United States Patent 7,868,149 (PLANT GENOME SEQUENCE AND USES THEREOF) - sequence listing, part 9

SEQ ID NO: 4200 - DNA, 35373 bp, Oryza sativa
  unsure (1)..(35373): unsure at all n locations
gggtgttagggttaaccctaaccgcccccacgatttcgccgccgccgccgtttttgccgctcacgcccccgcccttttcgccgcccaccgccgccatttcgccgccgaccgctgccagttcgccgctaacgacgccgccgtggatcgccaacgacgccgccgagggagtgccgagggtggcgccgcccttcctccgtcgccgccgcaccatctgccgccgccatctcccagttgcagcgccgacgcgtgatgcgccggcgttgctgcctccatatccgccgttgtccaccactgcctgcatccacaatccgccacccaccgctgtcgccatccaccatccactgccgccacggccacctcttcgtccgccggcggtttgccggccggattaggccgacggctcccgatcctcatcggaatcggaggccggccgagcccggacaccattccccggcaccccgttagggagtgtacggctaggagagccatgaggaacgacgatgaaggtgtggtggaggccgggacggcgagcggcggcttcaccggcatgacgatgagacgaggacggattgaagaagggcggctccctcgtgcgcgcagccagggtaccggtcccgccggaccccggtgacgcgggaatgggggaacggcgttggagtcaacttggtgtcggtggaagtggtgaaggagcggtcggtggtggcggcagcgactccatctccggggaaagatcgcatggctcgccgggcagtgtcaccactgctgtccatccgtggtaggcgcagtactgcaccccctgcacacagatacggcgaggcacgacggcaatcggagacggaggcgaaggaggagcaaccggagtagtggccaccacgatgcgtcggcgagggtggtggcgacgggcaccagccctagcccgacgttcatggtgttggtggcgaccgtggtggtggcggcgactcctctcccatcgacggagaagatggcgaaggcgacggacgcgctgattgcgagagaggccgagaacggcatccataatccaatgaaaggtaggcatcgtaccttctttgttgattcttctgttcgcttttctgttagatcaaaagcgatgtttcttccttctttcacttcgcgatctccttcgcgagagcgaaagtgctaataacatgttaaaagtgaataagattgattgagcgagagggattgagcgagagagagagagaattgcacaagaatgtagggaatgaatgagcggaatcctttattgatcaatgcggtacaatatatagatggggaaggggtggcaaccggagacacgatggttgggaaccatcgcgtctgttgccaaggagcgcctaaggaaggcgcggttgccttcggttgtgatccatccttttatatggatgatatcaccctgttgtttcataacagatccaaatgaaaaaaacaccttcgagcaataaagaagacgccctactttgactgatagtttaggtgtttaaccttcacccattccttaaacttgggtgtttaatgagttaattacaccctctaacaaggcttttaaaaacaccaccactccgcgaatcaagttctaaacgtctaagctgagctagtgttttacgccttcagaaaaggtttacgtaggacctgtttgacacagcttcagctcccacccttctggagttggagctcagccaaatagtttcaactccaccaaaactgggagtggagctgggttgagctatctcacgaaataaactagagttgtggagctggatttaggcagctccacaactccacattagacctaactcctataccaaacaggtccgtactaccattatccgccttctcgctgtactggcaaccgtatacctgaaggtaacacaggttatacagcacaaaaaccgtgttgttaatttcgcaattacccccttaaaaaaatccgttgactgaatcggaacgtgattagcgaaagcgttaacgcaccccaccaacttcctcccgttccccaccgaatcgacgaatcctacccgtccatcccatccgccagacagaacggacgggccagatcgaaccaaaatttccccaatccaacccttttgccacgaagcatccttctcgctgtctcggagtcacgcgagaatgagagaaaaaaaatcatgaaaattaggtgggaaaattaagaaacaaaaacccgtaaaaatcaccaaacacacgcagccaccgaccgaccgatcgaaggacccctcctccgccgacgtaagcagcggngggctcccagatctcgccggcggcggctgcggcggcggcggaggcggaggcggagggggaaggggggagatggcgctgaacatgaagacgctgacgcaggcgctggcgaaggcgtcggcggtgatcgagaagacggtgacgacgacggtgcaggaggtgacgggcccgcggccgctgcaggacttcgagctgctcgagcaggccgggtcggggggccccggcctcgcatggcggatctacacggcgcggccgcgggagggggcgccgtccgcgccctacccggtggtctccgtctgggtgctcgacaagcgggcgctcgccgaggcgcgggcgcgggcggggctcaccaaggccgccgaggacgccttcctcgacctcgcccgcgccgacgccgcgcggctcgtgcgcctccggcaccccggggtgctccacgtcgtccaggcgctggacgagaccaaggccgccatggccatggccaccgagccggtgttcgcgtccgtcgccaacgcgctcggctgcctcgacaacgtcggcaaggtgcccaaggagctcaagggcatggtacggagcgatgctgcctcgcttattttttgttaggtttccgtgtgcctagatgtccactttggcgattgctagtaattagccgctctagagtccacaagatctgtgatttggtttattttgggcatgggatgtttgctagctcaaaagttccttctaattaacatgttgaagtgattagtgttactgacagtggtaaactggcaactgtaccatttgtgagttgggatatatttagtaacattatctagatttgtgcgttagaacataatttgagctgaaaattgacataaggctttgtcttttgtatgcaacactttgcagtgccatatccagaaaattcattaaatgggatcattggtacttataaacatttgcagcgagctttctttgcagttaactttctaatgcaatcaatctgtctgaaatctgccaagtttcctgggaaggcatataaattgttacgtggtacttagaatacattcatttacaaaaagtgccgtgggttctataaagcatgacgatgtgtttcagctgtactgagatttgcttgtttattgttatgtttcaggaaatggggctactggaggttaaacacgggttgctacaagtctcagagacactagactttcttcataacaatgcccatcttgcccatcgagctatatcacccgaggttgaatgcagcacattcttcaactcatagtttctgcacgaatgtttcatgttatggatgtgctttgtcataaatctgttagaatcctttttcatttgacctgttttatttactttagttagtttctcaagttttctagtacaacaatataatgttctttgccttggagttgtctctgatgaatgcttagccaagtccattcatatcatgctgtgatctaggctagccgctcaattttatcatgctgttttttgcgcacttaactatgcatgaaatgagttcaaaagaatctgctgcacgaactggtgttgcgggaacacataatctaacactgcctgccaatgatcatgcatatactagttaatttttgaatctgtgatttcccctgctcttgcataatgcatttagcctatttggtcttcatctgcaagtcttatgttctgtcgttgtaataatttgatttcttttgcagacggtctttataactttgaatggatcttggaaacttggtgggtttggttttgctctttctgttgaccaagccacaggcagtttgacatcaacacagcaattccactattcggttagtaagtaatttatgcttagttgtgcattatgtgatagcttttaagctgtgtatttgttttaccattttggatacactaactaattggagcaatagcataaatatttctactataattgataaagattctcttagctgacctgattgcactccatgataaagcacataattcttcttgctcttttttgtttaactcatcaagcatgtacagctactgttatctgagttatttccacattcaatggaagtgcttttctttataatggcacaaatcatttcctacttaagtacttagcagtgaacaagtaaacattatttacaacttggcttcccctgtaattatttttgctaacactgtttgtcaatgtaattagctgtttgtggaacctgctttctaatacccatcattgtgtcattttcacaatttgaatcataatctatttgtctgtttggtccctctaaaggactatgatgttgaggatacagctttacctcttcaaccatctctgaattatactgcaccagaattggtccgaagtggagattctaaagttggctcggcttgtgacatatttagttttggatgtctagcttatcacctggttgctcgtagaccacttctggattgccataacaatgtgaaaatggtatgtcttgaatctggattttgacattttacctattcttaatgcttttttttttgaattttaattacctgatctctgaactgctgttggtacatgtatgtagtttccctttggtatgcaaacaaaccatctgttaaggaattaaggttgcatctgctgcaatgttagcatttttaaagatgtgttgatgtttcattttgttttgcagtatatgaattccttgacgtatttaacaagtgaagccttttctaatattcctgctgatttagtggtggatttgcaaaggatgctatcagttgatgtagcatcacgccctagtgctatggcgttcacaggtaaattatcacttatcatttctttatcttgggcataagatcttccagaatggagtttttggatgttctatttgattggagatcaccaggttacctatacttacatgaaattcttttgaaatgttgcaccttctgtctgataggctcttccttcttccggaatgatacgcggttgcgtgctcttcgtttccttgaccatttgcttgtatgtgtctattactccagtttcttttcacagataagttagttgcttgtttcatatatatgcatatcatagcttgcttattttctatctgagaatctcgtttgcctggcttaagtttcaattgtacgtgggaagacagaactaggagctttatctgcttgactgttgtttgtctaaacagacaacatactaatttgttacctagaaatggttataatcttgatccaatatcgtcttcaggagagagacaatatgcagaagacggagtttctgaaggcattatcggatatgtggaaggacttcgattcccgagttcttcggtataaagtatgagcaatccattatctccacttttcatatcaagtgtggtcttatgaaattatggccacattttcttggtttgtgtgctgcttcatagaagatgttagaacctgctaattatctaattattccatgttacttattcccagttgtctgataagtatttttgcatcgacagctatactatactcataaaattaacaggaagtccatcttaaattttcaattcaatatcattgcccaattctttgtgctattgagcttatcaagatcacatagcaaaatttcagtgtgttctagttattttgccaaaaaaaaaaatgttgagacactgagaactattggttgtaatattgaaaataaaaagataacatatacacacctcaatgttctaacttccattcctttattacataggtgaatcacgcctcctgtttgcttttagagaggaatcacttttgttgatccttctattagcattatcactttccttttttgtccttatctacagttttgattcaatgaatcaatgagaaaaatccaagaaatgccattgacaaacacccaaatccaagaaattccatcaatgagtgcgagttccataaaatgccatcgtacaaacgattttatctcagaaataccatcgctgttagggttcccccaatcccgcgccgttaagtgcactgttcatccttagcacttaacggagggctgctaatggaaccctaacggcaatggcatttttgggacaaagttgcttgtatgatggcatttcatggaacttgtacttgatgacatttcttgaaattgagtgcttgtcaatggcatttcttggattttctattaatgtattgaatttgcgcaacttacttatgtttgcatatgtgtgcatgcgaattctttctatcggaaggaaaaaaaatgctgattcacaatgttacttaatatattgactatctgtaagctgactctgtttgcaaccaggttcttccacctctctgtgctgagttacgcaacatggtcatgcagccaatgattttgcccatggttctaacaatagcggaatctcaggtcatgttccttgtgttttacgaatacctttttcttaaatattttatgaattatattctttgttcaatgatagtaagaacttatctcactgattgttaactaatgggatgataccatggttctgtaataccactttgcataatgtgaagtatcatattttatttgactgtttttcatctgaacttgcttttgactggagtaagtccaatttaatgtggttgtatcattcttgctgcaacacagagtcatccacagtactaacactcgaacattgttatttgtttgttatgcttcaatttcgtgagttcatagagtttgtaaagtgaaatacatttaaagctatgttatatggtaatgtttctttatgatgcaaatgctataatttttttttctgaaaatttgttctctgctctctggcaggacaaaggtgattttgagctttcaacactgccggcccttgttccggtatttacttcagcgtcaggtgaaacacttcttttgctcgtgaagcatgcggatcttatttattcacaaggtaactaagttacttttataaatactgcactgattcattgtttttgtttttgctctttttatctctatagtaaatgcaattataatctaaattcacaatggtaccaacacaatagttgtaattactggaattttccatggccagatgacctaatcaatttctttaccatgcttctcttttcaggccacacaagagcatttgatatcacatgtccttcctatgctggtacgggcttatgatgacactgatccccgactacaggaagaagtactgcgacggacagtgccattgtctcgtcagcttgacgtgaaggttagcattgaaatatattcttaaaatgaggataaactatatactgtagcttcattttctccatcacaattgagaaagccactatctttgcctctcgttgagtaagggctcacttgacaaattaacttcacaatgacaaaagaatcaacaattccacatgaaccatttttgtactcactcagtgatttcttcttgcagctactgaaacagtctgttctgccacgcgtacatggattagccttaaagactacagttgctgcggtatgcataatacatgttttagttttataatttgggtactttatgtgtcagattgtaccatattaatacacattaaaacacacaaatagcatgtatgatgaaacaactttttttttaaaaaagaataattaaaagggaaaactcctgtctcgtttgcacataaaataaataaacagaaatataagagccatgagatgttgagtgtatggtttttctatgtagctactccatcctatagcttgttattgatcaagagtgttaagatcttagatgttagtgtcactatagtgctattatataattcttctgtattttatcaccccctattataatcccgcctaattaccaggaaggcagccttctgtaccttatattattttgggttttatgtttctttgttctgatcttgattttgaattgtgacttgaaaatataggtgcgtgtaaatgccttgcgctgtttaggggatcttgttccatctttggataaagaaggcatactggagatcttgcaaactcttcggcgttgtacagctgttgaccacaccgcaccaacacttatgtgcacccttggagtggctaatgcaatttttaaacaggtttgttcttgatatagtttgtttcagtattgctaaatcatgaacaattattttttatgccaattgatttttccttgtaaaagatatcttattttactcatttgccaatgatccagtgtggtgttgagtttgctgcggagtacgtgattcctctcgtcttcccactgctcacagcacatcaactgaatgtacagcaatttgctaagtacatactatttgtcaaggatatcacaaggtaccttttgtcccaccacacttgcgatgcgttaatcaatatgccaactaaattagtgcctacttctacagcaagattgaggagaagcgtggtgtgactgttacagataatgggaatacagaggtaaaagtatcaccctcattggctaatgggattcattctgagccattgtcacgaggtgtgggacaaactgaacagatacaaactgcaaagggtgctgcatgggatgaggactggggccctactaagaaagcaagcactccatcacagtcatctgattccaatgcacggatgaagcaaccatcagacccttttgatttcagcactcaaacaaagcaaccctcggcacttccttttgatttcagtactcaacaacctaagccatcatctgcaatcccgcaagtgacaccagctacaatttcgcctgcaccatcacttccatcactgcaatctcttgcaccaagctctggaccccaaacttctggttcatgtgttcctgttgacattgagtggcctcctagaaaaaacacatcgtctgactttaatgcaccattatctgttagtgagcaaagtaaatctggagggctatctagtgatggtcttgctgatattgatccttttgccgactggcccccaaaagcaagcagtggtgccagcattttagctgttggacacctgtcaagcacaagccaaagtatttctggactaagtacaggaaatattgggttcagtggcaacagtggttctctgggacaaatgaaaaccaaccaaatgagctggtcagcgaaaccgaacactactaatttaatggccgtgaactcaacaggcaattacttgaatcagggcaactcagctcttggatttggaaatccaattggaggacggagtacagggtcattgtcaagcagcacaacacagggtccacccaggcttgctcctcctccatctgcttctgttggaagagggcgtggtagaaatcaagggcaatcggcactttcacgagcatcacgtactcctcattccaatgtttcatcagagcagccacctattctagatttactgtagcaattgagggccctctatcttcgttttgcaaatgttgaagttcctatatggtgagcatcatgccttttttcttcccaacctgcttgcggcagtagtgtatttacatgtcagttttgcaaactggatggtctgagactgaggcccccaaatgaagctgcttcagagccttccagaggttacagaatgttccctttctcaggagtcaggatgtcttcttccacacttggtcctagttggacaggcgaaacaggagaaattctatttgtgtataatatatttgttcagacggctgtagattgtagagttcatgaatacagtcaacatgtttgttgggatgttttgaatgcccagaatgtgccaccactccaccaggtttaatgggcctcgtgcaaatggacccaaggcgatttactcagatactcccctcccctacatgtaattcatttattctgtgaaggccccatgttgtgtagtccagaagtataggcccatcaacacaacagtaaccgttgtcgatagaaacccgtgtcttctgtgaattgtgattaaagttgttgagggtgaacgtgcatttcttttttttgggtcaggtcaccaccttgaccattagttttccatagcttattcttcttggtgtcaagtgcccatgttagtgctaaaacactcttctcgtgtagacagactagctttgttttggaagctagagattttaagtagttaataaatatacaactagatgagaatttagaattctgggtactagtttattttctaagggcttattcggtttggtggaattttaactcataggaacatgataaatggaggaatagaaatgcatgtacactttaatccataggaattttccaagagatttgaatggatggaaaattttgttctctcttttacaacttgttggaaggggatattttctccttttttttcaagggacaaaggggaggattttctttggttttctacacatagagattaatccttatgaattcaaatcctttggttttcctccaaatcgaacaagccatagttcctgtaataactattgagttggagaatcaagagttatgatctgaattgtttgggagagcctgagattttgagttgttgcatctaccagaagtagaagatccccaaacaggagctatacccgactgtagccaaccattatgtttttacttggtccatggacttgatatcacggagcatccgtccatcgatgaaccatgtgaaacatttcagccacatcagaatgcacacacactagcgacttagcgagcagctgggagctggctggctggccttcaaactccactgtgacggtcgctccatccaaccatatgcatgctcggggtcaacatccatccggccggcgtgctcccatctccatcatgccctatgtgtcctcccatcccatgatggcctcaccctcagagcaggtacaatagcaggctataagccagctgcagacatattttaaagagataagtgagaagagataaaagcagcgggctacaaatttgtagccagctatagcacggactttaaagcgcagtgtgtatgacagatgagaccatatattaatagtgtagtatgtaactatagtatgaatgagttattagattagctatagatgaattggagctagtagttgactatactattattaaacttgctttcactaccctcttgctcgatcggtagcctgggggtggctaaaagatgggcgcatcgtttgctacacacgagcccgtgcgacccctccaaactgcaaggcgaaggcgactacgcattgattgtgatatggtggctcttgtagccggggagggcaaggcgcggcgggataggccgcgagcaaccggcatgggtagcctcctgatcgggggaatactgcgagatagggtgcaaagcggatggatggatggatcatggcgtgccgtgcatgtgatcacattcatggtggggggtaacggatgaaaaaagtaaaggcaacgcacacgcatgcatatgcatggattttctctataaaaaaaaagtctagtgcaaatgtgattttatgtaagacaatgaatctggacaatcttttatcatatcctcacgtagatttatttttgtgagataaagggagtacctatggataggactataggtgtagtgtttccttgtgcagtacaacgaatctcggttaatggttttctgctgatctctaaacgatgtggtagtactttgtaattaaccacctcatcattagataaatatatataagtttgtttaggtagggatgaaagattcctttttgtcatgtcattggtcaaattctaaactttgaattgtttggattcgtctcctaataagcacttgctgggccaaaaacacattgatttacttggaattagtttcccaagaatactaatattgcgtagtttgagaacggatgaatatcttgtttggtttgctatcattttgaaccctataaaattatttgaaacgaaaaaatttggtaagtgacaacctgaatatacatatataaatattgctgctctaaaaaaaagtagttccggaagttttcactcaaatattatagaaatatggcaagacttcaaatcaagcgcattgatcacaacactgccaaaatttggtactccacataaatgtatgaacatctagagcttaaaatttctttaagaactagcaaacatgtccgtgtgttgtaacgggtgaaaaaactaatgataacatacgttttacatgtataaccatgtcgatgacaaacaaaaaattagaacatcttaaatgtaatggcccaacctcgatgatggcaaccttaccgatgtctgctttatctaaaataattggattattcatatttgctttacttaaagtaattggattgttcatatgacaacatgcatataatctaaaatattcttttaaactcattcttgcaaccaatcaaattctagactgcctcgcatggtcaagtctacataaaatagagtcataaactgtgcactattctctaaataacaattaaattatgtttattttctaatattatttttatataatatgttatcaagaatagtagctattcttcataaaaatagtctgataattgcctacagagatgtgcagggtctccaatacaggagaatagatgacgaaacaaaaagcagtgtaggagatggaaaaaatcgatgatcctatatgaccaagcatccatcaatttaagtttttttctgacagttttttcctcgtatgttttttttcttttttttcagacgatggaaatattttctcatatgtttttttgactacggaaacccttttctctagcgcggttttttttgcgcttttttctaacatttcattttttaaaccatttttattttctcgtacatttttcttttttaatatatgatggaaacttcttttaaatagttagattagattaaattagagatagataagagatatatatggactactaaaactgcgaatagaaattagacttttttttgccgcgctttttccggcctttttattttttcctcgtgcgtttttttacgaacgttttttttgccactctcttatagagtctgacctttctatatgttttttggttttttttattttttgcggattttttttgtttttcgctttgtaggaatcggacttttttttcccgttgtgggaatcggatctacatttgttttctcttttttttttgccaggaaacggattttttttccgtttaggtgggaatcagatatattttttccatctacgtttcttttttttcgccaggtatcggactttttttcctgttttaggtgggaatcggatctttttttttcgctagggaatcggatttttttagttgttttttcgctgttttttttatgttgacggacgacggaaacatgttaaattttttaagtagtagagatataagagtatcaccgcctactttctcatttgaggcctatttgttttagaggaatttcaaagaatttagattcctaaggaataattcgtatgaatgtcatttggttcatacgaatgtagatataggaaaaccaaaaaaaaattttcttccctacaagttacaaagagaaaacaaaaggaaattttccatctacacaaactttatggaaaaattcctatgaattgaagtgtgcatgtatttctattcctatgtgctgaagttcctctaaaatggataggcccttcaaccagctatttcttatttaatttttcctcatctgcttcctaatctcaaccattgaccacaatccctcatctgaaccataatcttaaaaagagaactttggtttgggcagcaaactacaaggcccatattattatgccaccgtgtctaggtagtactgtctatttccattcgcaagaagatttctcttcttgaaaaaaagaggtgtgcatgcatattttatactggctgtctcgccgtgatctttggcctggccatgattgggcagcggaacagtggaggtggctcatcaatccatcagtaccagctcgctcgtcacaagaaagttactcgcagtgcacgcatgattgagcgatcacgctgcagttgtcggtcgagaacaatgaattttagaatcatcatctttcttctacttcttctcggtgagaaccaatgcgctacatgtatatgtatacgtatacacatacaagtcttttagataatattttttttattgatccgacctctatatacatacatgtatatgtgtataagttggcacgtacctacagagctagccaccatggttggtccaatatgtactagtactacttgccaatcatacatgggatcgatccccgggtacagagaaacactgtgcaacgttcggacttcaacggcttagccactgtagcgcattgttgttgcgccaccattcgcctactctacttttagctactccttcactggctgccggaccatgatgcgatcgatcgatcgatccaactgcacgacgagacgttgaaactgttataagtacctgctacaacaatatactactttcgtcccaaaataagtgcagccatgagtttccgcgcccaactttgatcgttgttttatttaaaaaatttttataattagcatttttgttgttataagatgataaaacatggatagtactttactcgtgacttatgtctttaatttttttcaaaaaaaattaaaataagacgaatggtcaaagttgagcgctgaaaaccatggctgcacttattttgggacggaggtagtaagaacctagaatcagatgtgatattttttatactacaaatccgaaaaagttgaaatgtctcatccaattctagattcgtacagtattttggaacaaatagaacactccgtgagtcccataaaaactaaaaagaaacattattcataatataacataaaaactaacaagaaacattgttcataatataatataactaactgttcagattgatagtactgagatatgttgtatttggtattaggttcgtctttcatgggacggataaagtaaaactgatttagggcatgtttagatcccctggcaatatttttcaccctgtcgcatctaatgtttggacacatgcatgaaatattaaatataggaaaaaaaactaattacacagattgtgtgtaaatgcgagacgaatctttaacgtctaattgctgcatgatctgacagtgttgtgctatagtaaaactttactaatgacggattaattaggcttaataaattcgtcttgcaatttataggtggaatctgtaatttgttttgttattagtctatatttaatacttcaaatgtttgtccgtatatccgatgggatacgtcaaaacttttggaaagatctaaagacagccttagcctactactagtctttaatcattcccggatgctgtacatatttgtgtggtccgaccgatgtatcgatcgatcgatcgatcgagaggtacgcagtatgcacactgctgcgcgcagtacgtgagtgagtaaatcgcgtacgtacgcgaacgtacctacctgggaaggcgcgccggcctatagattttggacacatagtggtggcgtcgtatgaccgtaataacagcaggctggctcccaacatctggaccacgagctatagctccctcacgccgcgtcatgcataatctatctaatgaggaagattggaaagatacgcaaaataatataagtcattagcatataattaattgagtattaactattttaaatttttaaaaaaattaatatgattttttaaaacaactttcctatagaaaattttttgtaaaacacacaccgttttagtagtttagaaagcgtgcgcaaggaaaacgaggtgttttctcaccctatctcacgaacgaacgcagcatagtgatccctctatatcgttttgagatagtgatcactgcatactatgctacggtattgatttgctgagggggacagattaaattcatccatggcaaaatctgatccgaggatttattaccatgtgtgtatatgcacgtaatgttggatgtgtacatgatgaagtagcgatcgagcagacgatcaacgacggcagagatgggaacaatggaatatcgatgcgaggaagaaatggatagtggcattgtgacattgtgtgtggctgcagagagagagggggaatccaatgaggagagacaggtccccctctcctctgttcaaatctattggatgctctgcttgcatttgcatcgcttctgctcatcgatctctccagccatctctctctctcttcccactctcctgggattagttctcatcatgggtgacgacagactagtgaaagtctgaaagatagaggatgagaacgtaatatgtgttaggtttagaaatgaaataaaatggattaggtccatcagttggaatgattctatctacttacttctatttgatatttgagacgaaatgatcctttcttttttaaaatgagagggattgtatagtcttaattttttctttaataaatgagaattatgtgtagcccatatatcagtgagataaaggaggtgagttggattagtcgtttaattttttttatggaattgactcagatctagagataacatttattttcaaaaataatgccattctaaccatattccgaaaccaaactttcaaaagatagattcattccaatccgatctatcacatctctccaaccaaatactataaaacaccatgcataaacggcgtgtgcagccagctcacgcgcacggtgggggtctccgccgcctgccgaccggccccggctggtcgtcgagcgaagccccgcgcgcgcgcgcgcgcgcatggtggtctgtgtgagtcacgacgacgtacgcgacgtcgcacgtacgtccgccgccgcgcccgcgcgcgccaaagcgtcgcgtcgcgcggccgctcacagctcactctctcacggcctcacctacgtacgctaacacgcacgccgctacgcgccgcgcgcgatccgcgaaaatcccctgtgcgcgcggcggccgtgcgtatggaggcggaggcagaggtaggaggccagatattgtgcggcggctacggaacatgtgggactcacctgtgtctgctgtctatagctacttacccggcctcctctttttcacccgtacgtgttagcgcgcgggggagaagattaattacacctgttcgatatggtgaactctagctcatcgatctttttgtcatatgtgattaccttttgttagccactagaaccacacaagtaacataacatctcgcgtagtgtttatcttttttgttaagagtcggacaaaaagagaattgcatggatgctaagtgtaacaaattgtgtggtaggtcaaattatagatgcagggaagtgcttgtgtgtttttattacgcttggtacggagagatcagctaaccatgtccaatgcaccggtacagtatacatttatttctcaattgccgcacatgaataattcagagctattacctgcttttgtttgaagcacggagccaggtagagagggcataaaaggaacgattttgcaagtaggccccactctgtgggcttttggcgagacgagtacacatgggcttttcgtgggcttttttgttcccttccgctgcaaaacgttggcatctctggtttgaggcaggcaaatgcctctgctgttgccaacaccactcactcaccagtcaccatcggctcaaagaaaaagaaaaacaacactcactaattcaccatccaatccaactatgcatgagaaaaatggccgaaaccgaaaaacctaaccgaactaactgataccgaaataatcgataatgaatatttcgttcagaaattcgtcgattattcttactaactgaaattaatttggtcattagcctcggctaacttagctaatcaaatagaaaatgccaatacgcccttgtaaatgttccaaaataatgtagcacttgaattttgtaacaaatactataaattatcaacaaaactttctttaaaaaaattctagaaatataaaaaacgggaactaccttgttgagggcttaaagtgggggataaaatctcaagatgaagagaatatttcttggggacagtcttgagagtacaaagaggatgcatatggtagaagggaaaaggacttgtcaggcccggttctgctgtgtgaccaccttcaatcagatgttgagaacccagccaacccagggtgcctgtgactggtttgaggctactcccaactttgtcacaaaccccattacatggtagtacatgtcaaggagaagagatcaaggcagtagttgccatgagcaaagcctttaactcttggtggttggggctcatgtggattggatggatgcatctctccttctctcttttttttttctgcctcaaaaaccacaggagaacaacctatgcagaaagccatattttgcttgccatcatggatctgtgagatgctctctagctacctgaaaaggttgcaattggggtgtgtctttttaatgaaaaggctgcagcctttttttctttttctttgccctgagcacattatagtacagtttagtggcaactatcatcaagagcaaatagatgctgcacctgcacaacggggggtgtcaatgcaaggatggttagattgggtcagggaagtgaagtaattgtagctgtctgcggactaatgcaacatgcatgtatgttttctatctccctgtgcatataattgtgtacttacaaggcttcagatcgaaggagaggagacaataaaagcactatgaatttggatcatggtacaatgaaaattatgtaccctggcctcacctaatgctgtgtcatcttatgcttgttataatccttttgttcctactatgctttagtagtttcagttttcactctgacagcattaaagctttgcttgcctgcatctcataacaccacaaagaaagaagaagccctcaacatagaacaaaattgaaccagaacagtgtgatctgaacttcttttcatgacactggacttcttaaaaatacttgacttcacaaacacaaggtctgcaattaaaggattcaacataatatttctttatacacaatccaagtaatcaaatattctatttcagaaggtttgtaattggttaatactacttaggattagcaaaaagaaggttacataatcaaatacataaatatccacaaataaatacagtaagctgttgcttgactgcttggggattggacactacggagtagttaaattttacagaattttcagatgaattatttaaattcccgcaaaaacttcaggaaatctgacacccaaaggacacctaaagagatagcctcatccattttcttaaatttgaactgacctacattgcttgcatcctactacaaaccaaccatatcctagggcaaggactctgaacaaaaaaaggaaggaaaaaaaatattactctggctggcttggtccatgaggacaatatataattcccaatcaataactactgaatcccgatctaacatagaccaatcactcttcctggactagccagtactactactagtcctaagcaagatctatccagtctaatctcctttttatcttctcctatcctgccaagttaccattgccacaaacagcagtacggtcaaacaatttttactgcacatgccaagatttaattgtgggggtgttaagtgagccaatagcatccaatttaactgttccattggatgctttactccctctccttgttggtccttggcacatctcttcagaccaaatctaagcttagttactagtacttactagtagtacttactgccataaaggataactataacaattcttgttttgggatcttgagacacaatgcaacatttgaccccctagcttcatcttcagcacaaccatgttatttactcatgtttgaacatacatacaaagctcacaattgacaagtgtgtgaaaagggaaacatgtgaggttaataattcagttcaattctatggtttttgtgccatgtgacatctgagtccagcaggcagtaggcatggggtgtagtggtggttgcaggctcatcagagggttcaccaagtacaaactcagttaggtttgagttggaagtgcagatcaaatcagaggaggaaaagatgaaacaatgtggcggtgatttgatccaatgggagtaccaagtaggagtggtagctaggtagtgtgtggtgtgccatcatccgttgattaacctgtgaccccaaagcatagatgtgactgagtgaagaatcatctgatcatcagagaggatgaaatgataaacaaacgtggattgatgcattacacacacactcacaggtggatggtgatctgcattaagtaggacaggtgtgcaatgtgcaaccccatctacttttctcaactctttagtttaggggttcacaagaggggtagggtaacccccttggcaatattggctctctttctcacacatcttctcctctcatcaacatttatgccttggccactcagctcacatgctgggctgctgcttgcttctgctgcaacaacaaccaccaccaccaccaccaccaccaccatggccataaacatcccttgcattgcattgcatgacaacttttattggcattggatagattttgccatggcctcaatctgggtcaagcagacctgctcccttttagtatgcttgctgttgccatgctccaattgattcaccttttgtgctatctatctatctgaccttgaattcaatagttttctgaacgtccactctgccaaggtcaagaactgcaatggcttcaaatcctctcacacagcacacacacacacacatatatatatatatatatatatacacacacaagaatctgtagtgtgcaataataataatgggatgcaatgattaaggtgacgctttatctttccatggaggacagacagacaggccacaggtaaactataaatatgctctgcacaaaagaagagcttcttcatcagctgcatacactgaacctcccacatgaaaagctctgaaccttattaccattgtgcaagccaaaagccaccaaagagaggagatactgtcatcccaagcacacaactgatcaaggccatccatctctgtaatcacttgctttttctcactgattaagcagcagccagagccaatggctggcctgcaaactctgtttcttgtgccaggacgatttgttagataactaattattttgtgtttccttttgtgttttgtgagcacagcatgcacagtgcagtggaatctatggaggtctcagttctggtaagtgcacagaatgagggtgcagttatcccctctctttgctgacaggatgcacatggcctcttgttggatcaaatccatttgtttaaaaccttgcaaatcttgcaaacatggtggcttgcattgcccacacacacaggcacactaggagtactatattgctggcattcataccatatgcccaactagaactgatcttttggttaattaactcgggtgcttttcaaatgctcacagatcagagacagcttaattaattggctaagagaacacgtacaatgacttcatcttccatgtgagctgctataggcacttgaaatcaccattcaccaagagagctgtagtgactactctgatacaagccaaaatgaaactgctccctcaagttataaatatatagcatttatgataagatttgatcaaactttgaaactttgatcaccaataacatctgaaatgcttactttaaaaacaagaaatagtattagtagatttgcttaaaagaattgtcatgatatcataaaaattattacattttataaattattgtaatgtcaaaatttaaatttcaaagaaatcatgttttgaacataaaaaattccttatcacggagtattagcaagacatgtaatttgctttacgattcgtgcagttttctttaaaagagcagaaacagtaactgttagggaccatgcatgggctggtgtgaagcatttgtttttccttcttaattatagtacatttcatctgtctgagaggagcttgattattgtaaacatcatgagttcagcacctaatctgcagccctaatttaaactcagggacaagacaagaaccgcacacccacacacacatgattctcctgcactggacacaccactacagcagcagtacatgcatgcatcatccgatcaatggctctcaacaccgatctcgaggagcaacggacggcccagatccatccactcacataacttcacctctaatctccatcaacgagtgccctaattaactactaaccaactaatgaacaatccatgcatgcaccttgtgagtgatttgattaatgtgaagggaggagattataagagccagtgtcagctggactgcacatgtgtagtacttctgaatttctgatcctgcctgcctgtaatattccatgcacctatcttgcatgcccagccttgtgtaggctcggattaatcaaatcatcagatggacgctttggaagatttgtctcatgagagaagaattaagattaattagagagaggagcttgttaattagcttaatacggcttgctaattgaggattaaggcgtgctcatgtttaattactgcaacaaccgaccaaaccgaaagcaggagggccatgggggcttggagataatctgtctcctctaaacaaaacacgtacacgtccatggatgcgacaaccatatgtactacgtactcatgtgattattataaatcaaatcactggattttagattagatagtcgcattgtatactgactgggctagctactggcagcacctactgtattcccttgactgtttaaaaatgtgctaagtacattacaagtacattacattgctttaacattgggcaccgtcgtatcgttataatcttaatggacctgctagttaagttaatcagagacaacaatacattgttcacactctaaatatgagaacataatcatgatagcaaaggttgtcttttcatgacaaccaggaagataatccgcgcattagtttgtttcgaaaatagttctaacaaaaaaattaaaattaaagtaacgtattttcaattttgaattgagtgttctttatatatctctttcgtgaagaaatatcaacaaactttcattggttttttttttcattggttgaaagcgtttgtacggagtttatttgatttttactatataatagatagttaatatagtatttcttattgtttatgtactgagctgctatctagaaaatttggataaagaagtgagcaggtgagataataggagataaaatgatgggtccaccatgttaagtgaaaatcaatgatatgatgttttcctttttttctcaaaaagttttagatttctctaatttattagagcgccacgtgatggcttagtagcgtttgtaggagtcacgtgacagcttaaaagcatttgtagaaagtttagtggacttttatatatatttggttttttcgctttatgctttttaatttccgatcatacgatcttacattacgttcatataaacgtatatcatgtaattttttttttgtttttttaggtagtacatacgtacattcctctccttccatatgcatcgcatatgatttttttttctgtttacgaatagtacatcgtaccttcctctccatgcatcgtatctatattagaaggaatgattttaatagatttaatctaatggcctgaaatattatgtcccaccaatttaagtgaaaattaagtgctagatgttttgttttttttctcagaatttgtaggattttctctaatttattattagagtgccacgtggcggcttgagagcgtttttaggaagccacgtggctccttaagagtgtttgtaggaagattaatgaacttttagtatataatagaagataatagatagatagatagatagatagatagatagattgatacaagtacctttaatttcattagagagatcaattttggattaatcactgggaaagtttatacgcacgttccaaaaagccacataacaataatactagtacattattactgttctaaataggagaacataactaagactgcaacagtaatttctattctcttttaattacctgcacgttcaggaaagagaatgtatgatgtacagagggagtgtaagactattcgctggtttagggaaagaaagaattagctaatacgtggtacgtactacctttgccagcttttgagtagtactcgtaattaagtactccccttaattagggcacccacaatggttatctataagctatctacaagagatccatgtcagcatattttcctacttggaagatattaaatgaagagagagagcaaagctatctactagcttagagatagtctatagagaaaaacgaggcaatgcatgagagagctatagatacctatgtagacatactattgaggtggtttactattaatctagtctattgctgagatgtacatgttttatagagagcaccctactttaccattgcgggtgctcttagttgttaaagcttgtgtctggaaaaaggtggttcaaaacttgggcagtttgggtatcagcacacagagatggctggaaaccagcgaggcatttgcttaattaaattgttagtggtttcgtcgtacgtacttaacaggagtagggttcatgtgtagtaaggaatactccacgaaattaaagcagctacgtattaatggctctcgtgtgctttatcgtatcgatgagtttaggttgagacacttgtcgtgttctcttgtgctgacttttctttccttttttttttcgcctgtcatgtgcaagagagaaatatgtaccggtggtgtgtggaaaagtttgttgttaatcgcctgattaatcattggcggtaggcaaaatcatcgtacacatcgtgcacagaaagcatcttaggcttttagcagtcttgaacgcttaatcacccaccccctttttcttgttacacaccaccgttttatgatcgaatcgattggcatgcatggaaaagcatcattagtatggtctgtgatggtgaagtcgtggaacatattagaattcgaatcttcttatccaagaatatgatagtgtacattttagtttgtacacaggtcatataaaggttcagagtaatactaccactattttaaaagaaataaattagcatatactccctccgtcctataatataaggcgtacaagtgttttcaagattcaacctataaaagatttgaccaatacttaatataatatgaaatagattttatttgttaaaaattatatcattggattgagatataaatttactttcatatagttataattttgttgctacagaccttatagtttatgagaaattataagctagagattagttttggagaccgtaccaactttaaccgcgccttatattatgggatggatgaagtattatatagtactctgtttcatatcataagcgttttgattttctttaaagtcaaacttctggttgggttcatagaaaaaatagcaacattttcaagatatatcaatattgaattcaatggcattgattcaatattatagatgttgctatttcttttctataaactttgttaaagttaaaaaaaagtttgactttgaaaaaaaaacaacttacaatattaaacggatggagtctttaaatattaatttctttattctgctgaaaataactatgtgtataacatagatgaaaagttactcgtgcaatgtatacataattaattgtgttcatctgaaacctcgctaaaccattcaaaaaaacaagaagaagaagactggaagagctgtttgtcgagaagaaacgccgatgtgggtctcccggccccgtgaaggtcggtggctgcatgcgcgcctatcgcgtgccggtgcaaaacgtcacgaacgcacgcacgcacgcagctgagccgatgggcaattacgttgtgcggcgcccgtcccgtcctcccgcgcgcgccacaccccatccatcacgcagcctttcgagtacccggcgcgcgcgtacgtacgtaccgacgcacacgcagcgtgcatgtgatgggcgcgcggtcgcggacgcccatcaccccgcatatatgtcgatcggtccggtcgctatacgtacgtacccgcggccagccaaaggcagccacccagccgccatgcatgcagcagctgcagctagcgcgcgtaccgcgtgtagcgcagctcgctccacctcgctggagaggtgggtgggcgcgcacgggcacgggcacgcgggagtagtgacgatcgacgacggcatgcagcgacgcgccatcccagtatcaccgcatccagtccgccatgatgcgcgcgcgcgcgggccgcggccgagaggcgggctagcctagcaagctgccgcgcgtgcgtgtgtgcgtgtgcgttctcgtcgtcgtcggtcggggggtcggggtcagcgttcggcaccgccgccgccaccccgcgtatgagcgcccggtggagggggtggggggtggcatccggtatggcgctaaccgtacgtgactcgaggtcggtcgtttaccgtgggggggttgttgagccagcgttgtgtgcagagtagttggccccgcgaaacatataccggaagaaacgcctgtgtgcatcgggaataaacgagtgtgtatatactggagtactgtacgagtagtactactaattactgaagagtataggatcacagcaatttgcaaattgcaactactgaccgagcgtatcatttctgaccgatattttttaccacataacgtaagagaggttttctaatttctatcttatcatattgattttttagataatatcttatcatattgatatcaatactaaatagtttaattgataaatctggttaattattgatcgacggagcattgttttcgaaaatataccgtttttatctcctggcctaggtccttgttgcatcacatcgccgggatgccttcaggagtttcgcatcggtcctctgctctgttccctgtccgacacactcagtatctggtattcctaattaattaaaggagaatagaaagctgtggcctgtggctatagtagctccatgcacgtctgacgcccagagtttcatggagctgagctgcgacatatcgacacggtgatatgcacggtacattattgataccttgaacacatgacatttccaaagtctaatttaacagacaagccatgttatctttgatgtaaatgtaatcatgcaagtataaataacgcacactgcccggtcgagacatggccaacctataataattcaagacgaacataaacatctggtcaagcttttggcacgttgagtgcccacattcttcatagttcatacaccccggagaagagaatatcagaagagacgaaggcatccaatgagatacatacggtgcttcagggcttgtgcctccctggaagaagtgggtgctggagccgaggcttgtgtcatggcctgcaggccagtgaacagaacagctaaaaaggggcagcctttgtgtgcagccaaagcgttttccgtgctcagatcatggcctcgcttcctctgcaagactgcaatccagagcccagaaagacaaacacgcacacacatacacagagagaagagaggagagaatctactacgactcgtctacggcctccaggcacatgacatggccaatgtgacctccttgaattctagtattcttctttcttgccttcccatttctcctcttcattaaaaccgctctccatgtgtgtaacgtggggtgtatttagttcacgctaaaattagaagtttagttaaaattggaacgatgtgataaaaaagttggaagtttacgtatgtataaaaattttgatgtgatggaaaagttgaaagtttaaagaaaaaatttgtaactaaacaagaccctatcctttatagagctccaaacaagatgcaccaggagttttacaagtacagctgggagagaagagtaggttggttgcacctcacctcttatttccacccaaatagatcaaatattacatatagtattatttatgtaactaaaaactggttttatcctaatccgacaatgttatcactcctatttctccgacattggtctcatcctcaatcatcaggctagaactgatttttttttcatcccaacttatcgccaataaaaaaaaaagttatagaagtcaatattttcgtattaattgctattgcgtagtagataatcgaagaaagttagaacaaacctggtacaccctttttcaggagaaaaaaaagatagtatatggtacacgtcgtatctcagataacgaaagaaaataataccggcacggcgtgtaaacaaagcccaaaatcaatattcttcgctcctttttccatgtgtgcacgacgacctggccttggtgtctccatcatcatccgacttggctggcaacaacacaatactccagctttttagctctgacttgcacgataccatgcacgccgccactgtgtgttaccggccatggagaggctttttaattaggatccaatagttgttggtcagtggcgaccagtctcccctatatatgtgcgtggcaaggaaaggactatatatgtagcccaagcacatagcgtggtccggctttgttttgcactgtggtgtcctttttgaacagatcaaaccccctcatgagagaagagaataatataattattgtccctcttatgcttatagtgaaactgtttattagcaataaaattgatttataaataaaactatttaacgcgttttttttaacgctagaatgtacaatacgaaacacccaaaagtaactctgggattaaaattaaaattttaaatttccgcttatgcatatgaactaaaggctaaatgatgggattgtaaaccaccatccatgagggttagcttcgctggtttcaatatgtgtgcgtatgcaatggtacgtggtggtggcagtagtagaatggaagctagctttatcatcatcatagaaaacttaaggaatggaactacggaagcattggaagggtagacatgaagtccaagcttaggtagggatggaatgattttcagtgttgcaattcatcaccaattaatttttagtggagggtgaatttaagtcagcacaaatatcgtaaaactttagcatgacaaatgccaaatagatgacgcggggttttaagatataaccatgataactttttttttaaaataggatcacagcatgagctatttaactgtgtcatcctgaaagtatttccaatggtaatatacaaatatggttttcgtttatctaggttacttaatagaaaatgatcgaaactcaaatattgaaagttttgctaaaggaatcaccacatgttatatgagggcatgactgcatgaccataaatgatatagatatgaaatgaaaattgtcgttatatacgtcaaaccatctatatcatttatgttccttccgtcagtgtttttgttattgtcataatctttagaatcccatatgcttacaactacttttgtatgatggacgtaacataattaaggaataaaatccgacgggcacaatttacaatttaaaccgcacctctccatctccaaaaacctcaccattttgcaggtgaattgcaccgggttgagttctgctgtgcccatccagtaccctctccaacaaattaagcacgcacataaaaacttctctcggacttaagccactaattgcaccgaacatagctggcgatatgatatgatcggacacattaagtacttgcttagccggaaattcccagccggattacagctaattgccgtgcaaattttccccttctcgcataaaatttccggtggcttcgcatgcagtgtgtaacaaaccggtaataataaactaataatggtaaagttttgggcttttttcccagaacgggtaggccgtgtacttggcggccgctgtggacgctacaggagatcgcgtccagctggcacgagggcatgatcaaaacgccacgtatgatggcatgcacagttgcgagagttgccggtcaaaatgttaaaaatgagatgtacggactcatcttttcccttatatttatgtttatattttatcagttaaattttaaatttttaaccttaaatttagagttgattttgatttttttttcatcgtaatttatttatcagcttttgcttttagatcattatgaagacgtatgtaaaagttatatttataaattatttttcgtttgcaaactcgaataagacaaaagatggggttgtggttagtagaggtggcagtattgagattaaggtaaatgctaggggccaacatgggcattacaccggtaatataaacgctgctgtttataattcaatctgcgtcgtgttgctcttaatcctaaacggaaagcagcggttcacctacctaattattttgttggtgatggtgttaacgtttggcttgggcacttaaacagtacttaatcctacctatggctcactttcatagtggaatattgtgttatgccatccaaaccttatctccattaaaacactaaagtaatggagatcacttgtgaacatacggccaaaaggacacatttagcaacacaaataatacatgattttcgtagaaataagtttaatactcataaaattactccaaaattttatatttaccctaacacaaatactagtagattacagagaactagctactatattatgacgtgcatgcttgcaagccgttaaacggtgcaatttttaaaagagctttatgtatagaagtgcttttttagcaagtaaatgcaatatttaagtttgtattatagaagttttaacattaatcgtacgttaattatctttttagtaagccaagaggctaatctctcaatactctgaaatgtactctgctctattaatcttttcagttctacagagtgaaagttgaaaagttgaaatgtggtcgattaaatccacggaggccgcttagtcagggggcagggcttgccacgtggatgcggagggaatattccgtcgggatctccactccacggccgacgtgaaggtgacgacccgagcctaccctgagtggggcccactgcccacatgaggtggacgtgcttagctggcagtgcgggtgttctccccggacgcgccacgcatgtcttgctgaccctgtcccgtggggaacgtcaatttaccatactgcccttcgctctcctttttccgtgttttcttggttgcatgtatggtttgttggtagcgggtaggtaaattttacaaacatcaacttagggggtgtttttggtggtgttggtacaggagtgcaaagttttggcgtgtcacatgtgatattatatagagtgttgcatggaatattcagcactaataaaaaaactaattatagaatccgtcagtaaagacgaatttattaagcttaattaacccgtcattagcacatgtttactttagcaccaaattttcaaaacatagagcaattaggcttaaaagattcgtttcacaaattagtcgcaatctgcgtaattagttattttttagcctatatttaatacttcatgtaggtgttaaacgtttgacgtgatatggtgtaaaattttagggtgaggtgtgtttagttccacgccaaaattgaaagtttgaagaaattagaacgatgtgatgaaaaagttgaaaatttgtgtatgtatgaaagttcgatgtgatgaaaaagttaaaagtttaaaggaaaaaagttgaaatctaaacaactcctgagatctaacatgcccttaggattgagggctcgtttacactacaatattctcactccctcccatcctataatactgatcattctatactgtttagtataaattaaagtttaaaaagaaaatactgcaatatctcttattgaaatgtaagtaggtgagtagtggggataaaatggagagaagctagaataggagatgattgatgggacaaatagataggatgatatgaactattttgagacaatttttgaactctagaaaaataattattttgtgatggaaagagttcatcataaaacatggaaaatacatggtttagagtgtcctattgattaaaaccccccctaaaaagatagaaataactgtttcgatggaatgcagggaagcgtagcaattagaggaaagataaacacagacaattttttttccatgaataaaattcttccaagatcactatgttttgacaggggttttaactatttgtcacttttaaatttggtaaataaatatttgtcacccctatcttaatgacatatgggtccagtggcaaaaagttaattgccacatctaaatgtggcaaatggttaaatattcctgttttgacccaacacaaaggaatttcgtatgatttttttaactattcctttaatccaaagaactatatatgcaaattttctataatatttcatgactttgtttcaaaggagccaaaaagcttgctgaagaaaataataataattttagactgaattacatgcgaagaccaattttttttttgttttgtatagtgatacagttataatgaggaatgttgtgttgatgtttctcaccagaacttagaaatttatttacatatgatgacatagtgcatagctttttatttagttttatacaaggataacattgagacacaggaagcggttaggaaggaatgtgttccggtgtgcgtggttggcaagaacatgaaagcgaaaagcacagtgtttgttgtgggggcagaacggtcattttggcgtccactggaaatctatggtgtgctgtctcttctcatcccttctctctctgtttttgggaagcagattctctggtttttagggtatgcttgcgtatgcagtgtgagagagaaggctggaaagcttcgggaccgagctccatgcttccctctctctctttctctcatgaattttgatggcctcggaaaatgcaatatgcatccgtttttgaagatttcataaatgcatatttacatttgtttcctgcataagaacagtgaaaacagatgaaaaacatgattggttttttcttcgttatcattgaactatgtatttgttaccatattatgaaatttatgtatcccatataacttagatatctcttattaaagttgagtctcaagtaaaattgtggagcgttctaaacacaacactacatttcaaattcattttgtgagagtttcagccatctccactctctttttgagaagagcataaactgttggctgaactatagctcaagaaaagtaaaaatatagctggcactatgttaaaaagaccctaatacgtgcggacgtaaaatctaaacgtgggcgtaactggaagattgccactccatttcagaaattgtataagaaacctttgtgttgatgaaatatgttttttttttaaacgtcatggtgttacctaaaaggttatggaagattaaggaatcaatgtaactagagatatgcacgcttgtagaaagcttattgccatattatctaatacgtaattttcaaagcttctttgatgtgatcaaacttttatatccccgcggacattgtgatattaattaaggatggaaaatttcagatcacacgataatgttaatgagcgtatatgtaaaaagataatctctttacacgtattttgcttgctgactcatatagacatcgtgatgataataagggatagaaaaatttaggacatatgtaataaaagatatatgcatacgtgtttaaagcttatcactatatcaaccaacaacacgactacaaaacaagaccagaacatcattgaccatgactttttaagtgcctacgcttgtcgatttctgcacgaccgactttgacatcagtagaacactagttgccacatgtgatttttcaataaaaacaacgctaattaataattatggttgaacatagctgtaaagatgctcgaataatgacgtggcttatacttacctgagaaaatccattactcacgataaaataaaaacgccgacgttacgaaaacaacatgaaactaaccctttttttccaaacaaacaactataccctttcatctaagtaaacaactataaagaaaaaaaaactactaggagccactcaaacccagcttaaaagtttttacataacaagaacaattgaaactccagcacctaaaaacccaaaaacggaagaaggaaaccagaaaaaccctaaacttcaatgacactagagaccaaaaaccacaaaacccacaccagagatgacccaaataaccacacaacatattttgcactctgccccctggatttcttccataattccagggtagcccctccccaagtccccccacccactgctatttctcccccctgcttcccactcctcccctttcttcttccttctcttctcctctcttctgcccccccccccccccccttttcttcccttgacgctatcctccatttctcctcctcacggggaatccgctcgcgcttttgctcggcgatttattgctcgcagttcttgctgggtggtggtggtggttcatctcgccgcgggcgcgcacaaggtgggggcaaaagctgtgctgttcttgggggggtgtggttctatgcctgcttgcttgctcgggattggaggaggaggaggatttgaggggtgtaggtggcggcattgctgaggcggagagcgggagatccggcgatgtcggaggcggaccggatacgggtgcgcgcggcggcgctggcgctggacggcggcggcggcggcgcggtgcgggacaagccggacgcgaaggcggacgtgttcgccgatcttggctcgccggtgtccccgctgcgggcgcggtcgagcgtggcgacctcgtcgtcgtcgtcgtccgggtcggctaagtcgccggcgccggtcaatgccggggcgctggcgctggcgggcgggaggagccactccggcgagctgacggcggagagcacgcccccgcggctgcccgggcaccggcggtgcggatctggcccgttgatattctccggtgggagcagcggc

SEQ ID NO: 4201 - DNA, 6917 bp, Oryza sativa
tctcctcctcctcccgcattgcttctttcttgcttccgatttcctccgacttcttcgtgcatggtgctgttgctttcttggatgtggatgctaagctcttttttcccgcgagcgagagcaacataaatctagcgtctttcctttttccttaagctaatctgatttcgatttaggattgctgctgctttgtgcggcatgcttgatcgtcactgttggttaatttcttttttattttttttacgcttgatgataggatgattaagaattccatctttttgcttacgcaacaattgattggtttgatttgtggttgtcgaaagctacaagcttgtgttggccatgaagtaaatgtgctgttaaagtggttccccatcacacattgctgatgaaaggggagcgtttgcttagctgtattttgtaagctttctttaggtgcattggatgtaggccacacaaagctgaaaattttgtcctagttttgttctgactcgcaagatgtctgattttacagttggaacaaccggtgtgatgtaatttttgctagaattgtagattaaaccgattggaccttgcattgtctcaggttggggatgattagcaaggcgaggaggcacttaacgcaggctgggcatctccatcaatctgatccttcggagtgggagaagctgcaggaggtggagatgcatcagggaagaagcatagatgccaggaaagtcggggattggaagagcgcgctgagggaagctgatgctgccattgctgctggagctgactcctctcggctggtaatgtcaagcataaggttgcaaggaattgttggtttgtagcaattcacactgagtttgctcttctgtgcagcttcttgcgataaggtcagaagcacttctccgtctccacaagttggaggaggctgactcgactcttgcaagtttgctgaaattggacagcgtgttgctgtatcggatgggagccaacccgtcaggcatgctagctgagtcatatgtctctattgtccgagcccaagtcgacatggcattgggaaggtgtgattctctaaccctagaataatgctcaattttccacattgcggttaaaatagattagcatgaatttgttattctgtattctacaggtttgatgctgctgtggaggcagctgataatgctagatttattgatcctggaaatgcggaagttggaatgattctaaataatgtcaaattagttgcaaaggctcgagcccaaggaaatgagctctataaagctgccaagttttctgatgcatctatagcatatagtgaagggctcaaatatgagccctcaaatccagtgctctattgcaatcgagcagcatgctgggggaagctagagcggtgggaaaaggctgttgatgactgtaacgaagcattaagaatacaacctaattacacaaaggcgcttttaaggcgagcttcatcctatgccaaggtaagcagcaatcatatgcattaaatgtttatttttgatagtggaattgagtaattggatattgtttccactctatgtacattatgttgaccttgttaactattatttagctcgagcgttgggctgattgtgtgcgggactatgaggtgcttcataaagagcttcctgctgatacagaggttgcagaagcactgttccatgctcaagttgcattgaagacaactcgtggtgaggatgtatcgaatatgaaatttggaggagaggttgagatggtaaccagtgtagaacaactccgtgctgccataggatcaccaggtgtgttattctctactagttcttttttttcccttgatctcataccctgaaattaactcattggtgctgctctggtagcatcctgaacaatccgaaatactgccttctttatattcttgaaacatgtgttttactaggtttatcataccagacttgcctattttgcaattgactgactattgaacaatttgctatatcttcaggggtgtctgttgtttacttcatgtcaatcatgaatcagcagtgcacactaattacaccttcggtgaactccctttgcagcgaatgcccctcgctgaatttcctaaaggtgagacacttgacatgtctccaatcaaatacatccaacaagtgcttataaatgacactaacaaatctgcattgtgtgtgcaaaacaacaggtaaatgttgaagatagccctatggtcgcgaaggcggagaacgtgcggatagtcccaacattcaagatatacaaagatggggtgaaggtgaaggaaatgatctgcccaagcttgcatgttctgcgctactcagtaaggcactatgccgtatctagttcttgagaagcagctggtaccgaaaaccccgatttcccgatttcattgatgcatagtgctcccctttcccccctatagccttttactgtcaaaacttgagatgatgttgtcagcctccaccagtcccacctcatttcatcagctgcacaataatttccctgacgagcatgagcataatgagctaaaattggtatatgtggaagagcctccccaattttccccccttgccccccattccattccccatctgttgttactccttttttaccgttcatatgccgaccccattcaattctttcaccttctgggctctttcacctcttgtatttgatacattttgctttaccttatagtccaatagaaccagccaaccctccttctcaagaagggcaagtttgtaatgttgtttagattagtagcatattatcatagaggagaggagggagggggagagggagttagagagggatgatggttgagattttcattacatgtaaataccatatagcaaaaacatcagaaatccaattgaaggattgcttccctggagaaatggtggtatcaaaaaaattttggaggttggaggaggttagtacaggagaggctagctgtcattttagcgaatcaagagagcttgttaattggtgcaggatgggtttaggggttggtgttaaaagaaagattggtgtcattttgctgcttctgctgctggtttgtggtgctgatacataatgctaccatttccatgaataaaacaatccaacattctttttatcttcctcttttggaatttttgccttgctctcctttgtggttgtgatgatgatgataatgatgatggtgatgccaatctctgcacctggggtgagcattagtagcacagctgctgattgtgttgtgttatcagttataaccagcatctgtttttttttcatttttggaactagatttggttctgggagtgtggtggtagctgggagtgacacttgtctgtcacatctcccaatgtgcttgggagtgagagaaacaagaccttttcctctttgtgcctcctctctctctctctctcatcctctctcaagattctttttccttatttatggctatttttctctcttttgtggtggtcagatctgtggggtggggccccagctggtaatgatttgggccccagggccaagtccctcctagcctggcagagagctggcccctcttttgaatggggttgttggctcattcattgccttgaaaatactcctactactactaccacctctcctaccattacatttacctcctctctctctctctctctatctagtactccctcagtctcaaaaaaaaaactaaaaaaaaagacaaaccctggttttcatgcctaatgtttggccgtccgttttatttaaaaattatgaaaaaaataaaaagacaagtcacgcataaaatattaatcatgttttgtcatctaacaacaataaaaatacaaattataaaaaaatttcatataaaatggatagttaaagttggacatggaaactcagggtttgtgttttttttggacggaggaagtagatcttagtactagcaaggctagcccctacacaacagtacttaagccctcttgataaccatttaaagggcttttagcattctgtttagctctactggagtacatgggttctgatgatggcatgtgaatatgatagccagaaaagtcaaaagaaggcccctgtcctgcctgctctgattctggggctatgtaggagtatagtacacttgtggaaggaaggaagagaaataaacaacggtaggaggctaggggacgggtccacatgcaaatactagacaaacggagggggtatacggtaagtatgtcggtgaaggagtacttggcattttggctggaaacagtgtacaccctccgtaaaaattcaattccatgttcaggtttgtaactactgcctccgtcctaaaatataagcacttttggatctcgacatgatatttaatatgctactttgaccaacgatatctataaaaataaaatgttttaaataaaaagagctgcatattgtgatagtttgtttaatgataaatttagtaatatcaattttacatgattaatcttttttattattttgctattaatagtcaaagttagaaatatttaatttggcactatgctaaaaatgattatattttaggacggggatagtagaaattaattttttttggagggaatatgtggctattactcctatttgcagctccgtgaaatatttccatcattttgaatcttggccttctttgaaacgtaggaatttcacattaattttggagaaatcgaattggtccatgtgaaaatcatgtaaaatttctatatttcaaaggagtcttgggtatgacacataatctcacaatggttttagtggaacaataggcattctcaaactagaatgtcacaaatttcatctgaaatgcgcttgcaagcaggggcggatccgacataggggcggtggggtctcgagccaactttgggagccccacaaaaaccccgctaaaattttctgctatttgtagatgggagggggggctgtaagctttatcaagtttattcagacccccctactatctcttcctagatccgccactgcttgtaagaaaattcttttggttgaaaagtatcaaagaaaaatctcaagttgagattttttttttcatttcagtatatataatccacaaattacaaatcgaacaaagtttttacacgaaccatactcagcatctcctcggcaacaacaatattttgccgtgttgtggcttgtgaggcattgactccgttgcttactcgctaatctctatgaaatattatctctattctaaaatataataacttagaatcggattagatatatccgtctaaccaacttcgtagtgatatatcctagttctagttctaagttatattttaggatggatgaataagtagaggatgcaacatagaggagagggccgcttgaccgttggtgtactagtcgccgtaatgtacttaccagcggctaatcgtgcgttgctttttgaccagggtcatccatctcttctgctgcgtgcatcatcgtcttgtcgagccagatgcacaggcggtgaatggaacgtgaagaaggccaacgtttgcactggcatcacacagaaaaatatagagcgaaaaatatagtcccaccacccacaaatataaacatttgttattaagaatgggaagtaaagattttaacatccttgatctctattatcttaaaagcagagttatcctcatttcatcttattttcccactgcacgcaacgcgtttgtatgtgaaaagtaaccaccagatccaatgttttattctcaatcattctcccaaccgatctttaattatataagcatgacccattacaatgtaggagtatgttactagttaatcaagaaacaaataagagtggaatagttaatcaagaaacagatgggagcagaagggtagtggaggtgattgatggcaaaggcaaccatctataatgcctatatttatttacaaaatttaaacatttggaatgctaatatttatgaacagagtgagtatcgtttgctgatcagttttgacagcattatacatattaccatatcatatgatatggtactccccttgtctataaatataagcattccatgtattcctatcttcctcaaccactcttctacacccatatactcctcttttaacgagaagaaccaaaatattttctccaaatgtgcgagatggaaaaacaaacgaacttaccgatcaagagctcatctactaacctgaattaattcatctatcatcctcgtttagtcaaaatgacagaattaattggaattggaaaagaagttcaagtagctatcttattcttgtgttgagttggaagttagaactgctacaattgacgctatcttgatattttgttgtgatttgtttttttcccgtaaaacagaagattgaaccaaatcaaccacgatcaaattattctgtcgaattttctcaaaaacaaggccgaaccaatttttggccagattgaaaaatgcatatcgttagaaaagcttatacttcaattgtgaatggagagagtactccattatataccgaatgcatatgacgagtctcgtaatttaaaagaggcattgttggttagagagcaattgcattgatattttcgtcacgaacaccatcattcccatcttatagttcggttggctgactaagtcaaacattgcataaatgtcattgttgatgctaatgatgtgtctgacatggcaatggcatcaaccacaatacataatgccaacaaaataaatcaaccctccttgatgatgggcctgataccagatataggtggttgatccctttgcttctctctgcacatagcattgtaatttggcggtggcagatttacaaactgtttagaggctaaatgaaaccaacgtgctttgctgaagaatatattatatgcacacaatatttccgtgtacatagcgtgccaacaactaataaattttaccaaaaat

SEQ ID NO: 4202 - DNA, 9005 bp, Oryza sativa
atatatatatatatatgtgtgtgtgtgtgtgtgtgatgaattcaaggatggtactttatgagatatagtactaacaaaagtacacgtataatcttttttcaaaatttttggtaaaatttgttagctggtgtgtacggtatgtatacaagaaagcttgtgtatataggataagttcccgcttacagtttgctaacaacatctttaaacaccaacattgtggcatgttcatcagggtggtcactagtcaggccctaggtctactatatatatatttttaaaaccatttaaacactttgttatataattaagacatagttcagggaaaaatcaccagtacatcgtcaggatgatatatagggtccgtttggcacagctccagctccacctcgacctctcctggagctagagctcagccaaacagtttcagttccacctaaaatagcagcggagctggatggagctctctcacaaaatgaacagagatgtggagctagatttaggtagctccacaactccactctagatccaactcctgtaactaaatttagaagttagaactctaccaaataggctcatatatagaacaaaagcatagagccactctttgtttctaaacttccatatagcataaaacacatgagttcttttttttttaaaaaaaaagagagcatacagccatccttttcaaaaggaatgtgaactgaacaaaacaaaccaaaggcaactatagattagggatgcaatatagtgtaaagcacgtgaacaaatagcatagccactagtaaacctatatagcaagctaaagacaactatagggagatctttctcgccaagactaagaaaaaacaaatcatataaaaaatagtctttttcaagataaaatgaagcacaacacactacgactttacaacacccgtgaacttttatagggaaagatggacaaacatttaatatttttttaaaaaatgctaagttcaatctctatggtgataacacgaaaattttgtaagtcgtccactagcaagcccgagaggttgctacatggtggatacacagattatggttattgtacagaattcttagcggagaaacttaataccatgataacgatggacgcgtgaatttctaaagcccgagtgaataacatgtgtaaatcacatcaaaggcccacgctagcattgtggctatttacaactaatacctccttccaaaataagaccatcattgtttttccttatttgtcttatttgtttcaaaatagctacattttcatcttctgctttattaaatcataatacacctgttttccactctatctagtttcgatctatggctcatcatcggtgagccttggatcgatcgtacgcgcatccatggctcaaaaggtcactgtccaaaaacgctcgatccatccatgaccgtttccatcgtcatcatcttcgccatcgctcgtccataaagcgagaacagaaaggacgccctctttaataactgccacacagtgccggtgacgtcacatccagttcagtagccagcacagcacagggggtgatcgccagatgcagccgccgaccgggccggccacgcggcgcaaccaacgggcaggcagccaggcaaacgaacggcgtcgccgccgccggctgcccggcgaggcgaccaggcgattgcaaggctgccacgcgttataggctctcggcccgacgccgtgggatgtaaaggcgccacttggggtgcaaggcgaagccggtgcccgtacgcgtgtaccggctgcgcctgcaccgcacgccgtgtgcccgcaccgagaaaatggccgcagccttagccttcgaaggtgactcgagctcggacaatggccgtcgacggtaaagaaagctttagagagagtaaagtatgtctaggagttatcgcatcagatttgtgtcgagtttgagaatagagaaaaaaaagggagatgcgtattagaccctgtgtatagatgggagttaaacttatcagtccctatcacatcagatgtttggatattaattataaatattaaatatagattattaataaaactcattctataaccctggactaattcgtgagatgaatttaatgagcctaattaatccataattagcctatgtgatgctacattagacatgcgctaattatagattaattaagcttaaaaaatttgtcacgcgaattagttctcatttatgtaattagttttataagtagtctatgtttaatactccaaattcatccgatatgataggggttaaagtttagtcctagatccaaacaccaccttagtcttacatatttataaccagctaaagtaaaaactctaacaagctttatgagaaaaaaaatattaaatctatagataactattatataggtgagcgaccagatttttcttttaacctataagctactagattatggttgtagatgatgtgctaaattttataactagaaatcgactatcctattaaatttgctcttgggagcagtgaaagaatgaagacgtccacatgaacgcatagtaggtctaatttggaacgaacaattaaaaaagaaaccacatagattcattctattttcataggaataaaaaaattgttgttcaatgatactagtgcatttaccaataatctactgccaacttccttttcttctttgttctacatattctccacggtctccaacgtcaccttgaaaattactatacctctaaaagaataacgttttgacaatgcacgtgttttaccattactttctcaataatatatatttatagaaatataatatgaaagagttgttcataacaaatctactaattaaatactcacattttaaatccttttttcccgactattaatgatttaagattcaaggtttggttgcacacattcaaagagtatatattttagtatcctttttgacaacagaggtagtatatattttagttagatatgctcaacaaagtcaataaaaaaatactatagcatatgatgtcacctgcacatgaacgcccaaaccgaaaggtgcatatactcaaaatgcatcagctaaaaccactaaataacagggaatacatcagatgccacagagatctacaaagacgacatacctacccaagtagtgcggtttcatgtttaattcatatgcgaggaatgaataaggcatggatttaattcggccttgcgtcaatatatttgtctctcttctcagctccctgaattcgacaccttggcgatagcctcctgagggggtgggtggtcgaacttgcactgcataccaaacttgcacacgccagtcttcatgtagaaggcacataccacggcatcctgcatatcagcatatgcattagtttaggcatcaaaacaaatgctatccaggaggatattcatacatgactacattccgagaatgcatctatgtagctagatgaaagggtgaacaagtgataacacctcttcttatatgatgatgaaaaaagcaatccagggaacatcatcaagatcgttacaatatgcagggtgacggttacgatatgcagcttactatatcatcaagatcaatgctaacgggagaacatatgtaaaaattgaaaggactgcagcccaaaaatagtaagatcattggaacgagcggagtagccaaggtattaccgacaagctttgaaatgttacctctcttcttggtaggccagcaagagtaagctgcacagactcctcagcaggctcccagtttgcagagggatcgggagcagaacgatcaattgggtggtgaaacttgcatcggtcagcaaacttgcaaaatcctgtcttcatgtagaactgcattaagaaaagagcataacgctgtagaggcacacccagactatatgcgtaaagtagttgatatcaatcagctagttaataattcatagcgaagagactgtcatacatcacaaacagttgctccaggcctctggggataggtgactggcccaggtccaacctgcattttacaaaagagcatatcaacttgtgtatctcacagcacctatttccaactttaatttcctttgtttactcttacaggcatgtgtgccgcatgaaaatcaaagccttgcatgaagtttgcagatgaatttagcagcatggattccggagtagggagaatggtttgacccagtggaagtggaaaatttaaaactgcattgagcaccaaattaccataagaatacatgtcgagtcataagattcaattcatgtaagaatcatgaacactatcagacttgtttaatttagatgcaataacagatatggcagaagagtgcggctatcagattgaaggtgttaagttcaaggcatggacagttttgaacgttgaatacaatacaagcttgtttggttcatatggcaagttctctgcttgttttggctttaaaggtacagtagaaaggacacggtcttaaaaataatgtgtccaaaaagaagaaaagaaaaagttagtaaaacctggttagtatttgtctaatgtcttcagtattccagtcaaccgtgctgcaactcataacaagatctgatcatttattcatttcataatatttacatcagatataagtagctttacattgccccatacttgaattaatgaattttaagaaccttgaaggtacctagagaatgaattcattccttctcttattctttaatgcattgtattccttctgcctcgcagtataagaaaccatgcagcggcataagaaaaggttaatggcaacagataccaatttctattgtactgccacatggacttgggatgaataagctgaggtttggtggataataacagattagaaggaagacaggagtctggatggatcagataaaacagggagaaatagaagtagaggtaaataaacttgtttattccttgctgccaactaagggttgtagagatcctttttcatagccacataaacagataagttcagccaatgcatcagctcacaaactatatctccaacagataagcctaacaacgtatctgagaactaacaaactaattgttgagaaacagataaaaatacacaaccaccaccactcaagctcttttacagcagagaagtagggggtgcaaccgagtggaaactatgccacaagtacacccttgatttctgcaaaatattatgaaaaaaatgatcctaaagaaaatgcactaatattatgaaaaagaggagtacaaggctattacgtaagtgctctatccaaccagggcaaattgcaagttaaattatgctattaaatagacgagcagctagatgatggttgccacgctccttctgagaagtggaagaaggccaaaaggatcttaactacctcaaattcatgtcatgataaatttaactttgtgaatatggttagttgtgaccatgagtgacaaacctagacgatcaggatggttgaatcgacaagtagaaccgaacttgcaactgtagagggacaaaaggaaatgtgagattccaagtatctccaaactcatgcagaagtgccaaagccaacagaaaatagtgttattctgcttaaggggatacctgcccatcttcatgtaaaaaggacaatcaacttcaccctgccatgaaggagaagagaaggtattaaacaaaacaagcaaaaggtatttcacctagaatcatgtaaatagacaaaaagatttcactatatacaccagtatattgataaaaaattcagtcttatcaataccccaaaaaacagaacttgttgagagaggaattatgtaccaaaaccatgtaccaggaattgagtacaaaatacagatgtgcggaatctaagcatagagcatcctcaacatcgttatcttgcattacataattcacaggtcttctcaaaatggtttacgaatgaaacaaagttatcaggcacttgataaggacatactggtctcataggcagccctttagagttaaactcttgcgcagcagcaactggagtttgcatcttcgctgaaactgaatcagctgctgaaccaatatccgtttctccttcaacagtcactgcactttcgggttcattttgacttgaaggtatttcaatatccttgggatgattgaacttacacattgcacgaaatttgcatttgcctgtttttgcataaaactgaggtacaaaagcacaactgaaaatcggtttttaagcttgatgccatacaaaaaggaaaagaaggtgcagtagcttcttacagaacaaagtggctcagaaggcctcactggtaagatagaactatcagcaattagatgcttctgcaatttcataaaagagcatacaggttgagacctgagcggttgagatgatgacatgttagtagtctagtaagtaaatggaaacaacttacatcattggtatttccagacgctaatgcattaaccttttcctttggatgattgaacttgcatttcgatccaaacttgcatttaccagtcttcataaaaaactgcatcatcaagaacaacattatgagcatatttgtcatattgattcaaaaatagggctatgaactgcttacaggacaatctggttccccttcttgttctggataggattcttcaacatttgcagcctgctaagaagttttaagaaagcaaaccagaagggatgaatttggaggataaaaagacacaattacaaccacaaacatcacaataaatatttcggaaaccttaaaaacaccaaattgcataaggtaattaaccagagccagagcattttattaaaagtggtctagaaaaaatatatctactgaaaactgtagtcgtgtcttttttataactatatacccaaccccccaaaacactcaattccgatgtttattggcagttgaagacttgatgtacagatgggcattcatcaaaagattaaaagccaactactattaaacctatgactgtgaagagaaatgtttaaaggcaagtgtgcaaatgtttgctgattggtctacaagaaaacaagttcctctaagacactgcaatgccagtacaccctgagtcccacaccagcaatacatttgtcagatgagtcacagcatgcttcattgcttcagccagatcaaactatatattctccataaaaggaaaactaagcagatgtatgcagttgcaactgcaaagaaattatatgtcatagagtaaccaaacagtgcttaacactgacatatgcatgaacaagagccacccctaagctcaaatatataagccacatgatcaacaaagaatatcaattccatgtctttattgtgaaattcacacttgggatagtcctactcacaaatcttggctggactcctagtgctgtaaggtaccaaaaaacatggtgttgacacgaattgccaatatagcccttatacaagatcagcgtgttatccaatgcttcaaacagcagatgctaaagcaatgcagcaacaggagcagacaaatatatgccacaaatgtttagttcacacaataattttttttgtccaaaatatccggtttcctgtcacaactgtttttcacttaaatactgtcaatcaataaatgaaagctttgattcctaaattctttcttctaaggttcaaagaaacacacataattaaccccacctgcactcttagattctttctttcctttttgctactagcgatgctaacagtaatacacttttggttttcaaagtaacatatacaccttaaaaatagtattataatatacattactataaaatatagacctctataaataataacattgacaggtgatcacctctttccaatttggaatcccaccctctggaacccattgtggatggtcaaatttgcaggaacctccgaatttacaggttcgggtcatcatatagaaggcacagtccttttcccccggtcgctgtggatatataggaaggctgctttcaagcctagggcgcttggtcatagtatttgaagaatacaaagcctcaatctgttcaacagtactatggcttcccataattggctgatgatagagaactatagtagatatacaaaagaactttataagctacatgtattagacaagaacaaaagcaaggataatagtaatagtgaataggtagtaataatagtaatagtagtatagagaaaaggatcaaggatgacaactgattactgcactagtgcactacataagaaaacaagacaagtccagttaaccaaggattgagaaactatcatgatggtaaaatgacaaactgcacaaagctctcactgctagaagcacaccaagtccaaaggactaccaagtaacttccttcaagttggacgagcaacagaagcatgtcaatgaaaacaactaagctcaacctactcaaagaagatctatcagaagcttctccgactgagaagctagtgaagaagatcagtggtggagccaaagctctaactttgtggtgtcagatgcatgaaatgtgggaccaattcccatagatttaataatgttctgtaggcatatccactaatccatacatgcttttgctgtatgttgcaaaaaactgtaggggcatttcatttcagtcgaccacacaactttaacatggctcccgcaatggagaggataggttagtgatcctgaaacgcttccatcacacaggaacaaaacagttcaaccttacttgcctcagcctcagccatttttaataatttaaaaccgaccgaccacgagacaggcatggggattggttagtgctaaattatgctatgatttccacgtagccattctccgctacattccaattgaaattaaatatccaaatggagcgcatcttgcggtaaaacgaagtaaatcgtacgtgttgggatataatacaaggtaacagaacccagccacaattctctctaccaacaaaatgaaatgatctgcactaaatgctgcaaagaatcccccctcctcctctttcttgtcagcctaacaccgacaacaagccgccatagcaaac

SEQ ID NO: 4203 - DNA, 8457 bp, Oryza sativa
gacttctcgatcgctcatgcttgtccacgcgcgcgcgttaatccccggccatgcccgctgactatgaaaatttggaaagcatcaactaaaattagtgccatgcatgtcagtttgatcagagatttggaagggcgccatcaacagccgagatccatctacgcctattgccgcatgtcgacggcgtcgtcacagagcacttgggcacggctgagctctacttatacttgccgccacatgcggacggcgtggacacagagagagcacgcgcggtcgaactccatctatgcctactgccgcatacatatagtgcttgcgaccatcgactcgccaacctgccgcctcgcatggtttcgcatctggaactcctcccgtgcagtatgctctgtcaacaccatcgtcggccaccatggtaagagcaagctttattattgagaagaaaggctcgcgggtagtgctgggagagagaagcttttttaactaaccaaactcatcagcatatgttgcatgtgctgtaaacgggagttgagaaggtaagtcttgaatgcttgcatgcatatgtattggaacgaacaaaacttcaatgcttgcatgcgtttaaacggctgccgaggaggtgccgccttatattgtgggatttgagaaaaaatacaggtgccccctatattttgggatggagggagtactatagtactagtgtctatctagttagatgatattctcaaatactggtacataaaaaattttgatcttgtgctctgagcgatggctaatcgatggcaagaagtggcgacatcataagggttggaggtaagaagatgagctcgactcctcatcaccagtttattgtataaagatagtgacaatgggctgagaatggtgtgaagctaagccaagttggtactccaaaatctccaattttatgttgtttcatatctttcgcattctcgttaagtatgtgggtttagtggatgaaaataaagacaattctatccttgttcaaatgagctatgttcacaagttgagttttattttgctaaattatcgaggcttgtacgactaataataagactgtaaaatgttattttaataattatgacatgctaaataaatgtaagacttttcatgcaaattttgcgtagcatcttatttgcataattgttgcaatgtggtttttgaattgtgccatgtgttattggtcacactctggctatgacacatttacaattttatcttggatccaccactcaatcaatatatggcatattttttcttaaaaattactatgatctaaaaaaactacaaggactatagattcatttttctacaccaatttaaaatagaaacatagcgtgacacaacataacaaaccaatgcaaagtttgatgtagccactttccaatttctagctaaacgttgagatatataaccattcgtatcctagtggctcaaatttttagcgaggaagcttgattaagaaacttaattccacaaaatatatgtaaaattggccgattaaatatgaaattactatactacgctaagagtgtgttatagctaaaacgtgactcaaagtagtaaatttttaactatgagggcaaccatcgtcaaatacccctattgagcctgttagtttttgaggacgatataactagaccgtaaaagttttgctatgaatgcgcatagttaatgcacactcaagatactttttagtgcatccgctattaaataaacacatattttaataacattgattttgtacataatgcaaggacaaaaaagaatatttgttccattttatatattataacgttttgatttttctttaaaagtgaaactttttaaaatctgtccaagtttacaacatttacaaccctaaattattttaagtaaatctaatactgaatatatttttgctaacatgtttgttttatataataaaaatattaacatatttattcgtaaaattaattgtaaattgtaatatgataacaaggcccaacaaaccgttttccaggcccatgatagcacagcctactcgccctgccgccgcccgctgatcccccgactccccccaaaacccacgccgccgccgccgtctcttccctcccttctccgccgcagccgccgtatcccccctctctctccgggagctgaaagcgcccgaggaggagatcaggtagcctgtttattctcacccctagtatcccgacgcatcttgttttcttcttcttttttcgttacattttgtggtgggtgtggacgttgtcgcaggttctttggccatggtgggctggcgggcggcgggcggcgctcgtgccgttcttcgccggctcagcgcggcggcggaggcggcggcgaagcaggacggccgtgtgttcgctgccagctatagcggcagcagtggcggcgtgaatgctccgtttggcttgggtgcgttcccgtttgtctctaggtcttagcttttatttagttttgaacttatacatgatccgaatgctcatcagaagtacagactttaggtgatttatagttgatgttgataagaatgctgaattttttaggataaatcgcgttgtttctgttaaactctagtattaattttggattcagttgttattacacccttcagtatgtgttttttatcagtcgcactccgcattggtacttgtagctttggtactatcagttctttttataagctctgatataatttgaaatgatatggtgtgctgtcaagactatgtatttggggggaatggctgaatacataatttcattttgcttaaagctcttctctttatttcagtaattagtatagcgagaacattttggtcttgatattctcgttacgtgctaacaatgactgccaccatgtaggccaatatgcaaaccttttgagggcacaagcttttgcatccaggggagtcgcgctgaacttccatcagctgatccgcaatgctgtaatgcactcttccccatgtggccatgctacttcatcttcttttgcttttacatttcttatctctacaagttgatctcctgttagaactaaatcaatccttttacaattgcctatgtatgacactgattgaattttgaagagcacctcgataagtagctgattttgtgtctgttccatattggagccacatgtatatatgatcacattgcgttgctttgtaatggaatatattttgcttgttccgtgtttgacagaaaattaaattaactgaacttcggtcacactcttatttacatgggtatttggctcttttttttttctgtagggaatatctaccacaaggaacctgcttgctgcagatgatgctatggttcctgtttcttctcctttgacacctccacttggtgatggagaacaaactgacaaaaagggagcaattgttaagcggctgaaggtccaagccatcaagaaggatatcaagcaggtgaagaacaatgaaatactaactatatttccccctaaagtgattacatatgctgtcaccagcagtgaaagtttgaacgtgcagtgtgtcatgcctttgctgcattaactcttttatgtatcctctaacatgtttaaatgagactttcaatggttagtggcaaagcacatttaaaagtaacataatgaaagcagcaacatttcaatgtctgatgccccttttttagaagctgcaggtattgtttagtatatgtttttagcttctcattcataacttaatgttatatagttggtacaatcgtagtgttcactgagctgtttcctagttatgatcctgcttgattagagtaagcatatgttcatgtaggttatcaatatatcgagatagtagtgtagcacagactttctttatcttgtttagtgcacatattcttttactactatcatcaatagatgctcatctctctattttccctttttggctgttttagagccccaagaaggtgaatctggtagcaaagctggttcgaggaatgcgtgtggaagatgccctgttgcagttgcaagtgacagttaaaagggctgcaaaaactgtatatcaggttctgtagttaacaaaattttgtcctgcaactgctccttgtggtagatagggtcaggtgtgaccaatatttttcatgatcattcctttctatcaatcactgcaggtgattcattctgctcgtgccaatgcagctcacaatcacggactggatcctgataaacttattgtgggtaagaccttaagacaacatccatctcccccttagtccctccaatagtcattcgtaatggtttcaatctcattcctttctttccacttacctatcataccacagaagaggcttttgttgggaaaggactttacctgaagaggttgtcctaccatgccaaagggcggtgtggcgtcatggtgagaccgaggtgcagactgacagtagtggttcgagaggctaccgctgaggaagaggcaaagatcgcgaaactcagagtcagcaactataagaagctgaccagaaaggagaagcagctaatgccgcaccgtcttatcgaggttagccccgaggtgggctcgcaagaggaaagaggaggctggtgctgctgcgtagcatggcttcccatttgcaggatgtctgccttcattggccttgaagcggtgagtagccgcatatgctgaaatttacccaagaacaattgtagctctctcaagaatgaattcaaaggtctcatttgtcaggcctgtctttgttctgtttgtttcatctgtatgaaatttgtctcatgaagcataggaaactgtggcattgcccacgattctactcagaatgaataatgtcacctctgatattttgttcggcctgcctatttttatagttgtcttcgctgaagatccgtattcaaagttaaactattgttataatcacaagtcagatttgttaattccgttgatctcggttcatggaatatggtgtgccagtttcgggctcctttggaaaagaggaattttcgcgggaaattttgatgaaacaactaattcctataaaattccttcgttccaagaaagccgttgaccaatttacatgacatcaaactacaacagttaccggaaaagattcagttgaatttcagtccatcgaatcaatttcactagtacgatgactgactttgttcaagcaaacggtcacttttgatccactgaattgtatacaaaatttcctacacaaatatataagagaaaacccaagaaatgtcattgacaaacgtccaagtcctacaaatgtcatcgaatgagtgcgagtttcatgaaatgacatcgtataaacgaccttgtcccagaactatcatcgccgttagggtcatttccatcttgcgtcgttaaatgcattgtttctcctataacacttaatgaatggatgctaacggaaccctaacggtgatggtatttttggaacaaattcacttatacaatgacatttcatgaaacttgtacttaaatttcttagaattgtgcgcttgtcaatagcatttcttgaattttctcaatctgtaaacgcaaggctacaatatttgggccgcaaaatagactccaggccttcaacacgggcccgcctcctcccaggcctcaaaattcgctcaactcgcaataaaatttgccaaaatttggcaaaacccggaagagtcgcggtgcctaaaccctagtaccaaaccagaggtcgatccggttcccagccatggccaccgccgccgtcttctccgcctcggcccgccgcctcctctccaccgtcgccggcggcgccggggccggatccgccgccgagctccccgtcttgattggccacctccgcagcctcgcccgcgcgggccgcctcgccgacatcgacgccgccctcgcgccgcacctggcgtcccactccgtcgcggcggtctccgccctctcctcggtgggcctccccgaccgcgcctccgcgctcctcgccaccatccggaacccaaccgccgcgcacctcaacgcgctcctggccccgctcctccgccgccaccgcctcgtgggcctcatccccaccctcctcgcggcgcacccctccgtcccgcgcgacgacgccacggagggcatccacgccaaggccctctgcatcgccaccggcgccgactccgcgctccacctcctccagcgggagtcgccgccgccgtccctccagctcttcaccagcgtcatcgactcctactataagcagcgcaagccccaccgcgccgagcagctgtggcgcgagatggtcgaggaccacggcatcgtccccgacgccgccgcccacaacgtcaggatcacctacaaggccgccaccggcacggtggaggaggtcaaggagctgatccgcgccatgcgcgaggatgccggcctccagccggacatcgtctcccacaacgggctgatgcgcgcgatggcgcggcacgggagggtggacgagatgatggaggtgtacaagaggctggagaagggtagcgcctccgccgcggcggagggcaagtcggcgccggactgcgcgacgtacacctgcgtggtggccgcgctgtgcaaggcggggcggtggtcggaggcggacgacgtgttctacgaggcggtgaagcggaggaagctggccgacctcgggacggcgcgcgttctggtgcgaggcctcaaggaggccggcaaggggcgggcggcgaggcgggtggtgatcgggctgcgcaagaagttccccgaccgcttcgacggcccgtggaaggatctcgaggagttggccgggatcgccggcgaggatgaggagagcgatgtcgaaggggaggacgacgagcagccgccggcgacgacgacgaccactgccgcgtgagctctcgcagtaatttggtcgtgttcgtggttttagcaaatttgcattcgtggtaatacgaagaccatataatggtttaggattttagggctggatcaataagaagcaaattctgaggatgcgagaatcactcaaattttgtcaaactagcttcttgaatcacaccataaaacttctttaatgtgatgtctcgttgtaatgattgatcttgtttctacatctgatggctttgttttgtttccactaatttcactcacaaatacttttggatgctgctggctatttggtaattgccaatttgatcaaatcatgcagaaaaagctactccatccgcactaaaatatacatgaccggattagataggctccctgtccacgctctaaaatgtacaatcgatttacgaccggattagataggctcgttgtccagactattgttactgtcaaattcgatagtactaggattctagattactgccaaattcgatactagattgtcatttacggctgggttggagtattagttcgttcttaggttaaacacatctcccatcctcgaacttggcacggtaagtttagttttgtgcctacattagagaggaagatggcaaaagcttacgcaatcgacgcttaattacaagttgttgacgatgtgagtgataatgagttttctgttagaggaaatgcgccatgtttctcacctttaagcgcatgttaggatatcttgctttttagcataagctgcacattgttttctggaaaaagtacaccgaagctccctcaacttgtcatcgagttacaaaatcgtcctcgaaccacaaaactggataagtagatccctcggtggttttgactccgattttatccgacgtagcagctgactcagcgtggatcccacgtgccagcctcctcttcactcctctccacctctccctctctcctcttcttttctcaccagcagaacagcgacagccggcgggtggggaggtccgggaggaggccggtgggggaggcgggagtccggcggcggcgggcccgcgcggatggatttgggcggctgcatcggcttcgcggggggcagccttcatcgccctcttggcgcgggcggggcgaggggggaactgcgcgccttcttctcccacttggcagacgccgccgccgccgacgacgcggcttcttagcggcggcggaggggcgcggggtcctcttcctcttggcgccgacgacgcccttggcggccgggctgcgggcagcgaagcagagacaggcgagcgcggcggacgagttcgccgttcagtgagggaggctgccgaggagaagaaggcgacggcggccaggtccaaggccaagacggccgccaaggccaaagctgagcaaagctccggccgcgaccgcgagcaagatgaccatggagccaagccgctcgcgcctccctctcctccaccacttctcgctgctcgcctcgctgtgttccgcgcggtggcgagacgacagccgcggcttcctctggtaccccgccccgcgcccccctcggcgtggcccgcttgctatcgtagtctacgctcatgacgagacggccatgtcgctggagcaggaggtagagctt

SEQ ID NO: 4204 - DNA, 14548 bp, Oryza sativa
  unsure (1)..(14548): unsure at all n locations
caaatcgcctcgccgcggacgctccgccctgtgctggtgctcacgccggtcaccgctgacgaggtgcgcgcctacgtcgtctgctgccgcgaccacggcctcaccgtccgcgcgcgcagcggcgggcacgactacgagggcctctcgtactgctcgctccggccgtccggcgacggcgagggggcagcacgtttcgccgtcgtcgacgtcgccgcgctccaggcggtgcgggtggacgcggcgaggggagtggcgcgcaccaaggcgggggccacgcgcgccgtctgccgcatcggcgccgctggactcccgcctcccccaccggtctcctccggaagcagatcttagagggatgtacttcgcttcatcagcgtccattccgaatcctacggcgacggcgcgatttcctttttcgtcgtccttcggcccagtagctgtccagcgttcggcccagttgtcagttgcggaggccgaaggggaaaaacagagcagcgaaaatgaactagaaaatgaaacagagcagggaaaatgaaacgccagcgaccgcctccttcgtcgaccacctctcgccgccgctcgtcgcctcctgtccaccggcgctggcgcgagtggagtaggtaccctcagccgcgacgctctcgcctaccctcagccccgcgtcctccccgtgcgggaactctgctgcccctccatggatgtcgaggtctgccgtctccgtcgacgacgtcggcctcaacgcctcctggttcgaggccaccaccatgggccactgccgcgccaccgtgggagggagggctgctgctgctgccaagcccacaccaccgcaggaggaagggcggccaccaccaccatgggcatctgtaggagtgcgacggcaacacaagccactgtagcagcttgagaagccaagagtgagattgagaaatgatatgaattgatgttgtaaattgatttgaattcataatgtggctcaaactgattgagaaattatatgaattgatattggatgtgtttgtcaatttgtatggcaaaaagagattgattcagtatagcagaagaatcaagaatgtcacttgtgttgctgttgctgcattgaacatatgtgatggctgagtttttatacatatacagatttggttccagaatgtttgcttgcaaaatggcaaaagaaggctaaacctgactgttgtgctgtcaatttgtgagcagatctgaacatgcttataaactaacttctccagggcagacttttttgcttgcttgcaaaatgccaaaaaaaagaagagcacaactgaacatgcatacaaactaacttgtccaggacagacttgttttcttgcttgcaaaatgactaaaaaacataagtacttcaccaggacacaagctcttcagtaaaaccatcatctgtgattggtcactgtaaaaaaaacaaaaataagtaagatttttctaaacattatctcctctagatttgtaaactaacttactgtcaacagttgagtgaagctatcaatggcctcgtaatcttcaggctccttccatttatccataggagcactatcatctgcaagttgttcttctgcatcacctacctcttccctaaccttttgtatcttgcagacaaagaaaatttgagggtttagagaaataatggacagaatgataacactggaaacataattgttcttcagcaacataccactgattttttttgttttgttttttcattttttcctctctttttcctagtcttctggtttttatcgagccaacctcttgttcgttttgaacttcttgttttgacctcctttttctttagacgtgcattactcaacaagtcatttggtggactaacatctgtctaaactgtacatggatcctcagaaatgcttgtacatgcactgattttgtcttcaatttgcttaccaaggatgtcaagtgcactgtctactaacatggtgcactctggaaagttggctgctcgatgtgctaaattgagaaatttgtgggacataaacctgtagcgaagcatagcatccatgtttggattttcgattatatttctccccaaattgtcttgtatagttccactccttgcttctcgtgtccatcgcttcagcacgtagtgtggtggtaatgacttgatattcatcaaatcaagaactttcagagcatgggcacacaatatcccaattctatcgaatcgcctgcagctgcattgaactgtttgcttcaaaggatctccgataactttgtactcctcctcataggtgaaatctcctactagatattcattgttaccatccaattccttgctgcaagctgccaaggatttttcatattcaccttgaaaagcttcaaatataataggtgtatacaacttgctagcttgcaccaacataggtggtggcctccgcatacagattttaggcaactttttccttgattcaaattctgaattcagtttagtattcctttttccttgcaccaccctttcaaaatgcttaaagaaccggatgatatcaaaatcagatttaaaatggtttttcaagtcattatttagactttcactcaattgtgtacttctcattcctaatgtgaagacatctttcatatagcattcggcccatttttctttcaacttgtatatactatccaaccaggtttgcttgctcacttttgccctcatgatgtcaaatttttgttcaaatgctgccatgtcttcgtactcatatatgcatgcactaaaatctgacagaacacttgtgtcttctttgctctcctcattcttcactccacctaaatgtttgattgcataatgtggaaggtgcataatccatgccacgcttctgaaaacacttctgcaactgcctttcccattgccaaatcttggtcggtatagattgttttaggctgctgtccattatgagcttttagaaaggtctcaaacaaccatttgaggactcaaaagtctcatcatacatgagagcagcactaaaaattacagtttctctaaagtgattgaatcccacaaagacaccaaaaggcctactctcattgtttgttccaaaagtagtatcaaaactaacaacatcaccaaaacgtgcgtagtctgcgatcattttagcatcagcccaaaatatgttcgctatttgttcttcacaatccatttgcaatgcatattggaatgatgggttctcagcaattttgtcttgaaaatacttaagcatgctacctgcttggccatatgccatctcccgttgtcgcttggtccgtagatagttcctatgatctcggagtgtgtagctaaggttgagggatccaccaacttggcgactagccaactcatgtgccgctttcggtcctattcctgcatcatcggctgtttcaatttgaaaagcttgcaaatctgaaatttttctttgtgacaccattaaatgtatggtttccggcaagtgtagtgcatggttgtgttccaatatcagatcagacactatataatttcccttctttctattcattttgagattcatgtggacttgacaatcggttctagtttcagctcgaggacacttggttaaatgatcccttttgtcttgcaatcgatgaccttcatttgcacaaacaaatctacatgatgtaacactgccatccgacttgcttctgtttgtatacctttttctaacctcaaaacctttctgcccactgtagctaagccaaaatgcccaagcctcatctgaatttgtaaattccatgccaacccgaggtaccaaaccaggcatcaagttatctctgtattaaaaaaaaactaatgagtatgaaactagtgcatagatatgctgaccaaaaatcgccaaaaccatgctgtaaacattgattacatattagcacacattacatgctgtccatggccttgtataattgtattacacaccaatgtgcttccatcgcaggactgtttgacattgtttgatggcaggtctcggcaagattttcagctagctgcttcttccatgagaaaaggggaaacttgatcgatttcaaagcaacctaatggtggaagtttgattcagtgagccattcatgagaagtagaggcctagagggcataagagagggtttagacttacaagattgaagtgcagaaaagctcctgtccggcgatcacctcctccactcacgccaaaacttaacaaaattgttccatccgggtacggcgatcgctgctcattggccgctcgcgccaaaacgcgcgagtgtgttccttctcgcgcgctttgccgccaatcccttccactgacgcgcctttttacctccctccgcatggtttgcaaatgggccgaagggagcagctgggcaacgctgttgggccgaacaatatagaaccaagcagctgaacgtacgaacaaaaaggaaatcacgctgtcgccgttggattcggaatggacgcggatgaagcgaagtacatccctctaacgtagatgaggatctgcttccgtctcctccccacccagcggctgtgctgcagtgagccagtgagagaaaagaagagagagagagagagagagagagaggtggagagtagggctgtcaaaaaagctcggagctcgcgagcagctcgagctcggctcgtcgcaagctcagctcgagttcgactcggcaaggattcgagccgagctcaagcttgtctcaaagctcgcgagctctaccgagccgagctcgagctattcggcagaagcttgaaattttcactcccgctacccatcccaatttttcccgcactccaattccaaaatcctaccaccaacagcagtccatcacctaaccatttatttcccttatatccccatcccgtatccaaaccatagctcatttgctctcttcctcgaaacatttctcttctagatctacaatcctaggctgctctagtgctccactgaccactgctgtggatctagccaagcaccgtccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaactgtgtagtgtttagttgcttgatgggtgttattgatttacattgaattttatggactaggtggagacatggagtagtacttatcttgctgtgctcctcttctgaagaaagactgaaggttgcagaacaccgtgtgtttgccatttgccaaggtaaattgatggcaatgcttttcttgttgtacttgtttgattccttcccttgtgcagaatatatattgatagcagttggtatttttaatttttgtagatgtctgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggcactacaacacattggcggaggcatttagagcagtgtgattatcacaagcttcaacaaaaatccataaaacaacataatatcaatttccctagccttgatgaaggtgatgttgatcttgatgctccttgtgtttctgtccctggttattatgatactacaaagatacgtgagcttatttgcaaaatgatcattgtccatgagttgccattttgccttgtggagtatacatggtttaatgttttgctaaagaggctaaacccttcttacaaaaaggtctctagaaataccattagaagtgattgtatgaggctttatgaatctgaaaaagaaaaactgaagaggactttcaaagatgttagaaagataagcctcacatgtgatctttggacctctaaccaaacaatttgctacatgagccttgttacccactacatagatgctgattggtcaatgcattgtcgtgttattaactttcttgagttggagcctccacatactggtgtagttattgctaatgccatttctgattgtcttgcttcatggagaattgaggacaagatagctagcatcacatttgacaatgcctcaagtaatgacagtgctgctaacctgttgcttgccaagtttacaaaacgtggttcactttggttttatggaaaattccttcatatctgctgttgtgctcacattttgaacttaattgtccaagatggtctggctgtgattaagcatataattgacaaagttagggacactatcaagtacatcaagaaatcaaacaatccagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtccaaagacccaattcttaaataaatggcaaatgcaatgcttgaaaaatttgagaagtactgcggcccagaatgcaatactttgtttgcagttgctttggttctagacccaaggtttaagatgggtatgattaactacacattccctgctttgtatgaagaaactgtacttcctaagaaacttgcaaatgtcgaatccacattgaaatctttgcatgcatcatatgaaagtgaactccagagcacatcaaaggaaaatgatgccaccactcaatctactagtacatctctaggcactactagtagtcatttctctgctgctagccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcgagtgattagtgattatcgcagctctttactcccatcaacagtacaagctttggtgtgtacatctaattggattagaggaggccaccacaaaagcacagatttagtaagttcttatattttcatgtttctacccaattaatagagatacacaatctaataatctgtgtttacttgtttgttgcatactaggaggatgatactaattctattatccttgtcccaactcaagcttcaactgcaaattcggttgtgggcagcaattagactcgtttgtcaggtatatgtttgaggttatataaattatctattgctaccatatcaattcctcatcactgatgaaacattacctataatctttgcacatggtttcagatttaactttacgaaacattaatgcaggcatatagcatagcatcaacaattagtttgaagaaagtgcttggaggtttcacattggcgtactgccattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaatcctattatgacttatgcactactatgaatttgtaatctttctagtatatacctgtcgagaagctattatattctataatgaatttgtaatcctactttggcttgttaagaagcttttattgggagataagttcagattgctgaaggaaacagtcttaacgagcttctacgaattgagctcgagtcgagccgagccttgatcgggctcgaaccgagcctaccttcaagctcgaaggtaatgctgggctcggctcgagctcggctcgagcctgtaccgagctcgagcttaggtaggtaagctcgctcgagctcggctcgttgacagccctagtggagagggggaagaagaggctgacacgtgggacccacgctgagccagctgccacgtcagataaaaccggagttaaaaccgccaagggacctactttacactggttctgtaagttgagggatacgttagtatccggttttgcggtttgagaacgattttgtaactcgatgacaagttgagggaccttcggtgtactttttccttgttttccactggcgaaacttgtgtaataaaaccgcgacatctgggacgttgatcgccgatctgacggctctgcgcgtgtctgcagccactctacaagactacaactactgccaatcccggcccacgggccaattcagccgcgcctctccgtgggccagaagatgctgcgccgcctaccgntccgcctcgcgccgacgctcgcgnncgncggcgncnggcgccatcccccaccgcgtccttcgcggcgcgtgcaccacngcgcaagcctcaaggccnccgccctacccgctctccccgtcngacctagacgccgtctccgcgctcctcccgcgcctggtctccgcggggaacgtccccgccgccggccgcctcctcaccgccgcgctcctcttcccgggctccacggagcgcctcccgttctcnccgctcgccgcgcacctcgcctccatgcccacccttcaccccggccttcgcgctccttcaccgccaatccngccaccacccgctccgcccctcgccgctgcccctcgccacgccgctcatcgggccacctcctctcgcgccgccgcgcccgcgaggccgcctccgtcgtccgctggctctgccgcccggactccccgcagcggcccgacagcgccaccttcgctgtcgccgtcgcggggctctgccggctcgaggaccccaggaacgcgctcgccgcgctccgggagatggccgtggacgggatacggacctcggcgaagctgcgggagtcggtgcgggacgcgatgctgcaggacgcgaggatcgaggaggcgtgggcgctggaggcggcgatgaagcagccggactccggcaagctggctgagctggtccagaagcttctcgaagagtgggaggactgagacattgccgaggtcgaaggatattggttctcccttgcttctcgatcaaggtagaatttcccaatgcatttttcttcgatttgttcaatgtctagtgcaactgagcatgtgatgttatcactgagaaattaattagtgaaatactgatatactccatgtggtgatatgatctttgatagcatctgtaaattgttcgctgagcagtcgataatcgtgtcaatgcgattctctaaattttcgcaaacctgaaagcttcacctgatagagtttgcaaatgggttgggaatagcatatctatgaaattgtgtcgacattagttcagattgttgcagcatgagagcccagaaattcatatggtggagctttcgcaacaattttgcagagtttcttgaatccaaatacgagaagctgattttgctacaggttgatgtaaaaaatggatgtgcagtttggtgtaaaactggatgtggtgttcaaattttgcaaccataccaaagcatacttttcattatgaaagatggacaccggtgtcttatctatgcacaattcttaaaaaggaatagtaagaaaaagaggcaaatggtcagacctactagtagttatatgagggtatcgtttgttgatgggaactctctgttcatggtctgaaaattaacacaggcaaactttgcattcttgcaggcacaacgtgttgaaaaatggacttttttcagaacaaagaacagacagttctccctaaacagagagtacaaagcttcgggtttataagaacttgcaagattaggattacaaagcttctagtttataaaaacttgcaagattaggattagcgattgatttatctatcaaagagatgtttataagaacttgcaagattaggattagcgattggtttatctatcaaagagatggtttataagagatgataagtcacctgtacaatgtcgtgattctattcttttagggtgtgtttggataatgaaaaatgggggatgggattagaattgggaaatgaatgaagggttaagattaaatgaaagagggagaatgaacagttacgatttaaagatgtctttttgtaggtgggaaatcatttccctttcccattagccgaacactgccttagctgaagtcatttgggttccacataatttatctacatcacagtggctagttttataactgactggaacttttcgcttagactctatttagtttccaaaaaacatcacattgaatctttgaatatatgcatgaagcattaaaatatagataaatgcaaaaaaaaactaattgcacagttagggaaaaaatcgcgagacgaatgttttaaacctaattagtctatgattagccataagtgatacagtaacccacatgtgctaatgatggactaattaggttcaaaagtttcgtcttacggtttccaagcgagttataaaattatttttttcattcgtgtccaaaaaacccttccgacatccggtcaaacatctgatgtgacacctaaaattttttttttcacgaatgaattgaatcgcaaaagctaaattgcatgggccggagtcttgtcttctgaattattttttcaactcctggttaccttctggctgacaaggctttctttgaagcaaatcacaaaagctagggtattgatttacagatgcctcaaaatctgaggtttaacagatgaaattaccagagagtggcctgcgccgagagtgggtagtaccagaacttttggcctgtttcgtgaagaattttgaggtaaattgggtgtagagttgtaatatgaacatcatttcaaccgcgctaagcctctcaataagaagagagcaaaagccaggacaattgagcacagtttcagaatatcccagtattattgagaataatcacgcaaaattggcagacaatctggtacagtaatgcaaaaaacgtttaacttgtttgcaaaagcacaaaactgccaaagtacaaactgcctaacatcaatatcctctgttccagcgcagcatttatcaagcaaaaagaacaaaaacatccagcatttcttttctttccagatatacagcatgagaactcttcttacccacttctgccccccttggcttacagaaaagggtagggacgaacacgcaaaccacaatctcacaccttcaatgagattcagcccggttccttcaaaaacccaccgaacgagcaccatccttcgcacagtccgcatcgagcacaagaacattttttcttcctcgagcgaccaaagattaacgaggccagccacgacaaaactgatgcaattcaatagaaacagcaaaaagggaatgtgtaaatccttaggccacctactgaagaactaggcatgcacgccatttccattgggataatatgttccattggaaagaccattggcaagcttctttgcgtgcccattttggtgtactgtagatgtgtaagcaccattgctcagagaatgtttagtagaaaccacgtggccattgcagctgccttgcagcaatctatccagttgcccagatgaggcagcaattagtcctgcaaaagtgtagtgatgattaacatgtagtttcgaaagcttgtgtttacactttacaacacaaagtacaattaaaaaggttcgtgaacaagcatactgaaccaaactacaagcagaatattatttggcatcttaccgacaaagagtggagacggttttgaaggtcttgacttgaattcaggatggaattgtgcaccaacaaaatatcggtgattggggatttcaattatctagaaatagcaaatctgtcaagaggtaacagtggcaaaaaaggaaaaatatttaagcaagtctcagttttagtcgaacctccattctccttccagtctcatctttcccaacaaactgaagtccagcattttcaaactctggcaccatatctggattcacctgtgaagttgtagatgtttcagtccatgttacaagaagcaaataaatcgaaacttataagagcttaaagaccatacaatacatggaacatttcatagcatttagatgtacatctatgaaccgacacaatgtgatcaacagacctcatatctgtgccgatgcctctcatctacataactgacattgccatacctacagcagaacacaattatttcaggggatgcaacaaatcgcaaggactcttaagcactggggccataatggttatgcagaaaggcctatatgtgcactcacaatttagcagacttgcaatcagcaacctcgaaaaatgtcctccttgatcctaggcgcatcgtgccacccatatgtgttttagaaccctgagttaacatacataaagatttaattcaagggaaggcagtgggaagttgactttaaattcaaagaggttcccaaaataattacctcaggcataaaaataacacatggggtcttggcattgggatcaaattctgtgctgtttgcttcagggagattcatgacacttcgagcaaattcaaccacagcaagttgcattccaaggcatatgccaagatatggtacattgttttcacgggcatacttggcagccaaaatcttcccttgaatacctctatctccaaagccaccaggtactaaaacaccattggcaccctgagatgacaaccgttcataaaaccatgacaggcaataatttatccattataactcatatatgcaacagcattacaagtttttcaaaacgccaaaataatttaaaaaaaaccttaccttcagtaaatcccatgctgctttataagcatcaggcgcctagaaatttagcaaggaatgattaagaaaagaaaacagctcaaattggtttgaattatgctgctactgcctaacctcaatggcagtggagtcttcgagatcagtagaagcaacccaatcaacaagaagcttcctgcggcaatcaacagaagcatgcaagagtgcctacacatattacgcagcacactcagatattagaaaacaactgtcaaatttataaaatacaagcatattatcaccatggtaatctagctcaccttcaacacagagaggtatgaatcagatagaccagtatacttcccaaccatagcaatcctcacctgaaatgagagcattagtcaatgggaactaagaataaaaagaccaaatgggaaaattgaagtaagaaaaaactaacagtatcctgaagtgcatcaaataacgtagctcttgcgacccattcatccaactttggcccccgagcaaagctgcaagtttataaataaatatccaatcgcatcaactgcctcaatacacaataatataggttggggaaaatttaaatgactagatatatcgacaaacctatcaaggttcagcactttaagaatggcttcatgtgccttttggtcctaaatggcagaaatgagatatgcactgttaaaacaggatgtgggatacgccaaaaaagaatttttttgtaagggggaaaagagagatgtgacgtacccgtagcaacaaaggaatacgccaaatgttggaaacatcatacagagtgacaatgttagctgcctgcagaatgccaataaataatgagctaacaggagcagttttagctgccaaagcttattgatcaatcctgacaacataagtttacagtacattaccggtacatggcagaactgagagagtttctccttcacattttcttccagttcctgataaataatattgcagttcaagaaatttagtcttaagaaaagattcagggactaccaagatacagaataaaggtaaatgaaaattttcagctaaccttagtactgcgacaggctaaaatatttggtgtgagcccaagaccccttaatccacggacactatgttgagtcggcttagttttctacaagagtaaatagcatagatgtagaggaaattgtcaaatgtattgcgactgcaccaacttaccaaaataagaccataaaagccataagatggattaataaacagtacaacataataaatgaatcaacagtgtggtacctgttcaccaacaacattcagaactggaacaagactaacatgcaccaaacaaaa

SEQ ID NO: 4205 - DNA, 1115 bp, Oryza sativa
tatttggccacctttccggccagagccaactcggcctgctgtttgttgccccagaggaggacaacatggagacgatcgtcgctcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagattctcgaacgggaagtctaacctacatctaactagggaagtgctttgtatttgaggatgtgcggactctggggttctgaat

SEQ ID NO: 4206 - DNA, 42300 bp, Oryza sativa
  unsure (1)..(42300): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgcaagtgccaagtgattgcagttgccatggtgcttgccttattcaaaattaagcttcacatatttatcattcaaaggattatgtgtgaaacaatttacttctgtttagcattttgatatcttcttcaagcacatctttgaactagtttcttatagaaagatggaagtgtcatgaacgaaggattaaatataaagatgaaagaaatttagaaaaaaacaatagcatagtcttcaattgtcatatgtcacagtactcaacccatggcatcaactcctaaaattttaagaaggctgacctttagaacattaacaagatttgtttcgctattatcctgcagacgatcaggtcgatgaagtttatgaggatcaagtccgcacaattccagcatatttggaacctctaggcactgcatataggattatttttgttaatatgtccattaaagtttaaagatatttgaaagacgaaaatctctagtcaatccaaatttcgctgtgttgttggtaaaaatttgagcaacacgatgcctgaaagagtgaatgaacttatgatggtaatggtgcatacatattccaatagggtactcactgaaaatatgaattagctaatactgctaataataacagataggtccctaatagatattgccagaaaaggaaaggaaatagcagagaaggcataggttcctttcccatatggtaactggtaaccaacagtgaacatttgatgtgtacttctatttctcaatttcaaggtctaatgaaacaatttcaccaacaaaaaagatcgacagataatttgaagatatgatttactgcatcataaggattcatttttttgttcttcagatatttgatattagaacagattatgtttagcaactgtgatcagcctgtttaattaagaacatcaaatacggttaaccagtagcaactcaaataatgcatatatgatatttacttgcgaagtcaagtcttgacatgtcagtaatatccgagtgttcccaagtccctgaaaattgaatacaacttataaggaaaaacttcacatgaggaataacaaaatgctcagatgattttctgcagcatataaaaaattcaactgcatttctaatactttatagtcgttctaaagactgggaagaatcttttgtgcaacaatgttcaatataaacagggggaatgaaggtgtatttttctgtacgcagaaaataataatgttcacatcgatttcctgtctgtagaacagtgtgcatatgttccctgttttgctttgagatgtactaatcaacccttggcaatactaggagaccagtgaaaaatatattataagaaacatgagatctgacagaagaaataatttgtgaggtatgaagtataaacatttacactgaaacaacaatgtctttgggagatagcatgactgacctggtgagcaaatatatcccagaatagaggccccactatagcagtttcccagttatgtacatgcaaaacatctggctgctttccggattttacaatataatccaatgatgcacgtgaaaaataggaaaatctgtaacaatgtattcatagatgttaaatgtagtcaaatatgctagttatggtctatataaccgatcagtttgtttcaggcctaaataacccttttgtcgattacatacagctgtttctagctcaatacaacacatgaattgttatgtaccaaacaaggtatcaaagcaagggtctaatagatacaatcaacttaaagggggaatggaggatcatgtgttaaaacatgcagtaagcacatatcatttgtgtgtcacatacaacagataaacagcatggcacaaatatatcagaagttgagcttctgaaaatgctagagctaatgatcaacggtattcaaaatagaatcaaaacaaaagcagataccatatggcataaaaacataccgctcaaagtcatcggggtagccacgtaacatatcgcgatcaaaatatgacagctgcaccggttctatgagtgtaagactaacaccacttgatatactgcactaaagaaggtaaatatgacagctgcaccggttctatgagtgtaagactaacaccacttgatatactgcactaaagaaggtaaattaggaggagaaaccagcaaacatgactaaagcaagcacgcacagcaagaaattctctataaaattacttttaaaaattaagatcttgatataatcaacagagtaagaaatttctgttatactgagtatatatttaccctgtccatattctgtttttatgccaacaaccaccataataagattcatagtctgcttcagctttcctcaggaaatgaattacatcttcatttatgccagcatacctgtttttgggttataccagtgcaattaacacaatagctttgcttgcaatacttgaggcataaatatgacacaaccaaaatcagactacatacaaagctcaatcccaaatccaacaaatttatcaaaaacaaaacatctctccttttagaataatgatcattgtagtatgtattatagctctacgttgctgaaaacccacaagaaattgttcacttttttatgcctagtccatttataaatataattggaattattgcaaacatttgaaaatggacaaaattattagttcactggtgatcacttgcttgtcacaaagaaattgcatacttgggcagtatgacctccaccaagttaccctttctttgaagtgcggaagataatccagtaacataggttgctaatgatccacgtgatgttattggatccatttcactgcagatgtgcacaacgtgtagaggtttcctgcaaaacagtaatttaaattaacgtagctatgcaaaatttgtaagtagcagttatgatggcagaaactcagattaaacaggtagtttgtgcatcatatagaaaacatgcagttttagaattatacagcacaaaatataagcagaaggcatatatacgaaaaaattgtagtgcattttcaatttttcatgcttattcagattgaaagatgtatgtataatgcagtaggatctttgaatataatatggcaatagtaaagctggaacctggaggagagatgtaatgaggtagtggtacatactctgctggtttacgcagaaagagtctcaattctgaaagtagttcagtatcttgtttatgatgaatatcagaaaagacgctatgtatcatgtatcggttgtcaataactttctttcttaaatcagacgcttctgtcatgccaaccataccagaaatggtcattgtatctatacgcagaagcaactcagagaaccttgatgattctgctatttctatggaaaaacctgaaatatgtaaaaggagaatgcagcgtcaaattttaggtctgtcgtttacctcttattctcttaagctaacaatgataaagagaaaatagaagtatcacatcaaacacaggattgaattgctcgatgttacacatctcgcattctatcttcacagttaattcacaaaagtatcttggcattaggatggtatcaccgccacaccttgcctttctgtttccagtacttctatgtcctgcagaagcgatttattttcatcctgcagtttcttgagctcttccatggccacaagccgctgcttgttaaggtgtaggatatctgtgaaattgaagccatcagaacagataacgcttttcttttagcaaacaacaaagtgatgcaaatggttcactctaattgaaaagtgccataagcatgccacgccaaatatcaaatgatactgctctggtgtggttcaatggtaagctcagatttaaaaaaaaaaaaaagtagttattacttctctgagcctggctgaatagctcccagatgtcaaccccttcgtgtcgttcatcagccaaatatgtttcctgcgacatcagctctaaattcatgatcctcttaaaccataagagaatgcaggtacatgaggtaaaatatgtggggaaacgtgttacagattcgaagttttaatgcatacctggtcattgtttgctttcacgttcagcctagacaaactcacaaaaattaaccactcgctgcgtcaaatagtgaaaataaaactgaaaaaaagaatctagagataatacgagcggcggagcacacaccgaacggaattggagccctcgcgatggggtttgctgcgagcattgcccttcccctccctggaatacacaccgatttgaggatcaaacgcccaaacaaagccacggtgacgaatacccacatccacatgttacgagtgcgcgcgggtgcgtgagcgccagcgcagtggaaccgcaacttcgcaagcaagcaagtacctggaacagtagcaccgggtgagaggggcgagtcgaggtcgaggctcccgcgagaagatgaggaggcgatccgcagcgccacgcggggagcgcgggagaggaggtggcggtggcggttgcgcggctcgcagcgccgatccgacgacgagccccggcgcctccatctccgatccctcctccggtgcttatccccgattcgccgtgcgactgcgaggcagcagcagcattggggtttggggatttctgaattctgaggcggaggcggagctgatcagacgagatcacgagagagagcgaagaggagtgcggagaaagggagacgcgtgagcgtgatgaggtagcgatggtgtggtgcgtaccgcgccaggtttggtttatcaggagggttttggaattaagcggcgcgggcgccgggtggttaatggcgtattagccttttccgtttctgtttttttttttttggcgttttactggttcggtgggagcgagcgagccgaggagccagcccatcacgtgcatctcccccagcccaccagtgagcttgaaggccagcccatttcggacgattatctgtgttggcccattttggacgaatcgatgaggcccaacaaacggcctttgccgtctccaattggttgcgtgaagccgccgctctgtcaagaacggaaaataatcatacgagaccagaccagtggtctcgtgcatgcacgtagtagatgataggcttaggtcttaggataactaacatacttactccatccattgcacagccactttttcagatgttccataatactataaggcatacatgcatatagacaattaactatggccccttctctattaaattattactccctccgtccctaaatatttaacgccgttgatttttttaaatatatttgaccgtttgtcttatttaaaaaatttaagtaattattaattctttttctatcatttgattcatggttaaatatactactactactcaagtttttgaataatattcacaaaagtttttgaataagacgaacggtcaaacatgttaaaaaaatcaacaacgtcaaacatttaggaaaggagggagtacttttttaaatcctccactctcatgttctctaattctattggatgcatgcattgtatttgttaggatgatccaaactataagatgataataattattttcttagtctttaggttaagggtggttatgccttacatttcagaatgaagggagtataaaattacagatgaattgacaaatttatgaaaacagaacacacatcaatttatccacttttagtctcgtaggattcatttctcccaaggacctgcacgactatttcaccaggcaatatatgtcgctgaccctgaccggtattaacaatatacttcctccgtttcacaatgtaagtcattctagcattacccatattcatatggatgttaatgaatctagatggatatatatgtatagattcattaacattaatatgaatgtcggaaatgctagaatgacttacattgtgaaacggaagaagtacttcttctgtttttgcaaggagcccaggaacacgtactactgtttttttaagagagagagatgatcttaatttatatggtacacatagcagaaaatatatattgctagatagatagctgcaggaattaataaccaaagatccggatagagtatgtggtgtgtcgtcgatgacataatcaagaagcatgcacgcgcgcgtgcattcttggttcattccattcatgccgtaaatttcttgcattcgaagtccatcgaaggtggcgtacgtcacccatgacatggcgaccgcgccgttcatccaatcgactcggcacaggtgcatgcatgcgtgcgattgcacctggccgcgcccggttcaattcctctcacgtccacatctcatctcgcgtgatgactcgtcgtccgtgtaagagttagcgtaaaaaaaattaatgtttcaccacatttccataccttcaaaatgtcgtagtcaacccattaaccacgcgtacgtacgccaagaactgattggtaataaccggttaattgttgatgtggtagaaagatatcattattatgagcggtggtacgattcaagaaaaatgaatgactgattaaccacgagtagcacgaccagaactgattggtgtttaatagccggttatgatgtacagctacctggaatgtatattcattcgttgtttacgtgtcattcaaatagttataaaaatattttaaaaaatcaacatggtaaattaatatgtgataaatcattttaaacatgcaagttaatttatttatttttttacatatgggataatgtacttgtcgaaatatggataacaacttggttgtgaacttgtgatcgatatttacgtgtatttttgtttatctttccacgtacacgtattgtattatgtatgctccaagaatattatacacagcatgcagtgtcagccggcgtcgattctagacttccaaaatatgtggcttacctcttcagaatagatgacagattgacagtgatatatgtttttatcgtatatgtatggaggtatggagcacttgtttatgtgcacaaagtagttaatttacaagaggtagaatgcgtacagtagttggcaacttgtacagaaacaaacatatagatttgatcctagcctgctagcttcggcaacatgcgtacagaaacaaacatttcatcggagtcagcttgcatcatgcgcaaacactgaacacgaccatttgtttttgtcagaatcattcattcattgatataaactaaagccaatgaatttagattagatatggcgctagctaacctatatggccagtataaaataaacgttgagatgagatatatataacctcccttagttagtggtgtaaaaacaattccaattaggtgcgaggtgtctatcacccagataaaaaaaaacagcacaaatgatatatcaagccagctaattaagactgcggtcattggatctaagctaaagtcagtgaccaaccaaccacgagcatttgtatttggtcctttgatcgagaggaggagattggagatggagatgcaactatagaaataattaatatttttcaattaatccacttgcctggtcagcccccacagccaggtttgcagagcaattctaaatgcagagtccaacccatattccatttcttttcttcctggcctcaactgctgatgaaaaagctggtccatttccgttgcctgccttttcgttgttaacatgataaatttgataataatcgtttgttatcaagttggtgatcatgattcgtttgattcatcatgcatgtacatctatatatacacactttccgcttttgttatcatatagtagtagctttctgtcactaactcactatcgttcaagcgcagccgatcgatggatcgagcgatgagattccggaactgtgtgttcgttgacgtctgaattgaagcagaatatacggtttaggttggtagctaggctgcgaatgcgagaaaagtaagcgcgatacgatcgagttgccggttgcgaagccggcgcgtccagtttggaaaacgtggagctagcttagcttcgtcgtcgtcgccgtccgttcgaaacgcgcggtttgccggcttgggagttgggaattgggaagaagtcgcagccggattcaccgcgtcgtccaagtgggcgcgcggctgcagtgcagcacgcgcgcggattcttgtcaagcagcggcagcggcggcagcgcccgcgcgcgcggtcaattcaacggcggaaacgcaacgaacgatgaaacgatcgatcggtggtgggacttgctcgcggcttcactgtcgggggctgttcgctagcagcagcgttcgcgatccacttgtcgttggtttaagccactgtacacattgcgtcgtgaacgatcaacgatgaaacgtcgcatgcgcagttgatactgacagtagatcgagcgcgtccgtaggtggaattctacggcgattccgaagcagcgacgtaagttctcgatcgagtttctgcagctggtatctgcgtactccctccgttccaaataaaaaaaaaagacgaaccttgtgttttcgtatctaacgtttgactgtccgtcttatatgaatttttttataattagtattttcattgttgttaaatgataaaacatgattaatactttatgcgtgacttgtctttttaatttttttcataattttttttaaataagacacacggtcaaacgttggacacggaaacccataatttatttttttttcggagggagtacgctacagttcaggacttcaggcgatcgatcgaccgtatattaatttctccctcgtgccaaaagaaaaaaaaaataccaatggcccatttcaccactgaacacatttcgatgccttttttttccgcgtaaatatctagaccaggtaattaatcgagacaatctctctacggtaaaaagatttatacaacatgcctgcatgcatgcgtaaatcctgcttaggcacgcatgcattcgtcgtgggccttgttggctagtccagttgataagaacgaacgagacgggtaccaatcgtggcaggttttcattacgcatgcagatcaggtgtcgatcgcacaaggaatgcatgaagatgcagatatataatccctacatatcctctcctcgttcgtcataaaaaccaaatatggataagctgtttaatcgtaatcacgacaacaccgcaccacaaaacaacaaaatggcggcattaattccatatatattcgtcgacgaggccatcggatcgctcgagctcgatgcgatcaaaacgatcctatctgaaaattaaacgagccaacaacgagacagtgctaccatttgttcactgtttcgcaaaaaataaaaataaaaaatagtgaactttgtgtttgatcacagtttgtaaaaccaagggggattaattgagcttaaacaaagaagagacggtagtccatttcctctcctctttacctttttccctttcaaaaagcaatataatcatgggcagaatggaaagatggccaggtccaacgctgcagatgtgtataacatgcggacactgtagtggcacagtatcctcgtcatcacgctccaaggaggccacgtttcatgggccccaataattcgctgttctttgggccccaccgaccatacagacacttgtcccgtgcttacatcggtttctgcacttgtttatcccaaaaaattagaacaaaaaacatccattggcctgcccaaacaaccaaacccaacccgtccactgctcccgttttataatcccctcaacaaataaatacaaatctccaaactttaaaagaaagacattattaggagtaagacaacataatacacttcatccatcttggggagattttttttagtagataatatccatctggggagatgcgtatctcatttttattttgctcaaatttatttccttgttaaatcatgagtcggtagtaataactaataaagcttattaatccctatgctaatgcgtaattaaatggaaaatagagaaggaaaaaatacgagacgatacacatcaccaggtaggtccgctaggtgcgaaagagtatgtagcctagtgattataatgccctgagtagccttccaaaatcctgagtttaaatttttataagagctaatttcatattgaattgttaagtggctaagttctcaatttaaaatgattacttatatcccggttaagtttagagatcggtttaaaaataccattctctaagaaaagaaaagggttcgctaggagccaaagaaaaaaaaggcgaggcggatattccatttcgtctccttggccgctgcgtttcccggctgcatttataggcgaggcggccgcggcgtcggagaccagcggagacagaagaaggggggagaagagaatcgcggagatagcatgagcagcggcggcgagctcgcgctgaggcaggagtacgtcatcggcgacgagatcgggcgcggccgcttcggcaccgtccgccgctgctacgccgtcgccacgggggaggcgttcgcggtcaagtccacgcccaaggcgccgctgcgggaggcggaggcggcggacgcgctcgacctcgcgctcgcggagcaggagcccaaggtgcacctcgtcgcgtcggcgccggggcccggggccagcccgcacgtcgtcgcgctccacgccgccttcgaggacgacgccgcggtgcacctcgtggtcgacctctgcgcgggcggggacctcctctccctcgtctcctcccgcggccgcctcccggagcacgaggccgcggacctcgtggcgcaactggcctccgcgctcgcgtcctgccaccgccgcggggtagcgcaccgcgacgtgaagcccgacaacctcctgttcgacggcggcggcgtgctcaagctcggcgacttcgggtcggcggggtggttcggggacgggaggccgatgacggggctggtcgggacgccctactacgtggcgccggaggtggtggccgggagggagtacggcgagaaggtggacgtgtggagcgccggggtggtgctctacatgatgctctccgggaccctgcccttctacggcgccaccgccgcggaggtcttccagtgcgtgctccgcggcaacctccgcttcccgccgcgcgcgttcgcctccgtctcgccggaggccaaggacctgatgcgccgcatgctctgcaaggacgtctccagaaggttctccgccgaccaagtcctgagtacgcactaaccctcttccttcgtttaaattttgctccactttgtaatttcagttcatgattccccagaaaatgtgaggtgtttttgctaacgattggatcgttcggtgttcgtgttgcagggcatccttggatcgtgagccgtgggggagccgcggtgatgggctagttcgttcgatcgaggatgatgatgaactccatccatgtgtagatagcttttcttcaggcgaaggactcgtctgctagctgtgaattttggcttggattagtggcagggttcagtggtagtagcgtattattagtgtttgtgtccagtaggagttaggaccatgacgagctctggtgaattggctggaatttgggagctagctatatctttctacccgagtttgtccgatgtacatacagtgatcagttgatcaccttttggctgaactgaagaagagggtagtctctcttagtgcgtagcaggcttgttcagatgaaaattgaatccaaaaacatgagaaaatttctgtgaattgctgcagttcacctatgcatatttccatctggagtgtgattcacttgtcatttttttcgatgcttcccatgatccaatgtatgtgctgtgatggtcaatggtgactggcgcagtggtgctcatggatttggaaaaattgaggcggctgttctgttggtagtggtagtggttagattcagatactactagtatcataatcttgggcgttgaattaaaactgaagaacagaagcagcctgagtgcctgaccggctggcagatctgtgagtggtggcgtggtggggattctgggccgtctgttggcgcaagtagccgcacccggtgtcctacggaagctgctcctctaacgtactgccctctaacatgggtggccgacatgtgggtccgctagctgtgggtcccacatgtcatcctctcaaagttagagggcagtacgtcagaggatcccgtcgcgtgtcgtaccggtgatcgatgcccatttctgccggtaaaaccgggtgaaagcaaagcgaagcccaaccgcagcctctggctccaatcacgttctgcaccctgctcgcaaagcaaccgctctccccccctcctccgtcctgcacgactggcggcaccgtgcagcagcagagcagcaagcagaaaaagcagcggaagatttgcttccccgtgacgcctttggaaaaaaactgcttttgtttcatgatcacctacacttgcaaagttgcaactgctcttgcaactaactaaagaaagtagtatttgggattgattgctgctgaaagggagcataactaggagtattaattagggattctgctaaatttgttaaaggatgaaaatccggactaatgtacatcctttaatttatatgtggatgatgatgaatctacgtggataatttcatattatctcatattcaaatttattgtcttaaaagatatcatattcttatttagatttttttttacgaaggagtactcctagaaaggaggaaggagattaaagcaccgagttggggcgggcgcggcgcccaggcccatgcagctgctgcccttggatggcgacttggatggaggaatgctttgtcacagtcgtcatttcgtgcacaacattattgtcgaaatgtcaactttaacatctgctaaccacacacgacggacaacctgactacctgcctcacttgctcagcgtcatggtgtccaggtacagtccccccactcccccctgccttgcccttgttggcttgaacagttcaactttgatttatttattacccccctcggttttttcgaaatattcttttcccctcggtttctgtaaaattgagaagaaaaaaaagaatattttaaaaaaatcggctagcttcattcttactactaatatgtgggctctggctttttaaagctgcttggttcttaaatttgatcattgttttccgcatgatagataggagtaagttatgttcagtgcaaatagccatgactaaaaagacaaatctgagtctccgtgtgaacttcgaaatggaggaaaatttcacctttcctgtgggaattgaaatgctccgtgtgaaaatcccatacacgcatcggcccaaatccgcatggccgctcccagagagatttcacgggctttgtatggcacgggaattactgggctgaacttttttttccttgttctattaattaatgaattgcatatgttgagttgttgaccaatgtgctaacaatgccagaactgacagactgttgaagaatcagccgatgtacagagactatagaagaacaaaactaccagatattttaattcaaactgttttacaaaattttatttgtaattctgctagacacgacagcaaattgagccagatcaacgagcatacagatttgtacgtaactgtagaacacatcatgccagatgcaaggttgtcagtttgtcactagagcactgatgctgcaacccttttcagggattcagatactttgaggatatcagattcagtgtgaccagctgatacgaataggcggattccaaccggaagacgacacttgtccaaactcgatcgtttcgtcgctgcaatgaagactgaatcttccttcaatacctgtgaaattacaattacgtaaaatacattattggcttaactccaaaaatcaaatctcaagtgcttttcacgaatttgttgaatccaccactaaataccttctctgaaataacctcaaggagctccaggtcagcaacagcagaacctgttgatgtcttcaatttgaggaagacaataggtgacaatatattactagcaatttcaagcccctgtacatctgacaactctgcgcatcaaatgcaaatgaaaagatgagtggatggacaaatatacagcgaaatatgccagacgtttcctaaaattttgatatcacaagtacatcaaaatacttgtaaggatgctaaacattgtgtattttcggtactttgactatagcccatagtaagtacatcacagttttataaactaggttagtaacatattaccagtgcactatgttcggtaaattaatggaagcaagaaataaaggtgccaagagaattagtgacctttatgcagaagagtgatgtttgatcttagattggcaagaaccgatgggttctcctccaggtggtccacagcagaaattgctgcactagcaagatatggtggtaacgaggcagagaaaacataaccggagctgcttagacgctgcaagatgacaacagtacagccagttaaaaatactgaagatgcaggtatttctataccatcatcaatatgctatcgatctgatgtggcacctacctgatgatcaaccactctgatacttcctgtacagaaaccaccatcagtagctaatgcatttcccattccagcagtgataatgtctattttttcaatctgcaatcggtaaagaatacttagaaaactagtagaactcaattgtgcagcaaactaagctagtcaacaaggaagattttcttaatacaaattgcactttgtctactgagccactgattatgcctgcccagttctttatttgttgtttcagattcgctgttgtggaaatatatgaaaagaaatgagagggagcactcacaggaactccataatgttcagcaaggccacgtccagacttgccaagaacgccaaaagaatgactctcctccaaaataacacgaaaccggtatttctccttcaatcgaactatctcatccaagggtgcaatttggccagaattctgtatccagaacagtagacagactttagaaacaaattcagtcaatgtatttctcagcaaaaaagaattcatgagtaagctacaaacctggtaaatagcttccacaacaatatagcgcctaatcttttctgtacgtttgtttccatgagttagtttttccagagtgctcgcaagtgaagccatgtcattgtgcttgaaataaacaacagtgcttcttgaaagctgcaaaccattttgtactgcccaatgaacaccctcatcactgcattgcatatgaatatcaagatttatttttatgaagaacgtggccatactgaattattttttttctggatgcaaaaactagctaataattttaaatatgaacaatgaaaagagatatataaggactgaaagcacgcataaaaaaaaagaattcaccatttcgaaattatgagtttcaaaaatgcatgatggctagaaggtcaagtaggtttgtcaataacacagaaggattagcgaggtccatgataccatattaccaattctacgaatttccagaactacaataaaatatctatgttcattttacatcagatggtatggcacgactcaattcattagaaaatgttgaataatatgttactaaattgttgtaaacaggaggaaaaaggttcacttacgctacaattatatctcctttcttacaaaaggcaggaatcacactgaagatggttgatatcccataggagtacaagattgaatcttgcgttcccaggaactttgcaattttagtctcacagtcaaggtgaacatctgaaaacaacaaaatggctaagttcctcccctgaatttgcattaggcttttggccacaagatacaaagtattgaatataagttgtaacagaacattacgaaccaatcgttccataaaagccacgaggtccgcatgatccaacgccatatttctccaccgaaccaatacaggaatcctgcaatttccttacatcactcaaatgttctaaaagagtactaaagaatattagcaaaagcatgaggttcttacgagtatcttttcattgccaatcaaaccaaggtagtttgctgacgcaaagtttacaacttcttttccatcaacaattgtatgcggtccagcagcactgatcaaacaatagaatatcagtattcaatcctctcggtcttggtacaaagatagtggggaaccatagctataattgtgtgaactctaaatcatagtttggttgtaattctagaactaacaagctctggagatcaacacccatattccatgctcactaggtcatagtatcatagtataagtgtacaacaatgcttatataccgacttccctaatccttactaaatgaaatggctacaaactgaacccatgcaatcttttttttttaaaaaaaaaagaaagaaagaagtacattgcaacatagagcctttggtgaagcacataaaacactttactggtgacatgaaggactaattagaaatgtctactttgttgggaggggatggggcttgagaattgagacgaacctttctaatgtaggagcctcaatccgagctccctccttgatgggtgggcagagaggctctggttgccactcatcacagagctcatcaacctcctgttgagccaaaaaaaaaacacctgattaacacaattgatgaagcattaagaaatggaaaggaacagaaaaaactactaattccaaattattgagcaaagtgtagctcaccctctcagtgagtggcttctttggaggcttgtagctcttcctggagagctggaagagtattgcggcaatgagaagcccttcgacgaccaagtgccctgaaaatcacagaatcagcgcatagcgcataatttaaatgaaacacgatacaactccagaatttcttagctgctggagaaaataaatatcatttaccatcgatatgaatcccaaagacaacagcacgagcaagcggggcattgaacatagcagaaacccgcgcaagtgctgcagcagtcgcgttcgcgactggcaacaccatctccatactcgagagcagtttcccttttctcccaagattaacaaactcagcaccgttctaaacctgtacaaaaaaacaaaagaacgagatgctaaatccaccaaaacaaactcgacaaactgatccaagaaactacagtttctctgcaactgttccaagcacagaaacagttggatctaatcctaagacacagccgaaagaccgttacctttatcaccctgacagatctcgatcaagaatcgcgaacgacttgcggactcactcgatttacctcaacatcgagaggagtggcgggggttatatacatggggtaggaggcagtcgtcgtcggcgacggagcggacgaggttggggtgtggagggcggggaaaccgtgggttgggctgatggtcggagatctgcgggtggaccgcatccgcgattccgcatcggcggcgcggcggagctcatggtcagctttggctatctttttttttatgaaaaataaaaaaataaagtaaaatagaatagatttgtcagtttgcatgggttcaacgtagaacggctatgttgccgtggcctaagcccaggcacggcccagggtggaggtgggccggaccaggctggtagactacggccctaacagaaaaaggaaaggaataagttcactgttagtcccttaactagtgacggaatctgattcgtatccttgaaccgcaggaccggatatctagaccctccaactattaataccggtgtaatttgactccctcgatggtttcggaggacaagttcaatgatgtggtgttcacgtagcagtgttgacttggtctgcggatgtggcactttggtgacattagagttaaaaacatatatgtgggtcctatttatcactaaaaaaaattatgagacccacatgtcatcctctatctctttcttcttcctgcccccctctctctctcccttctctccgacatgtcatgtgtggcccaggatgggtaaaggtaaatgtagatggtgcttttgtgcaacaaaccaaggaagggagtgtgggcattgtggttcgcaatcaggagggaaagttactgctttcatcttggaagctgatcagaggctgtgcatcggctgaagaagcagaagcaggtggcttgccgtggtgggatccgcctggtaaatgagtgagttaaggggcctttcatccttggagccgattgtgctaacgtagaagcagccctaagatcggctgggtgtgataaatctcaggtctggcatatacttcgtaattcagaaagctagagcagggctgcatgttattcatggtcctcgatctgctctaattagtactactttccataaaaaatcaactcgtaactacgaacctagacacatatagttaggattgaaaatttttttaagtcggagagatagggttgaaaataaagtggctcgatcatggtctcatacactatgcgttacgttcgaaagagtctgtaggtttgcgcttccaggcgcctgagggtgttaccgagctcttagctcgtgattgtaaccctatttctgtgagttaataaagcttcctgaatgccccccccccccccccccccccaaacaaaaaaaaggacgacctcggctcgcattggcatggatgcaatgggctatattaggccttacctcctgaatggcaggccagaccttgagcttacatgatatgggcctcgccatctcatttccccaaagttttccaggccactatctctcagttatacttttgtctgactggttctatctctttttttacttttatgcagtcgtcaaaaataagattggagtttttgcattttgataatccatccattaattatgtcaccacttagaggttaatgcacgacctaatcacactttgagtaaccagaccgcaaaaggacaaagcatcaatgcatcattatctctcatattctctcttagctgtctgtctgactctgctaattgtgtcctgaccgccgactccattcagagtatgtggttgctccccaactccaatagctcatgtaattactgtaaggcgacgacagttcatccataatttgactagccattcacccattctctgtccaataataataataataatatagtactatagccctcttcttttcttatcttggatttttcatttcacgatttccaagctcctaaactatatgtttcatgtaaaattctcggaaaacttttctaaactgtttgaagtgaaattttacaaaccttgcgagttgtgacaacaatgttctagctcgaaaactaattagatcagtcagaaaaattatataagctcataaattagcttgaaaactagtttaaaaaattttattttttaaataactgacattaggcactatttattaattttcaaactttgaatttaaaattattttaagaaagtctgaaatgctaaaaaattataccttgtcaccgaattgtaattaaagcatcttaaatataatcataaatcatgtatctgtcgtactacttttatcttttaagagtaaattagtggtcaaagctaaaacaatgatagtcaccagtgacggcaatttaaaaacggggaggatttactacttatctatttcttacaagcatgttcatgttcaaaaataatggtcaaagttgcatatttgaaattgttcccatgtctaatggcatatattctgagtatatcaaacagaactttttatctgctttggcttccgttctacagttgtttggtgaaatagaaaacgtcagggattttgctactgtccgacaaactatattgctttacacatcacactgattagtctctaaccagaccaatacctaatttttatttagtggtcgctacaaagttgagtcatggctaagctcttctcctgacaagcacatgctgcatcatcacacgggtaatggcatcttatctttggttctggccccaattaactcactcaatgactggtttttttaatgaagtccaggatgcacttgttaaaaagagaagcatacttagctgataaagtggggtactaattctatattcttctggtaaaaaggaattaaacatgattcagaactcttcaaaaagcaaggagatgagctgcacatcatcattaggcataggtttatgtatctatcatctaatagaacaatggcttcgaactaatatatttgaaaggagattatatgtttatagtattttgtatgttagaaatgcactttatgatgaaaaaaaaacactacatatattctccaactgcaaatgcaacatcaccaacaccccacctgaaaagcatacgccagtcagataccacataaagcactggcacaatcgaacagtggacatccataggattctctcatgatatttgttggcatatgagaattattctctcccaggatggatcaaggcaagaacagaaggaaagaagtgcacagaaaaaagaagatgtgatgtatgcgtccattggaaattgggaatcggatgcaacaatttggcaacctgctggccatttttatgatgtgtgttcttgcctgcaatcattcaagccttagtcttcgctggtgccggcgccaatccagtggatcactgcatttctgcaattcccttttcactacccatttttaagcaggtagtaatacgattaattagtaagtatcagcaggggcggattcacaatgggggcggaggggtctcgagaccccactaccaccccgggacagtggagacccccctaagcccccactaatttttttttccatagatccataggatgtggggactgaaggttcgatttatgctgatgtagtttattcagcccccactactatttttttctagatccgccactgagtatcggactactatcaatctatcacggtctgctatgtaaaaaaagattgcaatctttagtagtaaatcagaatgtgctagagaagatcgcaatcttcatcaataacctcttcttctggcaaagagtgagttgttcgtcagatatctgaatatttcagaatggaccagcattgtattctgctgcaagtgattatggatcagaatggcacatgtatttttttttcttcttaaagacaatacaatacaacacacatgcatacaaggagttcataatcacatgcttgtcttgtacaaatgacaaattccagaccgaatatgtttgcgtacaagctactctacggatcgctacgatcgtccaagatcgaggaagacgactactgggtgagcccctaccacgagagccggtggtgtatatatatattccatctcagaaagggctaaaatctcgtgctcttctgatggcaatggcgttcttggcggtgattctccttgctgctttcgatctcagctgagcttaggctcagtttgaaacggattattgagtgattatagggataaattaaatattttaaaacaaacttaataggtaggcataaagttttttctttaagaaatgtatgttttgaatcatatagcaaataatccgtttcgacgatcaagtgaatagtgtagagagttaattgatcttggttacttctcgtttaccgttaatatactttttaaagtgctaaagggtacattcgtatgaaaactttctgtatagaacatgattttgagaaaatcaaataaatctatttgcgtatagctaatcagccaaaaccaaccgccctaaatactacacgaccacatgactagtcgaattactgtgtggtcgtcaggtcgatctgaacgagtcaagcgatcgacttgtaatcctatcaaaacgacatcagtcggcagctagctgaacttgcctgatcgagaggcaccctgtcgtggtcaggattgagctagctggaacgaagtttaaccaggttattaatcgccatatcgatcaataattcgtcttagtaaatgcaagcatcaaaaaaagttatggcttcaactgtagctcgagatggaatcgacacacagcgatagctacactgctaaaacctgcacacagtgtgcagataagaggatggagaccacaccttgagaagaaaaaaccaacataggatatgactatcggtgagagagaagatgtagaaagagataattaactcattgacagatggagcaaattcatcgggtgagacaattaactagctaattcaatttaattcagtcaaacaaaacacaagtactctccctgttctaaaatataagcatttttagacttcgacacagtcttcgaggggctactttgactaacaatatctataaaaataagatgttttaaataaaaaattgcatattatgataatttgtaatgataaatctagtaacatcaattttaaatgattaatttttttatttttttctattaatagttaaaattaaaaatatttgacttgacactatttaaaataatattttaaatgtttatattttgggatggatgaagtgctagtcttcatttctagagagtgactccaagtaataaaccatgattgttttctttaataaatactagtgtggattctttgatgaatacatgcatcggtttgagacaacaagctaattcaatttaatccagtcaaaatacgcagcctaaacttatgtaccagtcttcatttctagatagtgactccaaataataaacctggattgttttctttgataaatactagtctgaattctttgataaatatatctggttgagaccagggttcaccttaccgttttggggggttaccgaccccccgcggtatggtggttaccgcggtaaccgtgcggttaccgcgaaaaaccgcacaaatttcgtttccaaatttttgaattcaaaatccacggtatagacacggtaaccgcacggtttggtacggtaaccgcgataagaggacggtaaccgcgatatgttggaactgaaataagaaaaatgaaaaaaataatagaaaaaaactaaaatgtgagtattttagttaattaagatgtggttatacaacagaaaaattcggcatgacctactctatattgtggagttcaaatcaatacaataattcataacattataacaacaataacaatcatcaatctcacatttcaaagcataacgatatccacatgtaggtccagaataacaatacagtccagaataacaatatagtccacaataacaatagagtccacagtataatgtccacgattacaattctagttcgaatgaaaggaaataaacaaggacatgcatagctacgcattccattgattatatgccatattgtactcctctgtggacatgagcatcaagccatgtgaatgtagcaaccccgccttgtattcctcccaactttgacctgtccatgatgatgttgtttgccactgagcgtacaattgagcataccactgaggctcttgccattcatacacccatgtagtaacaggataatcagaagcttggggatggttgtacacatacgttggatagccactttcaaagttagaggcactgaatgagctagagctatcctgttgtatgtcactgaattgttgctgttgtcggactcccggtgcaatggtagttcgttgagagcttggagcaccatgatcctggtcctgagtagcatgagtgaagtcgccctcacctgcaaatcaaaaaattgcaagaaaattatccagtactgaattggaagatgaaggttgaaattgcaactgaattatatcacaccagtgaattgaacggggctgtggtgatctgattgttgggtgtgacccctaggagggcacattagtagtgccttggcctccttgaccatcgtcgtcgccgtcatctgtttcagttcttgagctactatcattggactcttggtactctgggcttccttgggtctcttcatcgctatcaacactagtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactggaggagcaacattgaccaaccaaacgcaacgcaagcttcttcaaattcggcgtgtctgaggcgaacatagaccaccattgtgctgcaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaaccttcaacaaagcggcggcagccgtatcgatatccgtcatccactcgaatgcctgtcggaggtcttggaagacagtagcacttggagaatacgcgtagtgcgtcctagggttcaatgcggcagctacaaaacatggcacaggttaagtaagagttacataatatgccatgtgaattatgttatgaccaatatttaccggcattgatgagagtctcattggttaggtcgtgcatccttctgttcacgatctccatgtatgcttcaaacttgtccctttgattcgcaaaaagactgtcgtactccattttgagcaactgatatctcaaaagtacctcacccaaattggggttcttgtcctcgtcagcaaaccgaaggaatgagtacataggttggacagaactcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcattttcccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctaacactgacgataacaggtgatgaagtaatttgttgcatgaaccatacataccttcagcacaaagttagcatcctggctttgcccggtcgcatcaatggacttgtggaaaaacattattccattgcagtatatcagaaaattgatgaccgacatactcgtcggacctgtccaagaatcacacattatagtaacaccgtactcatcccaatccttcttgaacctatcaaattgcttcttcacatccttctctgtagaatcaagatattttccatctatctcgttaccagttggagaaggtacactttcacctacaattgacgtatgaaataagtagtgcgcaatgagttagaaaaaaagaagttccttaatagatgcatacgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctgtgtcaatgcgtggctgcacaggggccttggcagatgctaggttgtaatctctcacagcaggtgactccctatgagacgtagcccttcgtagcatattggtaattgggttacttctacctttccgtgcctccggctgagcggatccactcccaccgccatgctcataagtgccaccacgctcctcaacatccctcctaaagttttcgtcttgtcgtgaggctgcaatggctgcttccatttgttcctcctcgtcggcatcacctgttaggtcataatagttgacccttgctgcttcaacccttcttccgctatcactcttacgctggtcacctgcatcttttatcctgtccaactcacggcagaagaactcacggacattcggaggcactgaattgcaatatgtaaccccattccctcttgcagccaagtgttgctttagtcttgttgccccaccaccgcccctctttgtatggcaatacttacagcgccatccaggtgggatattctccccgtgctcccacacagggtccctactatctaacatctccaccctgtatcaaatgcatgagaaattatcactgctaattataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatccccaaatatgtccatgcatatcacagtaaaaaataccataccacggttcaagccacggtaaccacggtagggtggacggttaccacggttttcacgcgattaccgcacatacgtatatcgtctcatagattacgaagccggcggtaaccatacaaaaccgcacggttaccgctcctaaccgcgcgaaacccttcaaaacggagggattacctcttgcccgtcgacccaggcggttaccgtcgcgtaccgcgtggttaccgccgcttaccgcgcgggaaccggcctcgccggcgcggagccggcggatctggcgcgggcgcacgccgtcgccccttcggtcctgagcgcagctacgcgagagaggggaaaaacagtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattttttcaccataacaacatacaaaacaagctttacatccatgattttttttgatttttttggattatttttcaaatttttgaatttgagcaaaatttgcccaaaccctaccgccggtttttgttaccgaccccccacggtaagcccggtaaccgcggttaccgcgcggttaccgacgagaaagtgaaccctggttgagacagactcatcattctttctctgtttcaaattagctgtcgttctaggtttgtgctagttcaaacattttaattttggatcatcaatttttataaaatggtatagttttaatatttgaacatttatatttttattcatcattagaaatactttcgtattttgttaagtatataatttatatgttgttaaactacatggatttcaaatgattaatagtcaaagatatgcatattttgacttaggataaacataaaagacaaggtgatttgaaagaagtttttttttcagtaaaaaaggagcctgaatttgaaaggtaatttttaatccgttttcttttctagagagtgactcccagcaataaagcagtgttattctctttgataaatgggcgacagtctgagctttgaacttactgttaaccctcctaataatgcaataaacctaagcatattcgtagcgtgcgcatcaggtaaaaacatccaagtcaatcactagctagtggcgcatgtgggaggcaagaattaagagcatcttgaggactagcactgtacaaccattccaattttacttggttgagagttgagagttgagacagacaacgattgcattcccctgtacattatactccgtatttaatatccccgttttttttatagttactacttcctccgattcaaaatgtttgacaccgttaactttttagcatatatttgaccgttcgtcttattcaaaaaagttggtgaaatatgtaaaactacatatgtacatgaaagtatatttaacaataaatcaaatgatatgaaaagaataaataattacttaaattttttgaataagacgaatagtcaaacatgtactaaaaaaatcaacgatgtcaaacattttgaaacagagggagtactaaataataaaaaggataatgtcgctggaatataaaagtagctttcatatttttctctactatatttggggaggtatatacattcttgttacttaaagagataactcctatatagtactataaggtaatatatatacacctctttacattaatattattgactgtatatttttattctaattaatttaaccaatttaaattttctacctctcaagtagtggggatataatgtacctctctctccaaggatgagagaaaaccttctaaaacggatggaccaaacaacgtcacagaaagtacaaattacacacagccagatgtttagttttttccgataaaatcatatgtttatctgatgtaaacggaacttttagcaatacacaaggtataattccctctcttactaacaagtgaggtagctccaagtcactaaatgatgtagatcaagatggcaaattatcatggttttaaatagcgggttcagacatttaacggttaacctttttaaataactgtaacggttaaattgagctataacggctaatttatacataaaagcacgtagctaaaatccttctcaaatagttacagtccgatattcaaaaccatgcaaattatgagatgccacatgtaaacatgtttccacaacaaatttttttctgattgatctataccgaaatttcaccatacaaatttaatagcagtaaaattactactagtattgtagagagtacgtgatgccaaattggagatggtggcgtgcagggtttccgtcgctgaccgcaacccgtagactccaaaagagaaaagagcgacggaggaataagaagaagaagaagcgcacaaaagcgagagccgcctcctttcacgggattcaatagcgaccccaacccaacccctctattgcttgcttagcatggtggccaatcgttgaataggatgccaccatctggactcctcttttgttctcttgcactaatctagtgcacataggcacatgaaaaaacaagaagaacatcctatatctgaacgatgaaagggacaccgggtgcaaattaaaatcgacaacgaagagagatcgttgcgaacagtcactgacatatgggttcggacgagtcgtatcagctaacgaggctcacatgtcagtgactgttttgtaacgatttcgtagaatacatgacgtgacgattaagatgagttaaaattaatctatccatggatttcttgctgttgctattgccgcactgggcctgcttaaattagggtcaagtgctggaaatgggcagctcgattggcgctgtgaaagagacggatcatccaatccaccgtcagaagaaaaccttgcgccttttaagggacatttcgccaatttgccgttgcgattgcgatctccatcgccgtggtagggacaaaaacaaaacaagactttcacatgctcattttctcatttcattacattacattacacttctgcgttcgttgctagtcgctaccactttggtcttcggaagcacagagaatctgcttagtttaagcacagcaaaatctgatcatcaagcaaaagtcatgagagagccgtagaccaatctttttcgaatagagccagtcgagaccagtgagtgtagtagtttttgcagcaggttccaaactccaaaggcaaaagcagtagtaaaagaaagtgagccagattcagctcaagccaaccagcctcctctgcatgtggctggttgaacagtctacatatggatgctacaacactttgacccgtctctcccagattattcgcctcttggctcaatccagcatgacatatctaggacactgcactgcagcatctgctgcttcttgtctactccatctctgaagaagttgttgttcttgcatattattgccaatgcattatatgtaaaatactaaccactggtagtactgaaagtgcaggtgattagtgcacaaaatgatggaagaacatgttgacgatgagtgagtgaggtgcatggatggatggtggacatgtgcagggtgatggagtgggtgggcgcaggcatcatggattgatggcgagggtcaaagaaaagcgcatggaatggatgggtcaggcaggcaagaggcaggaggcacaggcagcatctcagcttgggcagtggagccaccgagcaacaaaccaaaccaggcccaaacaatctcgccactgttgcatggattgacatgtgtgggtgtggggttcctcctccctcctcatggcacctctcaaaactttaggccttatttagttccttatttagttcctgaaaaaaaatattttagtttcatatcgaacatttgactggatattgaaagaggtttttaacacaaataaaaaaactaattttataacttacctgaaaaccacgagatgaatttattaagcctaattaatttgtcattagcacatgtaagttacttagcacttatggctaattatagactaactaggctcaacagattcgtctcgcgattttcgtgcaaactgtgcaattagtttttcattttatctatatttaatgttctatgcatatgtccaaagattcgatctgatgtttttggaaaaaattaggaactaaaaacaaggcctgagataatgtctaaattgtaaagttatcataggcattttattatcgatgaacgaaatcataatagatgtgttattatcgatgggtgcttaccatatcactataaaagtagttaaccatacacacaaacactcaaatcaaatatagagcttgcactcatgtaaatagatttcaccataataaacataaccagccgcctccgttgtcaaagtgtttgttgggggagttttagattctaataagcagctggttgatagccagcttataagaatcactggatttcttagtttctgactttcagttcattttttaaatttcaccattacaattttttaaaatctgaaaaaaacctaaattgtcggaggaagcttataattctgagaaaaagttctgcgtgtcagaagttttgcaaacagacccaaagtttatgagctggtactagtatgagctcactttgattgattcagctcaggtcaggtcacatgcatgccattgccacccactagtctactggtcactcactcgctcactgccgacacccggccgcggcatcgatctgtggcgtacgtatgcgtttgttttttagctggtttggtgcgtgcacatccaggaatcatcagatttgccggctgccatgctgtgccgtgccggtgggtgatcgatcatgctgcaccggcgcaacagattaatcggcacaacacgcatatatatagagtacagtgctcgtaaagcaacgttttctcttcttctttaatggtttcatccatccttccattcgttcgttcagtgccaaggtcaaagaatgcggtgggatatgatatggtagatgggggcgtgcgctaattcagatccaatgaaacgatcgacggcgcttttttcaattatctgtggcagattccacgctctaacatgcgttaatatatagacggtgtcgtgaaagcacccgaaaacatcgcatggagtgttggcccaccgggatttaaatgctcttgcccttaaatattagagcaaatttaattgtaaaactaaaggatttcagaacatatcacagtacaacgaatctagacataataatatgttgcatctctccagaatcccttatattatggaacggggggagtagttgttctaagtcaacttaagagttaacatgtataataaattagctataagtttatatccaatttttatgatgtacggtcgcacagaattagtcggctttcgtgaaaccgttagctcttggtttgtgaaaaccggtctatattaataggtttttttttcatgacattgattaaaagttaccggtttttagccaaccggtgaggaacagttttttactttaaaatcgataagttaaaccctactcccaggccatcaccacccaccatgtgcaaaaatccacaggacgcccgctgcatgcactacattgtcaccgcgctgcgctgcccctgcctgttttgctctctcagagcaaggtcaataacaaagcccactatcggctgcaatgggtgtacacatcatctgaattaaagcattatagttaagatatattatatagacttactatatcataaatattttattgttttatggacccaccatcttttccctcttttcagagttctctttctttctcggagttctcgttcttctcgtttcttgccagtgaggacggggcaacatagacgtgggtgagggcgagtgagatggcgaccgttgcagcggacaccgggcgacaacggcagcgtccacggaagacgcatgtgaaggtggtgacggcgtccatagaggatgtaggcgaagggcaacaacacaatctagtggacacaagctatggcggtagtcacagaggacaaggacgacgaacacgagcggatgtgggcgaggacggggggatggaagtggatgacgacgacatccgcgaaggacgaggacggcaggagggatgcgtgcgacgctagatgccgcggaggacgagtacgtcggctgtggcggaggtgggcgacgacgacaggacagctgtgggcgatgacggtggctacgagtgagggcgatgggacgtacgcgcgaggatgatagctcttattcggttattcactgccatcgctagttactgcgggccccacaacctcgggtcgagcatatagctggacggctaagagcaggtacaatagcaggctataagctagctataaatatattttaaaaagataaatgaagagagataagagcagcgggctacagatctgtagccagctgcagcacagactccaaaatgtaatatgtgtataacaggtgggaccaggtattaatagcatagtaagcaactattatataaattgactattatattagctatatatgatttgaagctagtaatagactacactattaaacttgctctaattagtcacccgcccattctatctctcttcccttctctccttcagctcaggaaaaattaatcctgttgaatctcctaccgttcattatttgtaaccgctctgacaacgcaacgccgctacagttgcggtatccatcgtaaaccgtgcggtgcgatgcggcacggacgcagcgggcgggggtccatggcttgatcaggggtcgaattgacaacacgattaacataaacacaacacggctgggctgctgcgtcgagatacatagggtacgtttactttcatgcgaaaaaaaccttactaaattttgttaatactaaaattttaatatagttgttaaaattttgacaacttatcaaaattttggcaggatttcttatatagttcccaaaatttggcaacaaactaaatattccggccttgtccgtttccacgctgccagctgcagatgcagacatgcaatgcactgctctggtcctacccccctacgtattgcaagcagatttaattactgcgtctttgcagcctatacgtactctccagtctctacagtacatggagatgtactataccattacaggcaggtacaacagctgactaagcgggctacaaaatagtaccacatcatcaatttcctatgtagatgagagagaacgaagcggacgactaaattgtcgtccggcgttagcatttttctccacgcagtatcggtcgtgtgcagccgaccctggcgctaaaaacgctgtttgtggggcctgcacgtcctcagacgatcccgtgagaactggctaccccgcggcgcacgatccccttcccccagcggtgtgcaaatccatctccgccgttcgtgcgcgatctcatcaccttctgcgtgcttcgtcttccatccacgcgatcgtgagcgaaaactgtgccgtgaaaaactctgatgccacatcgtttgacgaaaatcagcacaggaaatccactccttcctcacgagctcttcttgccaacaaacacgtgctttgtacttttagtactccagagaaattggttagtatgatctgtgctatgatcctggtgtttggtgaacaaagtttatctcacaacacaaatagctacaataatacaattcactcttgatcatatatattgatatgtgcatgtcataattaattgtttgattatgagatacagtcagtcaatagacaatctattgtactagtagttggctttagccctggactattagcccacagcgggctatactattagccttgctgttactgtttcgcctgtacaatccaaatcaccagtactgttgctcctcattttcatgacaacaccaatggcacatgctttcttctggttaatgcatgcaaattgtaattagcatcttaagctctcaaatatggagtagactattcttttacgagtagtaccagcaaagttgcagttgacctcatcagtgctcaaggacagactcacagacatcacagcagggcaagcaaaagtgaccgcccacaccacaatagattactcctactactgatactccatgcatttgctctcattccctcctttatataaagtcacagcctgcttttctatgactatttgctcacttattctttttttttctccccttcatctcttctctctctctggcccttgcttttttgctcctggtttgggacttccggacttgggatactattttgggacatgttttaaggttcagctctataaaggtgtcattctgcttccctggactggatgtatcaaacattcgtttaacacctgcaagggcaatacaaacttaaaccacaggtttttttcctttatgattttttagataaattaaaagcatcatttgtacttcatccgtcccataaaaaaccaatttagtaatgaatgtgacacatcctaatataataaattcggacatatgtctgttcagattcattatactaagatatgtcatattcagttttatattcgtttgtttagaccaaggaagtaagtaactagtatacccaacaaatgacattggaatgaactagtggtaagaatacactacagcaactcgccaattatatcagtaaatgcttgtgcccatcaacggcgacacgaggaaatcagtgacgagaaaaaaaagcaccagcaattaaacaggaaaggcaaaaaaaaacaaaagaaattgacacactcctctttttttcccctttaatcatcgggagaataaaaagaaggaaacaaaacggaacacacccgaaaataagttgagaggcagaggaggcagacagcagcagataggcagacaaagcaagccagagatctagctccgcttgtcggaaagaagtagtagagcctctctcacaaaaaaaaaagaaataaagaaataaaaaatcgagcaagaaaaatcacaagaaactcttctttctctttttttttggcttaattacagtttttttgtgtgttttttcccttacacatactgtgccagtggccagtgtacagcgccaccacccacaggccacaggccacagcttggcaggttgggctttgagccgagctgagctgaggtctccacttacttcttcactgctcgccatcatctccttctttccaagcccttcttctttcttttttccccctcgccataggcgccctgtgctttgctcgctcgctgcttttctctttcttaaaaggctgctccctcactcacaactccctctctctctctctctctctctctctctctctctctcctcacctcttcttgttcttcttctctctctcttgtcactcatcatcatcactcttcagcttgcttggttggttggtggagcttgggagttgaggtcaaatagccatcgatacacactcctctttcttttctctcttcatttctttctttacatcgtctctttcttgatttcccaatctactaagctcctactagctctgtgctctgctgcttcctcccatccatggcggcggttgccagcgacccacctacctacaagtagcttaagctcaagctcagctcagatcggagaggggtggtagaggtagtagcagtagttgagagagagagtgaggatggagagcagatggaggaaggccaagatgtcgctggggctcaacctctgcgtctacgtgcccaggacgctggacgacggggactcgccgtccaccgggtcgtccacggcggcgctggtgtcgccggtggcgtcctcgtcgtcggcggcgaccagcgccaacaccacgcccacggcggagcagagggtcaagggcgccggcgcgctcatgccgaccaccccgacgccgacctccgccggacttcgcctctccaaatccggcagcaaatccttcaaggtacagtccctccttcacatccttcacatctctatgtatgaagcataaaaaaaaagagaaaagaagcttgcaactttgcaagcaaaattacagccaagatccatccatatgcacacaaaagtcacaaattaattccttttttttctctcgatttatgcctgctcggttgatttcagttccagtaattattgtagcaagttctgattcaggttgtacacctgtgatggatgttcttttttgccacacatgatgcatgcaactgtgcaagtagctttgctttcatgatttcatcacacgcacacacacacacacacacaaacacagagagaagataaaaaagaggagctcaagaggagaaaaggagatgcaggagaagatgggcagagggcaatggtggaggaggaatataatcatgaagtgggggagtttgtctttctttaacgatggggtcctcctctactctcttgcagctccactctcactactgactatactactactctcctcctccatagtccacacctcttttcttcatcactcacttttctctgccctttcctctagcctcctctcacttcactccttttcgtggaggaggcataaagaagaggtcagtgccatagccatagcatcctcttttcagaacagcttggagtggacactgttccacactgttctcagatcccttctgcgttctcttgctgttccaacttaaaactgcagagcccaccacccgtctcgctttaagagcccagaattgcaaaaggaaacctatattcagaaggtgccagtttgcaaatgttaaaattgcaaaatgaacctatattcagaagatgccagtttgcaaatgttaaaattgcagcagcctagctaattataccaaaccagtgtactgaaactgaacagggacacgctattagagtcgtgtttttcaaatgtctgtgggtggtcactggtcaaccatttaatcttctgttatagagggtgaggtgtgttagttagtcagcaatgactaattcggattaagccacctacctcactcgataatgctaaagattgtttcttccatttgtaaaattagcttgaccatggactgcaacttgccacatgactaatgattgatgttttttctccgagacaaattgtattgcaattctcttagcaagtttgttctgaaaaaagagtctgaaactacggcgtctgaccaaggtttgggatgaatatctctttggggataaaaaaaaaactctggactttttcatcattgtgaaaaaatatttatgaaaaatagaagacgacaagtgtgtaaaggtccaactacatgcctacacgtttctgcctatgctttagttctttggcattcttgatgttgctgctttgtgttgttaattattcgtaatatctctattatatattatagaatgaccgcttcaataaatataaataaactaagtatgctagtatttagtacctgattagagattatcacagcatcatcttcatgaattatccctttaatcttgctgtctctagatgctcgtttgctttctttgcagcatcactgataagcatgtattgtataccatggaagcatgcatgctaaccacttcaagtttcatgtttgaccactgttcattttataatctcactgtaccttcttttttcttccagaaaacatgtgcgatatgtttgaccacaatgaagcctggtcagggccatgctctattcacagcagagtgctcacatacctttcacttccattgtatagctgcaaatgttaagcatggaagcaacaattgcccagtttgccgcaccaagtggaaggaactcccatttcgaggtcccttgcctggtgaatttcctcaaggaagtgcaaggattaatccagttaatgggcaccaaaatggcgggcagatgaccatactgcgaccacttccccgtgctcgttcttctggtcggctgcatcatatgacatcgttgttgcctgacactgaccgtagtatttttaacgatgatgaacccttggactcactgtctgaagcaaatgaaggctcgcagcaggggtgtttaagaacagtggaaataaagacatatcctgagttcactgaagttccagaaagtacttcagaaagaaattttacagtcctagttcatctaaaggcaccccttgctcagactttgcaaacaagcagcaaacttgaagatggcaatagcttgggcacaactcgagcccctgttgatctcatcacagtgcttgatgtcagtgggagcatggctggtaccaaacttgcattgctgaaaagagccatgggatttgtcattcagaaccttggctcctcagatcggctttctgtaattgccttctcatcatctgcacgtagactcttccccctccgtcggatgactgagactggtcgtcagcaaagcttgcaagctgtttattcactgacatcaaatggtgggaccaatattgctgagggcctgaggaaaggctccaaagtgattgaagatcgacaggccaagaatccagtgtgcagcatcatcctactatcagatgggcaagatacatatacagtctcaccaaccgctggtgtacacaaagcagcaccagagtactgctcactcctgccatatactagtaatggttgtcaacaggtaccagttcatgtctttggatttggtgctgaccatgattcagtctcgctgcattcaatctcacaaacctccgggggcaccttttcattcatagagacagaggctgccatccaagatgcatttgcccagtgtattggtggactcttgagtgttgttgcacaggatttgcatgtaaaggtggagagcctccaccctgatgtacactttggctcgatcagatcaggaagctattctagcagacttgcagatgacaagaggaatggctccatagatgttggtgacatgtatgccgaagaggagagggatttccttatgtcagtaaatgttcccccaggttacggtgaaacagcacttctcaaagttggctgtgtctacaaagatccactgatgaaggagactatcaatatggctgatgtgcaagtcaagatctctagaccagcattcgtctcagtacaaagcgtgtcaatcgaggtggaccgacaaaagaaccgtcttcatgcagctgaagtcatggctgaagcaaggttgtctgccgagcgtggtgacctgacacatgctgtttccttactcgaagactgccggaggatgatcatggggtcaacatcaggacaatccggtgatcggttgtgccaagcattggatgctgagctgaaggagatgcaagaaaggatggccaatcgccaaaggtacgaagcatcaggccgcgcctatgtcctctccggcttgagctcacactcatggcagagagcaactgcgcgaggtgactccacagacagcgagagcctaatccaggcctaccagacttcatccatggtcgacatgctgctgcgctcgcagacaatgagccgctcctcaacccctccacagatgaggcatgtgaagtcgtttccagcgcgcccgcagcctaggtaactgcaatttctagtgtttggcaacgccaataaggatgggttttgctaaagcctagatgtgaatttggtgaaagtagtagtgtcagttgaattcttggttttgtggcgggaggacgggacgggggtatagtttgtgtggtataagggggattttaacggtgtaaattaatttgggtgtggtgggggtaaaagggaaaaagaatctgtatttgggagaaggatggtataagagttggggaaatggggtaagatagggtggctattattttttttttccttcttgttggttacctggtatactcccagtattgtactagtagctctcctctctcctttgtgtggtgatgtacataaagagaagggtatacatttgtgaactggaatgtggttgaggatggggatggatacctaatccttttgcaaggcttggcttgcctcttcctggaaattgaaaattctgatcatggcctcttgtgttctgttttgtttccgtttgcatctgctggtgatgctgctgcatgttgtcatcttggtatgacgctttgctttgatttgttggcttggtggaactggtagggatgatccagttggcatcttcagcatcaggagtttggacaatcatcagctgggaatcggttggtagatgaagttgtattgatgaggaaaaaaaattctcccagttgatatagatgaaataatttggtggagcaaatgggcaacactagcatcttagcatgtactaccttcatcctgtttagattcgcagcacttagaatatatcacatcacatctagtactagattaacttattctatagaatatatcacatctagtactagaatatatcatatccagcactagattaacttattctgtgatggtggaagtgtactcgatatggcgagagaagagaaaggaaaattggggaatctgcggaggaattggcaccttgaaatgcttgaccgatcgttgatagatcgcagccgccctccaccgccggccacggagcggcgtttctccagctcgatctgccgattcgggcaccgccgaaaccacgcggcggcgggcgatcgccgtcggccaccgcctgcgccgcgccgccaggaaacgtgccggtttccagcattttggtgcggcccaagaacgggatgaatactttcgagggtagggatttgcaataagtttacttcagatacctcatcttacgtcgagtttgaatttgtataacgtgtctctcaactgcaataccggtatacccgagattgtaggacggtatacaaaagagttgaatgggacgagttgaatgggatccaaaagagttggcgtcgaggatacctggtattgtgtttgaaggatatgtgcaacttaaacatgacctcaactagggaccaaaagtaaacttattccatggattttggcctgcatgcggttcattttggttggcccgacttacgtgcggctggcccatgtgagttcggtagcaaggatctgtattgcgtgcggcccattctgtttgggccagggaggaggagttgttgggccgaaatgtgtttgggcctgcgtgatggaaaggaaagggacgttggcgtggcggttggtggtgggcggggttgacgtgaatggctcaactacgaccgtgcttgtgtttgctgtgctgctgctgctgatccggtcggtcaggtagctacgctccgccaatctccgatagcgaccgacccaaacgcaaacgcaagcgctagcgctgatcgatacgtactacgcaccgcctaccgtcaggaacagctcggtttgccaaaaaccggaacacaaaccgacagtttgatttttcgattaatttttttaa

SEQ ID NO: 4207 - DNA, 3177 bp, Oryza sativa
accgcgtacactcacccatataaagacacaagcacgccctaacgttaggaacacatccaaactatttgaccggcatatctttaaattgacgatgtcaatacgaatgtttcactgtcgactggtatattatttatacaattttttttagtttcatttgaatctggtgtagccggtcttcctccgccgcctgccagcgttcaaagcgaaaacgatgccaaaatcatcatttgttaacagtgcaaccagcacatcatcgccactagggatgaaaacggagcggatagtttccgtccgctccggacaaaaacggatacggatacctttcggatcggataattctcggatatttcggatacagatacgaatacggatattttctcccggatacgaatacgaatatggtatcagagtttccgtcgaatacggataataattcagatatccggtgaatagtgctattcggatatccgcaggacccatgagacataccccatttctttctaactctataaccttcaatgtacctttatagattttaataatagtttatctcttaacactagtccatactattaatattatttaaatttaaaaaaatatttataaattatacctcattttatataaaatgagctaattatatatgttgaaatttatttctattagaagttgagttggttttcgtgttccgagaaaaatttgtttccgtattcgtgtccgatcatattcgattcttattcgtattcgagataatccgtatttgtttccgtattcgagctatccgtattcgttttcgtatccggtaaaaaatatgaaaacgaatatggtataagcattatccgtccatatccgctccgttttcatccctaatcgccaccactactcgctcgtcacctttcgtggattaccactaaaaaaacgagagtgccacacgcccgcacgtaacccccggctgctactagtacaagcacgacacagccatatgggcatagcatagcatccagtgcttttcttatcgctacatcagcccactaacaacatgggatcagtaatactcctctgttagtgttacagtaggattctatgctttaatcatgccgtcaacatccgtcggtgcaaaaggtttgcaggtacggaactcttatagaaaaaggaaaatgaaacgagtgaggtacgaaatgctttaattagtacatgattaattaagttttaattagagtaaagtccatcaccggtccctaaactggtaccgctgtgtcatcccggtcactaaactcacaaatcgaccgttcagatccttaaacttgttcgactgtgtcatccaggtccctaaacttgcagatcactcgtttaggtcctccaacttgttcagttgtgtcaccccggtccctaagcaggacggtctaaaagctttatatcaaaaataattcataacttttttatgtaaactctaatgaagacaaactttatattaaaattatagccctcgacgcgacctacaactttgtagttgataagtttttgaattaaaactgtttagggtcccaaaatattgttgcatttttatagattttgaaattttaattttaaaattacattttgggacaaaaaaatgacttaaaataaaaaaaatcaactataaagttgtagatctcgttgagggctacaagtttgatataaagtttgtctttattagagttcacataaaaaagttatgaattatttttaaatacaaagtctttagactgtcctatttgacccagatgatattcaaatctaagtttagggaccgaggtgacacaactgaacaagttggagaatctaaacgagtgatctgcaattttagtgaccgggatgacacagttgaacaagtttgagaaccggaacgatcgatttgtgagtttagggaccgcgatgacacagtggtacaagtttaaggaccggtgatggtctttactcttttaattattataaattttaaaaagtaatttatctgatattttaaagtgatttctatataaaatgcttttatggaatacacacgttagcagtttgaaaaacgtacgataacacacgaagtgagcacaacagggtttaatgctatatatgatttgactttgttttgctactgttttgtttgttttgtttcgatttataatctaaattggcagagtttgtatcaatcgtaaaaattgtctttgtaacgcaatacgtatttttgccagttaacgcaatacgtatttttgctagtttaataaataaagaaagaggcctaattaacaaaggacgataggtgtacgagcatagcatcaggtcccgttcgaagccaaccgaagtttgtttggtgtttatatgggggttcacatgagggggggtgcagatctgtgtggttcacaacgagatggccagcttagatccacgaggagaagatggccaactgtcggttactagctcggttgacggtgcggctcaatttctttcaacattttccatttcttgttgaggagagaaaggtacaaacctgaaaaaaaagttattcccatccatgaaaatccctgaaaaagtcaaggagcatatgacacaaaaaaagtttattgcactcactataattatttatcttattatttttttggaatatcatttttggatagaacgatttttatgttttccctaacaaatttatttggtgtttttaaaatttcacatcatctaccacccttcttgaatttcctggatcctttggggctgtaattttcagatataccaaatgttttgacctagcaacgacaagatacagtggaggagcaaaaaaacaaagtagctgtgcaaagcatgcacaaagaacacacaatagaaaggtcttttttgggtggcagaaaaacggttaaggtttcaacagttgaaagtaaaaaaaaaaaaagaaaacacacacacaacgcggaatgtgaaaggtatgggcattctctagaaggaaggagcgttcaacgtgtttgtcagttgacaccgtctcaatatgcgggctttattcccaggggtcccagctgtcatccagcaaggggccgtttagttcccaaaaagtttttccaaaaaacattacatcgaatatttggacacatgtatgagtattaaatataaataaaaagaaaaactaattgcacagttacgggggaaatagcg

SEQ ID NO: 4208 - DNA, 25927 bp, Oryza sativa
aaaatcgtctcgcggtttcccggcgagttctgaaattagttttttcattcgtgtccgaaaaccccttccaacatccgatcaaacgtccgatgtgacacccaaaattttcttttccccaactaaacacagcaaggtttaaccatgcaccacttagcaatacaattattacaatctattaaaagcacattaacataacatacaacaaagtaaataaataaaataataggaacccctacactaacatgttacaagtcagctgtaaacacatgtgaaaaagagaagagaagagaagagaagagaagagaaggaaaacaatctatatattggtagccagttgtagcacagactctaatactgtacagactctaataacacgtgagtgtataagaggtgagaccatatattaatggtgtaatatatgattatagctaacttagctattagatcagctataaatgaattggagctaatagttggttatattattaaacttactctcatatgctttccctttctcagctccagctcattcgctattcgaagaaaaaaaaaactaccaccaaaatacgcaaaaaataataccagtactagatctcgactaatcccgcgtcacgaacttgctaatcagtcaataaacctaatcaggagacaccaaaccaccgaaaaaaaaaggagagaaataataatattcgcgcatccatcacgaccccaactcgtcctcaatcgcggccacccgccgacccagcgacgacagcgcagggaagaagggaggacgcgacgcgacacgagcgcgagaggaaagcggaggagatcgaggagaaactccatttccccccccctcgccttctccgatttccctcgcgtggaatccccttggactcctccccctcccgccgccgcgcgagccgggcacggcgagcggcgccgccctgcccccgccgatctgctctgccttctcctcaggttcgccgtcttgttggattcgcctttttttgcgttcgtttcgggcgccgtcagatccccgcgccgtgtttggtgagcgtgagctaacggaatggcacggccagatctcgtgggggggatccgaggcggtcggcggatgctagatctggggcggggagctgtacgatcgccgccgcgttagatctggtcccgttgctcgcgccggattccgctgcttttgttgttcaaattgttttggtttcgagctttacctttgcgggctattgggttggatgctccgtgatgcttcgaagctacgggagaatgttagtgatgatgcttttttggatcttatggacgaattttatacaggggcttgcaccgaggaggaggaggaggagagagctgagcagaacaagctagattctcaaggaagggcgccatgaagaaagtattcgatcaaacagtccgggacctgtacgtgattcacctgccatcttatcgtataccgtgtgcagttcgagctccgttcgtttgcttgatacaatatatttctgtcgtaatttaatctgttctggtctttgtttttgcagaaaaagagaggtgaacaagaaggtcctcaaggtgcctggtatagaacaaaaggtaacagagatctctgctgctccctcacgcaaaagcatgtgttaagcatgatagttactgaatttaatggattgctcgcctttcaattttcatgaagcataatcagtgacatcagacttattccattttgctcgatggcctcatacagattcttgatgccacaagcaacgagccatggggcccacatggatcactcttggcagaaatcgcccaagcaacacaaaattagtatgttttcttcttgggcttttgttatttgatcacctttgtaacaaacaaaacctaattttcccggtgccaatgccctttgcgtgcttgcagccatgagtaccagatggtcatgaatgttgtgtggaagaggatcaatgacactggtaaaaattggcggcatgtttataaggtgtgttttcttatttgcttttaccccttaaccttcagtgttctctccttttatggatgtaagtggaaatagccacagcaatatgtagggcagtttattctgatgctatactatgcttgatatgtagggattgattgtcctggattacttggttgctcatggtacagagcgagttattgatgacataagggaacattcttatcagatatcggtattgctggaaatctattttctgtttcatatactccatgtagtttctgcctcaagtttcgtcagtatcttagttgcttgatgctcattaactttgttattataattgcagacactagctgatttccagtatatcgattcgagtgggagagatcaaggtagcaatgtacggcggaaatcccagagccttgttagtttagttaatgacaaagagaggatacaggaagttaggcagaaagcacttgctaccagggacaagtgagtgtgcttgcttttcgttatattggtacattgtgttttgtggacatgcatattctctgttttattgactacttttatgtgttcatctgaagataccggagtgcattcgccaccagtggaacacacaggagcccaggtggctatgacaatgaccgctatgaaggaagctatggcagtaggtatgataacagaaatggctacgggggagaaagagagtatggatatagggatgatgacagatatggtgttgctggaactactcccaatcgggaaggagatcgttattctagggattctaatgagcagcgctacagcagagatagagaagatgagtacaaaggaagtcatagcaaccatgaatatgcagaaggatcaggtcgcaggagctatggacgagatagggattcatatggggatgatgaagcttattcatcccggtccgtttcattgtttttttctggatttaaatttttacacgttcatatagcagtcaataagcagcctataagattgttatttcattaagttgctaatattcacttggttatttatggttctttatggaccctaacttacatacatttttccatcacagtggccggcaaagcaatgctgacggacctactcaggatgagaggtaaatgatggagaaatgctaagttcataacatattaacttgtcttatttgagcaatttatcttatgttctgtacctccttcggtaggcccatggagcggaagccttctaaccagcagattgcttcaccaccgccaaactatgaagatgtcacaagagatacacaggataataatcatgatggacggtatgtattttatgttataatgtttgatcagtagacatgacaacgatctctgatttctgaactaccgttcaatatcagaaatggagggactgtgcctgtgccagttgctgcagcaaaggtgtcttcacctccaagaacaagtgtacccccaggtcaggtgaatggtgtacatgataatactgtggaagacgtacctgcaccaccacctactcatcctgaagttaatgggtttgacgagtttgatcctcgtggatcagtaccaggtatattttcctccttttttgacacattgcattgcatatgaaccaaaagcccacattaatagaaagcatcacacaatattattttctgatacatttatgaagagaactgtagaaggaatgacccctattctggcattatactagtatcaatatcttttggtagtaattgagtactgattttttttttcaatatttgcatcccatgtcagatacctcacctccagtgaacccctcacaagccgtgaatagcttggaaatggatttattcggaccagatcctattaattcgttggctttggtatctgtgcctcagccaactgccagcccaaatgttgagccatcagcaaatccaggatttgagagtaacagttttatgggcatgccaccggcttctactggattcaatgaggtacgcgtctattgaacataaggccattcacgatactaatctcatgttctaatggtggcatggatctgttatactgaattgtagttctatgattttgtgggcttgaataattgcacgcgacaaagtgacacacactataggacaaaactttatttaaatcatgttgtttcttaaatgtatttaaacagcagcagtagtggtcacagaattgtggtcagtacaaactttttgaattaacatcaagatacttgttttggtgatgggatggttgtgttgttctatgtttatttgattggaatttgccttgtctggtagttaaatccaaccacctgttcatcttatccttttggattttgaccttgcaggcctttgatgcaactaatccttttggggatcctacgcctttcaaggctgttcatgaagaaactcctgcagtttctcagacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcctgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggacgtaagtggcttctctctggctgtcttctacacttgtacttttgtacttttgtgatctgacgtaatcttatgtctgttttacagcaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggtatgggaatggggatgaaccaacaggccatgggaatggggatgaaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtgagattatactgtacaatgcgatactcagtgaggggttgagaaacagtttaggaggcgtttggattttggtcacctggattttctttatgtatggtttcttttgttttgggtggggggggggggttataatttttcatcactattcttttcctatccatgttggatattgtatctactaaatatatgacatgtgaacgggggcaatgctacaactactgtgttgtgttggatgcaaagccttaatactataatcatcaatgtagctgtataattctctataggatgtttttttttcagtaaacattgtgattgtttcagcgttcttgctggcttgacaataaaaaggctgtaccattttgttcaagctatcttcctttctttttatgtcgtcacattttgaggtgcagacctgcagtttttgtgtcagatgtcacccgtcagtctgcaaatagtagtatatttttgctcgtccgaactttggaactacaggaatggcccatctctactgtcgcctcttttctgttctgatgcgtggtcacacaagccactgttgacacagcaactttgtatctccattattgacacagcaactttgtatctgaccataatgaaacgaagaattttgtgagttctttttatttggctgggattcttacaaaaactgcaacctaaccagttaagtacttgaatcttaagtcgaatcttgaagtttgtaaaacgtgtcccaggagcagcaattgtcgcatgtcatttaaccagctgtatgtgaggttcaggtcatcaggtggcatcaaaacgtgtatgcattggcgcatgcacggtcgagaatttataagtcattttgactttgctcacgctactagcgtcctagctacaaaatctcgtggccaaggtttccgtttcttcttttgagaatcccgcggtcaccacaagccgacgcctctaaagtcaaaactggttaaatatcgagctttgtacgccaacgagttgcagtaacctctgcgtgataatattggcttaatcacttccatcgattacctttcagcttatagccgtaaccaaaaattaaattttaaaatttagtttcgatgttgattttaggagttttcatcttagtttttttttttaattttctctgttttaaaataaaccaacctttatacatctatatcaaaattcatatataaaagtcggtttatttttggaacatatgaagtattatttgccttttaaattgctaataacatatttataaaagttttattcataaattatttttaagttgttaataagccgttagagcttataatcagcaaaagtgaaagtgattcttgtacacttatgtctcattacccaagtataagaacacaggtcagtcatccaccctagtcaaaatcaagactccgacccttgcatcatggaggcctaaagcttaacgaaatggccatggcaccattctttcggaagcagagaaaaagctccggttgagctgtatcgctagtactaccatatttgtgatgcaagtttgacctaaaaacgcagggtcccttgcttgctctggaaaaagaaatcagaagacgattgcagacggtgtttgaactcaaaaaatcaaaatgattggccctgaaaaagtctgaccacccacagttaagaggaacacaaattgttaactgttgcttgcactgaaggacattgagcagtgaattcaccaggggttttaacctacaggtttgcagcaagcgtaatcttggtaataggttgtaacagcatattctaatgactaattagtcggccaataataattccaccagatacaaatgtctgcaaaactctgaatactagtacagtgcattttgtgaggtgcaatgcacactatagaatctgaatctctagacagagcacagcattgttttcagtttttgtacagtgattcagagttgctgacatacagtacagtacagtacattgccctgggctcagaaaacgagcaggattgcttcttcggatgaactgtgcatctttgccctcaaactgcagcaaactcgattgcaatgttggcgtgaatgcatgtgcgaatgctcttggtttgtaggtgtcgcgagatccacgaatgccggtggtctctgcgtgctctaatggcgatacgacgcctctcgcttggattagctgcattctcgctgtgccccttttcctccttttcttgcttccttcgtctctccgagtgactcatcctgctttagctttaacccataataaacttgtcatctggcttgcattgcccatggtggtttaaccagggttcacgctacgtgtgttgacattttgcagatcactgcagcattgggaactgtgtcccgttattagttctatgatcactgttaattactcgtgattccggtaattaggcttgactgaagcataaatccttcagatcaaaggccatttcttgggaacttgctggttctttgtctgttccctctgttagctttgtttgcaaaatgcaaaccctttattcacatcatccaacgtgccagagttcgatcattctagtaatttgagaacaaaattttaaaaaaccacattttacagccataatcttcggatgcaaaagttggcttttgacgctgtccggcagagcgcatactatactaattaagccaatgcatgcttggttttcttagcttagttttgtctgaatatttcctgtgatgttgagagcattttgtgcagagagcatgtagctctcgcttcgttgacactcgccatcgtcgtgcctagtgttcacattcctccttcctctcactctaagcttctgacagcaccaagtgattacagtttgatttgcttcggaaccaattctgaactttgcagtgcagcatcgacggtgcccttattactagcttataaaaaggaggcacatgatgcattgcaacctagagtccagtccatgaacgatcatatctacctgcactgcattcctctgtgctcgactctcctgtatcttcctttctctgaatctctgattcatctgatgttcattcattcattcgtctgctgctgcactgcactctgatgcagtaactgctgcttattctgatcctgcaatgcttctgctgaattctgcatgtatcagctcaatctgaagagttaattacgttgtttctggcgtttcatttcctgaaggtaatagcaaacaatttctctgaacttcatagtaacatgccactaagtatctttttttttcttttttttttgttctcgtgtcttgtactagcagtcatcaggctacaactagctagctgcatatacaaataacctaaggcaagtcatatacaggttgcttgtgtgttctgaatcatgtaatccactttactgaattcttactgcatctcttagattcagagtaagtaattcatcgtgtagcttatatactcatcaagtcaaaagtagtactagtagagatttctaatacatttcatctcacacagttgatcgttgaacgcttttttttttctctctttcagttgatttcccgccacaaagtgcacactagtagagacgttgcgaaagaatttaaaccgatcgatcaggcggggtggcgcgagcgagttcccgccaccaccatgggcgtcacccgcgcgcacatcgtgaagaatgacgcactggaggggatgctgggcgagttcgtcggcggcggcaagggcggcgggaaggcggggcgcgcggcggcgaggcactcgtcgcggctggtcgcggcgctgacgtgcctccagctcgcgttcgccatctacgccaccttcctactctactacatgagccccgccgtggacctccgcgccaagccggacttcgcgtgggcgacgcgcatcgcgcagcactggaagcagctcatggcgcagcccgacggcggcggcggcggcatggcggtgtcgccggaggaggtgtgcgagcacgagagcatcgacttcgagcagaagaagtcgacggacgccgtgatgatccgcctcaagcgcgagctctacgacgaggtccgcgacttccagcgccggagcttcggcgccgagacgctgccggagctcctccggatgcgctcgcggtggagcgccgccgccgccgccgccggcaatcagccgcgggtgacggtgatcctgaaccacttcaagcggcggacgctgtgcgcgcagctggacacgctccggcggcagacggtgccgttccaccgcgcctgggtgctcgccttcgggagcccgaacgaggcggcgctccgccggatcgtcggcagctacaacgactcccgcatcagcttcgtctcctccggccacgacttcaagtactacggccgcttccagatggcgctgcagtcggagtccgacttcgtctacgtcctcgacgacgacatgatcccgggcgcccgcatgctcgagatcctcacccatgtcgccggcaccgacaagtaccgcaacgccgtgctcggcagcatcggccgcatcctccccttccgccagaaggacttcaccttcccgagctaccgcaagttccgctccaaggaggccggcctctacctccccgacccggcgtacgacatcgccgtcgaccgcatcgtgcaggtggacttcctctcgagctcgtggttcctcgccgccgacctcgtcaaggcgctcttcatcgaggtccccttcaccttcatgaccggcgaggatctccacctgagctaccagctgcagaagtacatgggcgccgggtcgttcgtgctccccgtcgacgccggcgacaaggagacgtggggggacagcgagcaccgcctcgcgtacgtggcggagacgacggtgatcttcaaggacatcgtgcaggtgcgggacgagcagtggtggcgcgcgctcacctccggctacgtcacgcagtgggcggcgatgcacccacagaaggtggacgcgctcttctacgcgcactcgctcggcgaggtccgcgcgctggcgccgctgctggagcggttccgcaccaccgccgggaggaaggcctacctcgtcgtctccggcggcggccactgcccctgcgaggaggcggcggcggtgctcaagtggcccaaggttgtgtgcaaggagaggcgcttcaagatcttcgacctcgccgtcggcgcgctctccggcccctcccactccgacgtgcccgtcctccacgccgtctactccagcatgcgcggcatcgtccgcatgcacaacccgagcgtcatcgtcgccgtcgccgacgtcgactccaagatcaaggacgccctccgcatggccgccgacgccgccgtcaaccgcaccgccctcgtcctcctcccccgcaactccatctccaaggttctctggatggccaacctccgccccacctcactgcccagtaagcttcttctacctcaaagctctaatccgccattgttgcattacatcaaagctctaaccattcgggaaagtgaattcatacctcgaggggatatcccctggtttcgtgaatacacctaaatagtcatcaaaaaatatataaaaaaaattagcaacataaattaatatgaaatatatcactccataaacacataagtttaaattcaacttctataagttataacaaaaataatagatatagttgcgaatgtgcgataactattttcagtttaatttgttatctttgttgcaatttatagaagttaaatttggtcttgcatgtttgtggaatgatatatttaatattaatctatgttatcaattttttttattttttttataacaatctagatgacatgcaaaccacgagtgtatcgagggatgaaaatccagatcctaaccaatccatggatttcacgcagactggaacaggatgcggatctcggtgaacatcatcacgcagaaccgggccaagtcgctgcggcggctgctggcgtcgctgcgggacgcctactacgtcggcgacgaggtgccgatcagcttcaacatggacagccgcgtggacgcggcgacgctgaacgtcgtcaacgccttcgactggccgcacggcggcaagacgctgcggcggaggatcatccagggcgggctgatccgcgccgtgagcgagagctggtacccggcgaccgacgacgactacggcctcctcctcgaggacgacatcgaggtctccccctactactacctctggatcaagtacgccctcctcgcctaccgctacgacccccaggtctctctccctgagctctcctccatctccctctacacgccgcgcctcgtcgaggtcgtcaaggagcggccgcgctggaacgccaccgcgttcttcggccgcagcaagaaccaccaccccaacaccccctatcttcaccagcttccctgcagctggggcgccgtcttcttccccaagcactggcgcgagttctacgcgtacatggcggcgaggttcaccgaggatgccaagcagaatccagttcagatacctcggtcccgcaccaatggctggcaggcgtcttggaagaagttcctcatcgacatgatgtacctgcgtggctacgtcgcgctctacccgaacttccccgaccagagcagcttctccaccaaccacatggagcccggcgcgcacatcagcgccaagggcaacgtcgtcaagcacgacaagagggacttcgaggtgccgctcgtcgccgacgacttctcgccgctgctccccgccgggaggatgccgccggcgtccaagctccccgtgctcaacctcttcaaccagccggtctccttcaaggcgctcaaggccgccggcgccaagctccgccaggacgtcatcggctgcgccgccacgcagctcgtcgccgtcgaccacgtcaccggcctcccaaagaactgcaccgccttctgatcccaagaaattgaaattgcatatatatattttgcattgaatttcttcgatgcatgaacacgttataaacgatctgatgacccatacgttgttttaccattcgtgatttttattcttttgctcacgatctctacactgtatttagctgtggtttacatgtctcgtttatttcggttttctttgtatcatttagcagtgaaactgaagggagttgcagagcattttcgcgctctgtacgatggtctgtaaagggctaaagatgtagccaaaagtggcttctctttgttattgttcttgattttcaccatagattcatcattcatggaaagtacgctgctacctcaataagaactgttctagttgtatagtcttcaattcctctgtttgtgtacaatgatcttcaattcacaacaggttcatgcagagtacattgatttcagagagagagagaagcaatcttgagatggttctaggacagtaaatttgtgaaggaacgacagcaatttcccaccattttgggcctagcaattctgctatgcttgatgtttcatactactacttgcttagacaggagctccagtatccaaatagcagctgatccactctctgcttttaattgtaaattttactgaatgtcataaatcttcgggtgaacaaagtacagaaacagtaggagtatgactctgctcatcgaataatcgctactagcaatccatcttgagatttcaaccgtggagaagaaatggtgagaggaattaaagatggaaaagagaaacagagcgcctcagttttagccttcaggagagtaatgccgacttgcagagagctgcatatgatttagtcgctgctcccctctcctgcccggtcgcccacgtggacgccatcggccatttaggcatttaccaatctggtgatctgccggacctcatcgccggtccgccggccgctggcgtcttcactggtcatcgccggccgcgtccgggcctcacctagtcacctcccttcggccttggaccaacagcccaacaggcaattccttcgagaaggctaattcgcgactggtggcgtgcggagaggagggcggtggacggcgcggtttctttttttttttttcggtttacagtttcctttttttttctgtttcatctttccgtatcgccctttgaatcgtaggaataaaaaaacggaggaataggaaaaatataggattctgacaggaatgtaagtgtaaaacagaggattgcaaaacacagaaaaaacataggaattatcgtttgattggaccatagttaaaatacaggaatcggatgagagagatagactcaaaggatttttaccaagaggttggacctcttgctaagtttcctctaaaaccaatatgcaacaagccattccataggaattttgtaggatttggaaaacttcaacctttgaatcaaagggctacatgggaaaatttcctgtaagatttcaatcctatgaaattccttcataattcctttgattcaaaggggccatagtattttcgccttttttaatacgtatttatagaactttgtatacatacacatacaaactttatatacgcgtatacaaactttatatacacgtatataaactttgtatatacgtatacaaagtttgtatatgtgtatattttgggtttttatccgtacgcactcaaacttagtatatgcatatacaaagtttatatacacgtatacaaagtttgtataagtgtgttttttagacttttttatacatacgaacacaaactttgtatacatatgtatatttttatacattaaagtgtgtatgtatatacaatatacatacatataaattttgtatttacgtatacaaaatttatatgtatgtatatagtatatgcatacgtatatacactagtacttcctccgtttcacaatgtaagtcattctagcatttgccatattcatattgatgttaatgaatctagataggggagtggattctaatccctcgaggggatatcccctcgtatacctttttctttcaaattcgatgtaaatagttatgaaaaaatctgaaaaaaattgacaatgtagagtataatgatacctactagtgcaccaaaattcaagttcaaatttgaactacacatcgagaaacaaaaaagacaaatttagatataaacagtacgctactattcatatgctgaatttgtcttttttatatctcgacgtgtgagttgagtttggacttaagattttgtggagttgtatatatatgttgtatgaatgttgtcaaatttttccagaatttttcataaccgtttaaatggtttttaagcaaacgaggaaacatcgcttcgagggattagaatagtttcccatctagatagatatatatgtctagattcattaccatcaatatgaatgtggcaaatactagaatgacttacattgtgaaacagagggagtatataggagaagagagactagagggggccagctgatcgcgcacgtgcgcggccgcgcgactagccgcggatcagcagccccctaatgcagaagcggattcaacgtgggtgcctgcagggggacttgagtctcactacacccacaagacctatggataccccctcagcacccttttcgattttttcaccatggatgataaaccaaaggtctctagatggctagaggttgaaaaaactgcgtaattgagcccccccaatttttttcccggatccgcccatgccccaatgccttggcctcctctcacttctcctctttttttctaattcttgatttgatttgatttgatttagtgtaagaactccaatatttctattaaaagttttgaatcactgtataactagcatgtaacatgttaggccacgtagattacatggctagaattattatatttttctcacataatagcatatatattttcacattttattaataaaatatattaaatggtaacataattttaagttctgtactaacttgatcagattaacaaatgtgtaataacttaattatatttctatatagactctagattcctcttccaatattccttcttttttaatttgaagtttcgttatttataaattttattcctatatgtactctaaacccttatttcaatatttattatttttaaattccgaatttcagttatttataaattttatttctatatggactctagattcatattccttattttttttaattccgaacttttgttatttataaattatacttctatatggattctaaactctttttttcaatattccttatttttaattcttaattttagttatttctaaattgtattcatatatggtctctagactccttttccaatattccttattttaatattcctcaaccactcgcagagaactccggtgggatcgctaccacgccggtaattggaccaggtgtgtagttgtaccttgaccactcgtaaagaactcgtagaggtggtgggatcgctaccacgcaggtactcggaccaggtctctagtcataccttgatcactcgtagagaacttttagaggtggtgggatcgctaccacgctggtactcggaccaagtgtgtagtcgtacctcaactactcgtggagaactcttagaggtggtgggatcgctaccatgtggctactcagaccaggtgtgtagtcatagctcaactactcatggagaactcgtagaggtgttgggatcgctttttaaaccacgcctgtactcggaccaggtgtatagtcatacatcaaccattcgcaggagcgcttgagttgattattacatgtgcttttcatgtggccaacatgacatcacatacctaacttataagcatgtcagatgtccattcgcaatcatgccgggtgatcaagctgacaatgctcgcgaggagattgtatgtagcaaccttttcacaaataaactgggtcgtgaccggcactaaatgtgagataggccgccggtatttgttggtaggtttggtccgacaagtccacgtttgttcgagaacgttctcgacaacggggtgtaatcgacctctggctattagagtgctcgatcattcctaaaaaatattttctataagacaaaatatatagcatagaaagctgagtacatactcagaaaattgtataaatcttctagtattgcaacatatataacatagaaagccgagtacatactcagaaaattgtataaatcttctagtattgtcaggatgtaatgagcatatttggattaagaatcgggtattatgtataccgtaaacaagcgtcatatatacaaaaagaatagagtaagccctcagtattaaatggtaatcggcctaatatagggagcatttgcacaatagatattgtataaaaatatgttatatgtaaacataataaattattgatatgaaaataggtatggtaaattgtatatataaaatattatgtatctttgtagatatatgccgaatatatatttgaaatttttagattaattgaaatcaattagtctactaattacctttttggacacatactacagtctacaggtaatatgcgtgtctgtctcctggatgtccatgtgcacgtttctggtaagtgaccaccaaacaagcacgttggttttgtcctttaccgaataggtgcatggatcgggtcatacggtgtattcgcagttacagtagtagactcgtaggtatgtgtcgacagagtagattgtgattacggtatttgcatgatatgagtatcgttcgtgctaacgtagaagcgaaattgagataaaagagatatagacaagtatttttatataggtttgggctccttgattgtcaggtaatagctctactcctgtcgatcgaagccggtgttgctcttattcatcaggatcatatgagcacaatatttgggtctaacctacctagtcgtcgtcgacgtggcagcatggaacaccacatgtagtagacgacagggtagtcttcttacttgaatattaactagacgaggttagaggatagctctagatccctcatgtcggcctctgtgactccagattgggtctatctaggcatgtccctcatgtttgtgtttgttggcatatattcgtgtgtgtcccctcttcttctaggggatcttgtatttatacccacgaatatcccttttttcaagtagaactaggaagatacatatggatatgatccgaataatccttgtagtttccaacttgaagtagtttccttccttatctagaacacctttcgtatatgaggtatgatttggtataagactagttatatggtgggcctcaccgagaccaatccaagatcattaagcatgccttatccataacacacaatatgcattagttgttgtcgtgttcgacttgatgatagatgggaggatgcaagcgcacgacaagtttgcaggggagatcaacatagtactctgtactcgactctgattgctcgagagtgccgatgtccgtccaatgtgaagggcagtcttcccgaggtttaggttgttgagtcttggtttgcgttgatttgaaagtaatcagcccgggtgaactcttgtggtcgacgatatcgaaccgttgttagtcaatcttggtagatggaaattgttggtggcgacgttatctagtcgggtcatatttcccagagcccaagccgttgaagtatctctcgtcgaaaaaaccacactagcaatgtcttgacaaagtttaagacaacgaggatcccgctccattgaagagaacgcgctccgattgggtcgtatctcctaaagccgaagtcatcagaaagttcgccacttgaaacccatctcgtcaaaaacttgaagcaccaagtcccctacctagtgctccactatcgagggtggatatcccgaccacagtatttatacagtatggatatccctacctggtgttaggttatacgtgagattgaggtaaaagagacgggagacagatattttcatacaggtttgggtcccttaactaaccggtaatagccttactcatattggccaaaaccagtgttgcctttatatataaatatcatacgagtacactatttgggatgatttaatctagtctttgtcggcttggcggcatggagctctcacacgtaggcgacggctggtgtagtattcgttctcggatctcgaatatgaactcggcgagattggaggtagcgctagatccctcatgtcgacctttgtggctccaaattgggtttgtctaggcttgccttccattggtctagatttgtattggcttctgttggcgtgtccccctcctcctaggggtcttgtatttatactctcggatgtctccttgtccaagtaaaactagggagataagtatgtatatgatccttgtccaaatagaactaggaagataagtatatatacgatccgagtaatccttaagtgcccgagtagaagtttgttttttcttctttatccggaacaccttccgtatatgaagcataattccgtataagatttagtatatggtgggccccgccaaccccaacctaagattattgagtatgcattatctataacactcattcctagaggctagatggaggaggctgccccccagtaccacgtggccctccccgaggggagtcaggcccgaggtggggcggcagccactccttcttagagactagatggaggaggctgccccccaataccacgtggccctcccccgaggggagtcaggtccgaagtgggacggcggtcaccccctcatgtgactaggggtcgggctcccccgaccccctcagcaggtcgccacgtgcggtgggttaggtggccaccttcgagcgctcacctacccacattaatggtgacctgagcagacgcgccacgccgcatttaatgtggcgtgcaccgcgcgctaatttggtctgtgactggtcgaatgaccgacaggacccggggtgtcaggcgtactattgcatgggtcagggggcgtgcaccctgtcttgtcccatcagtcatgatgacgagaggtcttaacctctcatcctggccagagttggtccgtccgccctggtcaattggggattccgtttcccggcgcaaatagggacccagaagtctccacccattaatagcagctgacatgggcgcccctcgtgtcaggcagcaagatttgacaggccccatcatcaagatgacgtgcgcttgcttcccaagtcaagagacaaacaggcatttaatgcaaaacacttctccaccggagctaggtttttgggcccatgtggtaaccccttgagatataaaaggaggtccaggcctagaaaaagggaggagggatcgaggacgatccattggacactctagagcagtctctagccacggatgatcaacaccacattttactccaacaaagagatcttataatccttcactcaaggagcatagcacaggagtagggtattacgcttcttagcggcccgaacctatataaatccttttggtctcatcatctttgaggggctcgaccccctcaacacaaacactgcttcgctcaccgaatcctcaaatctcacccgctgcctccggctgaacttacaaaggagggtctcatgaccttccgctagagaggatcactcctcgacaaaaccaactagcaatttctcctctagatgggttcaatccagcaccagatacacaatgcaacatgaaatccgagccaagttggttgaaatatagggattgcgaagaacaagaaaacaacaggtcaactggtacctgggtagaggattatatacgccggcggtagctcagccacatcgtagccggcctcctccacaacttgaagccacaccaacgaattggattcgcgcagatcggcacagccgggcgatcgatcggcggactagaggcgatctatcgtatcgtaggacgtccgacgctatcgatgagatcaataggcccaataggcccattgccgtgaggcacccgcacctctttgctcagtttgtgcgagttttctttgttctgttttggccatgaactcttcaagtttgtctaattctgatcctctacttctaaaccgtttaatgatgagcaatgaacgatgggagaaagaaacagagcgactctgtttctagtcttcaggtcagaaggagagtaaggcagatttgcagagagttgaacatgatattgcgaattgtgacgggctgatgatgtacttagtacattttcatggacatggcaggcccaagttttattaccactagcagccgaacaatatctaaagaggatttgattcgttattgtattcatgactcctcttaaatctactgtagtttcttctcaagcagttgagccccgtgaaaaatcactcatactaaggtggagtactagaacacaagatgaagatttgaatgttcatcatccgcacacggtacatctatggtgtggctgtgggtagtaagacgataaataatctccattctgaaccctcgtttgtcagaattagtttgcattatgttctttcttttgtctttatattattgtactgatccggcacaacagtagatttcccattcataatctgcacgacagtacagcaatgttcaagtgcccactggtccagcacattattaggtgcccaactgcccagcagaagccgcaaattgagttgtcagtaatcagcagtagcgcatagttataccagaggtagccagatcacaagaagaaagaaaaagttcagagcataaaggaatatatctcctcaaattggatgatcacaacttgtacagagggaggcaccaccaaccaacaaggcaggagaaacagaaaaaaggcatatagagatatataattaattgctacaaagtaattgctagtatagaaaccaaataacacttatcaatccctagacatagatgaactgcaaaaagaatttttcggagttcagtacatcaagctccaatataaactatgatggatgtcccccctgagtagctactagcaagaagaaacttctaattagcaaaccaacaaactccacttcctcatcaccccccttaaaaaaaacacatctcattttcctcctcctaattgactgactgactagctgcaaagttttcctctctaaatctgtctccctctgctgctggtttagctctccttctcacctacctaattttgcaagcaactgcaaatctgcaatgcaacaaccactgtgattcatctatttctcctgccctcctcctctctctctctctcacccacctctatacaaaacaaaaaatcatctttttaaggggaaccaattaatcaatagacaaaaaggaaaaaaataaaaccccaagaaaagccctagtgaactaacgccagtatgaccccggcgatcgatccatggattgatgatgatgctgatgctgatgctgatggaaaccaatgcagagcgggtggtgatcgatgatggatgatggcttcaggagggcaatgctgctgatgatcacactgctgtccatgtccatgtccatggtgatggtgatgacgaggaagacgacgcactgacgactgaagcaagcatgcatgcatacatactaacatgtatacatatatagctaagggggactgagaccgacgaccaaccgtcctccgacgacgccgccgccgccgccgggagattaatcccggcggcggatgtactgcaggaggtcgcaggacgggtcggcggtccgggttgccttctggcgcatctccaccaccttcttgtgggagttggaatggatggacggcatgaaggtggggctcgccgccgggcggtactccgggaagaggcggccggacttgtagcggacgccgcacgcgttgcagagcgtcttggggccgagcgggcccgcgcgccactgcggcgtcttctcgatctggcaatgcgtgcaccgccgcacggtgcccggcgggagcgcgagcgcgccgccttcctcgtagtcggcgtccgccgcgtcggcgtcggcctcggcgtcagaggcggcggccggagcggccggcttcttggccttcttcttcttcttcatcggcggcgggtgcgggttggactcggcaatgctctcgggatccgagtgcgacgaggtggacgagtacattggcgtcggcaccaggatggtggtctccgtcgccgccggcgcgccgcggacagccgggaacgcggacggcctagaccgtttgctgcgcgcgcgcgccgggatgacgagcacgggcggctccgggcgcggcgacacgggcgcggaccacgcgcggccgctgccggagaacgactccgacgaggaggacgccgacgaggaggacgacgaggaggagcccccattggttgccacgttgaagccgctgtgctccagcacggagatggggctggagctgcggaacagcgcctcctccgccttgtccggcagcacgacgccggcgttcgccgtcagcgccgacgccttgatcggcgccgcgcagttgacgcccggaaaactcggctcgtgcgggatggttccatcgtcgaacagccccgacagccactccagctgcgccatgtccatgtccagctcatcacactgcaaacgacaaccattgccacgtcagatcagtcacatttcctctacagctgcattgcagcagcctgctaattttgtcgttactagctgttcatgttcatggtcagtagtactactgctagtaccaccatgacatcataatttcttccatccactactactgtgtaaatctactgtaaatcaatcatcattagcggttggaggaaggggcccaggtttaatttcggttgcttaaagcggagaaaagggttactgctatgctaggactgtttgtaccacgttgggtttagtactagcatagtatagttgttgggcaggctaactacccaaagtaaatgggccccaaaaaggccgaaaccgccgtaaaaatccaaccaaacggaagcaaaaaactcccatcacgatggcacgccgacgcccgtccaccgacacggccatcgcctgacccaactaccccattcacacacgacgcgcgcgccgcgtggcgtggagcgggcgccaacgcctaattggcgcccagctgttttgaacttgaaccgctcgaccgacgccgacgccgacgccgacgccggcagcggcaatatcgtccgaattcctctaaatcggccgtacgctcaaccacggggaggtggtgggggagggggaacttaccgggccaatgtgggcgtccttgcggtcgaacacctcggcgccgagcgcgccggccgcgtcgaacagcgccgacgcgtcgtccttcgcgggggccggcggcggggggagcgccatcatctgcggcggcggtggcggcgccgccgccatggtggcgtggccgccgatgatgcgcgaggacagcgggctccctggcgccggcgcgtcgagcaggagcacgtcggcggccgactcctccttggggaagtcgagcaggtcgtcgatgtggtcgaagaggtcgccgcaggtcgcctccaggaggctctgctcccgcagcatgtcctccacgaatccaacgcccgccattgctgctgctaccaaatcacaatctgttcaccgtataaatacagaggggagagaatgaagaaacgcgtgtcaataatgcctcatctcgagatcaatgtttggatatgcatgcattaaacaaggcagtatccacaataataagaaagcaaattaaagcaacacggatttattcacctatgataaaattaatcaattccaaggatatgatccacctatatcaataataagataaaattcgtataaatggttacacaacacaccactgccagaaatggatagatgacgaggcgttactaatctatccctactactaccagaagaagtgcaaatctatctctctgagctgtaaatcaaaagctgcaggagggagatttttttttcttctctttcaaagtgacggcaggagcgggctccatatgtatgcggtgcatgatgacgcgcttccgtgggtgggccccacccacccccagccatgtgaccccgcatgtgacgggtgaattttcttttctttattctgaagcaaggctatacaatacagatggcgtactactctacccagggaagaaaattaatatacactcactccgtatataaaataaaaataataaaaaaataataaaagtaaaaaagaaagaaaaaatctgggcgtttgtttgattgattcaccaccaaggactccatccctatgcgtacgagtagtaaaagtcaaagcttgccagcacaaggaatttgtcaaaagggcggggggattagctgacgtggaggcgccctattggtccggacgcgtcactggcgtgccactggacaaagcagccgcctccctcggtaaaagcagctaattattgccgagtcctcgggtgaaaacaccgaggaattcatcaaatttttttctcgcatcaatcgcggccattcccacaggaggagggagcagtacggatcatgcaaaggcgaatcttgccatggcggcaatggaaggaatctttttggttttttttttccctttttgttgttgtttttactgcttgcttgccggcgtattgcctctcagaatttgcacattttttctcactgtccccaaatgtttccagataatccagactgtaaaaaaaagtactacaaaatcagggggacgcggttgaaaaagcttggaataatagcagtagtaccgacgtgtgaaccctgataatcccatccaatttttccatgactttctatccatctagtagccggaagcttccctttagtaattttactctcgatttttttgaattgatttgaaaattttgaaatcttcaaattgagaaagagtccaaatcggaggcttccgagtttcgtcatcctcctatattcctcccctttcgtcttccttccggggaagatgaatgaagcaatgaacgtgcaaaaaaacacgcatggcaatgaattaagctggcgacgcggcgaaatacggccgcgcgccaccgggaagccaacttaaaatgcaaagcccctttgaattcccgatcatttcttgccatttttttgaatttgaagaaagcggcggcggctgattttgcgggggggggggggggggggg

SEQ ID NO: 4209 - DNA, 8947 bp, Oryza sativa
gggggggagagagaaatgggaaagaacacatcacatgcagcaggagcagctaggctttcagctcacctgtgtgggaaaattgtctctgtttcctcgcaccgatcgatcaacacctgctcgatcgctctcctcgatcagcttttgcttgccttgccaaaaaaaattgtctctgctacctcttgttgcactctaactagctgctgttgccgatcaagaagctggctatctgaatgcgtttgtttatgtaagtagggagcagctgcgaactaactctatatatctagtacaccttctgcatggacatggttgctccagaggaggaaaaggatgagcagattatgataggaggaagaagaagaaagttgctgcctgccttgcaccactgcaattatatggagagcacttcactgtactcctaaggcagagagatggcgcaattccggagtgctatataggtggaggtaaatggaagaacggaaggagggggatggagaaaaaaggatgcgtgcgtgggtcggtggaattcaattctagagctataagaggaggtgtatgtagtactactagtatatgtatatactgggggaggagttaagctgcaggcagagctcaaaaaaaatttcaaaaataataaaaatggaggattaaatatgggtgtgagaacgtgagggaaggtaagaaaccagcacagctttcaggctttcagctgggacttgagaggagacgaaaccaaaaaaaaaaaaaaaaagtggtatctgcttgctgggctatggctcctgggttttgaacgttggaggctagctaagctatggcggagtggagatccactcccactcctcgttcccttttacactggtgctcgcacacgacctgcacggcacacgcggatgggaggaagaaaaaaggagacgatgcgtcgagctggaacggcacgaaagagacgaccagagagaggcgcccttctacagctaagcttccgtccgtcagtcactcactgcctcgtgaggacccagcaacaactagtactactactgctgctactatgcatgccatttactgggtctgggacgactacttctcccacgattattacgattacggtcacgattagcagtgtggtaaatgggttgtttaaccatccatgacgtaaaaaaaatcaaaatcaaatcagcgtggtaattaggatcgttgagcaaccacaattgcttgctggtagtaagtgctacagtacagggagatggggacggtaggtgagccttcctccctcactgctagctgtcctcgcccctgtcgtgacgttgaagtttcctccctctttctctctcctcacatccctctttttttcccctctcccagttaaccaaaaaaacccagaaaatacaaaatgctaaaatcaccagctcagattttttttctctccctcctgtatgtacacatggcgctgggttatcacacatggatgggcatgagatgccagctgctgtcacgacggtcacgactttcctcccccttgcctccgccgctcgctccttcacactgtttaaccgacagccaccgctcccgggcatcggtcgtcggatcctctgcggccactggtaaaatcctcgcacgccagaccggtcgtctcgtcgcagctactagcgtccagccgtgtcgcggttagcgcgcgcctccacggaagcatcccgcggtcgccgccgcaccgcggccgcgcattgaccgcgcggaggccgcgtcgtcttgcttcgcttgcagctgggtgagaacggtcagaaacaattggaatcggtagcatctcttataaaacaatattagattaatcggtaattaattatatttattatttaaattactcagtgtcaatagatacagcaaaaaaattagaaaaaaaaatttaaaaatagccaaaacgataccattttggaaacggcgctccgtccatcagttgatcggcagccgtatggacgcggactcgcgagccgcgcggcgcagggtgcgtagccgcatgcgacttggagaccgcgacggcgatgtgggggggcaagttgggcaacgagacagacgctgcggaattgcctcttgattgagaaggacgcgaacccgattcaaaaattttctttctcggtccaaaggactcgtggggttgtaaattcaaaacttatctaactcgatcgtcgattgcatatccgttcggttttgttttttttctatgtgcctacttgttggcgttctagggtcagcgtacgtatgctctctcgcctaacacttttttgagtgttctggtatattgcccaacccatggaggatatgtgcgcacgaacgacagtgcagttaatccactgtctctgtcaaattaatcccttcggtcgatagatatttaccgaacttaattactgccgtgcccatgttacgacttactaggatatatacatgacgtatacgcacatatataggacgtaatagtagtagtagttgatcctttgatccctgatgcattactactagattaatcttatcctgccaatcgatcgatctgcatgcatgcatgcagctggtgttggtggtagcaaagcacacctgcacatgaacgatcgcatctggatcgagcagcagtagtggccaggtcgggtcactcactcactcactcgacctacctacttctctctactactacctcctgcgtgtgtgcacacacacagccacgaatacaaacgaacgaacttggtttcgttcgtgcatgcaggtggatgggatgccatcggggactactactacacccgtctaaaattaggatatctttttgagtttttacttataacatttgactattcttcttatttaaaatattagtgtaaattaaaaaatcatatttaaagtacttttggtaataaattaagtcgcaaatttaaaaataataattctatatattttttaatatgatgaatggttgaacgttaaaaattttttaaaacgataagtatattgaaacagagaagtactgatcacacaaatcaacaacaagagttgtcctgcacaggcagcacagcatgcaagcacagctgcgccacatgtgacttaacgaccatcgtggttggggttgggaaaaaaatcgcacggaaaaaatggcgattaattgctggaaacgggagaacggagaagaggggggtgcgtggtgatggaaaaggggagcaacggaaagggaaggaagagtaaagtgaccgcacaaccgatggttgttcgggcctcactgcccccagcaaatcatatgacgggtcccactccactacgctactgatcaacctcttttcttttcttttttttctcatatcatcttctttctttgcataactaacttgggttgcactccttgcatccattccttgagctttactactccccaactcactctcactctctaccccgatcacacctaaacccattggccacgccagcaccaaagcctgttccacgtgtacgacagtcggattcgtaatgcttggcttcatctttttagtgtaaaactcgatacggtatcagagtcaatttgacgaaaacgtaaacccactttcaatcaggtgaacataagtccatatcgtcaatgaatgtttaaacttttcatatatatatatagggatctggaggatgaagcatgcatcattttattttataaaaaaaatatttaaagcgtacaacttgatgggaaggaattgaaaaggtattaaccattttgcggtgacataattcatatgtgtgtgtttttttcagtggttgttgcggttgccactgccgttttcgcgaggcataattcgagcctaatgatgccgactttttcctcgatcgcgcgctgcggacgcagcagaaagaaattcgtgcgcggcatgtctttgcttgtttgccaccgacggggccgagcgacctctgccagacaaatgggtggcatattatactagcaaaggaggtcgacactgaagagttgatcgagtgagttaacatcactcgtcaccaacccgtatatatacgttgtcaaatcaatcggccgggcaactcaaattttatgtcaatctttgttaacatatttttaaaattattaaacggtgtgtttgattaaaaaaattatataaaaattgttttaaaatactaaataaattcatcgttcaagtttgcagtaactaaaacttaattaatcttaaccgtgcagttgtatggttttcgggtctggtttttcttctaaagtggaccgattctcttcttctaaatataaaagtggaacaaagttccgccagtggtttaaaaaaacttaattaatcatacgttaatatatttttaattttaggattgctaatttgatctttatctttattagaaaaagaacaccgttgaagagtggcatactagcaaggagagttcgagactgaacagttgagtgagttaacgtcactcgtcaccaacaccaacccgtatacgtcgtcaaatcaattggccgagctattcgatcagtggctgtgctgctctctcagctcgatcagatcagttcgcttgatggccgtggctaactaggtacggcttcaatttgttggtgtcggatcactcactcacttgatatgatccaactgccgcctctgatctctctcttgcatctccagcaagcaacaattgctgtagcatttctggcctcattttcttccttcctattcttctgttgaacatataattgcacgattgttgtatactcccttcatttcaaaatatttcacaccgttgactttttagtatgtgtttgaccattcgtcttattcaacaaatttaagtaattatttattctttttatatcatttgattcattgttaaatatacttttatgtacacatatagttttacatatttcacaaatttttttttgaataagacgaatggttaaatatgtgctaaaaagttaacggtgtcaaatattttgaaacggagggagtacatcgaatggaaaaagtagtatactgataatgttggattcagtactacactgttggtggcagtagtagtaccagtgccacgacgactgtacacacatgcatgctgtctcagctcggtggcttggcttagctccaacacctgcgttccgggcagacaaggattaattatggtttgttgcaaggcgagacagccagccatccatccatccatccctacggagaagaggaccatcggatcgagtactcatcttcatctagtgcgtgacatatatcacgagtcgtcgtttaaccactcgtttggtggttagttagctgtgcgtattagcagcgatcgaacaaacacatgtagtactactggttccagtaccgtttacattgatcggtcccaaaataagcttatgtgtgggtttctatgcttaacgtttgatcatctattttatttaaaaatttatagaatgttaaaaaaacaagtcatgtataacgaattattcatattttatctaataataataaaaatagtaaattatattattttttttaaaaaataagtctaatggttaaacgttgaacataaaaatttacaaatgaactcgttttggtatggagggtgtacaatttctcatgggcaccttgtcttcttttgccattgagaactcacagagaatcagacatgtatttgttactgctactagtagttggccaggtagattggcattagcaggagcagcaacaacatgatgctgcttgttgcttgttgcaagtagagagtagagtacagtaataatcagtgagaagaagcgacaagaagcacccgatctctgacaattatgggatattcaagtcccctgcatcgatccctagggggagcggattatgattgctgcatgctcaacatgcccctttgtgctgtcagacaaataaagttactcctactacgatcagttccaatagtaggctattaggcagctgtaaacatattttaatgagataaacaatgagagagaaaagcagcgggctatagatctgtagtcagctatagcacggactccaagacacattgtgtgtatgataggtgggaccatatattaatagtataataagcaattattgtatgaattgactattaaattatctattgatgaattagagctaggagtagactgtactattatacttgctctactagtactactgcaggcagggcaccaatcattcaaatgctgccagtaattaaactggcactatctagtttatctctgccgtagaatcacttggtttttaatcaaccgtgaccgatgctgacggcccactggaattcagattctcccttctccctccttgcaagtaaaagcttgcattctggtagaaatggctagctactgattaattaatgaattgaagtgaaatccaccggtcgatcgatcgagccatgtgtcaatgtaccaaaagggtcgatccatccaaccaccggccggttaagaccaagatgagagtttatctggatgatccgggagtaacatgggattatatcagctagtaacatgtacattagttgctagtatcatggcctgctcttacttactgtagccttgtgactaatgagcaagacaacaagtagtgataacaattcatcaggattagtgagataattaattcactagtatgcctgagtatccttgtgataattaactcacttgatcgcctgttagtgagataagcgacaggctaactgcttggaatttcctctggtttcactgcacaggttaattaatcaacaagattgtagattagtactattaggtggatcatcaaacgtaaggaagattcagacaaagcatgcacgcacatggccggagttaacagacaaaccagcccaaattcatggttggatcacccccaattgcgcaatttgataatgaactgacataaacaaatcgagggcataattttttttaaaaaaataaagggagctgatggagcaaaccccagtggcgcgagaggtaacaatactggagtagtagtggtactaatcagtttgacactgatgcatgaatggatggctcctgattaattaaattaaacaatttattaataggatggtagaattagagctagaaatttaagtaagttattcagaggagaattattatagccgcgagatgagatgagatgagctagcatgtggcttgcaagctcgatcaccctggcgtcgtgttggttggttgcccggtcgctggtttctgctagctgcttcacctgctatctctccgcgtgtgcatggatgcatgtattctacgagtactagcttagttatgtatttttttaataatagaatataatatcggtttttgctcaaagagttacagccagttctccataggttcctaaatacaaacatttatagattatttagcaaagattaaaaagacaagatctccctttagccatctctcattagttaaaatttgaattttgaattggttagatttgtcttgtaagcatctgattaacttcagatgcttggttttttgtgtgttgaaatcagttccttagaaatgtttatgttgtgtattacaaaatttaatttatagaaatgcttatatttttgtaacgctggaagtattagctagctgatgcgttcttggatcaccaccgtgtccatattgctgtgcctggtcagcgcatgcacgtacaacattgatcatacagtccaaattcagattaaggtgttaatcatgtcatgtgcttgccctctattatgcactaccaacacacagtcctcgtcgtagcggtagtgccactactacaactaccagttgtacattctagtatagtatagtactatacctcattctagtatagtatagtagtgtatgctaattgttgctttgaccggagctggattggagattcgtcgcctttactaactgacgcatgggtaaaaaatgcagaggtaaataaaacaggggttttactagcttgactctgtaattatcttggagagttgagaaaaggactggttcctctgcattgccttcccagttgtactctgtcaaaatgttgttatttttcttcatcaacttgtctcgtgccaaatgttgaagtggtaatacgcgcgccgtagcttcctagctagtgaggtaaccaactctgcgtgaattcctgatctgttctaaaataaaagaaatctggtttaaaaaataaataaaataaatcgtgatcgatgcaggcacgtcatgtggatcgtgctttgtcaaacctaactgcatagtattttagaagtagtatatgcttcattcgttttttgtacgatttaatttgactgaacaaactaaaatatatcgagatgggccgttaatgcaaggagaaaagaaaatccctgtgtcctaaaataagttttatacgtgaccgttcttcttatttaaatttttttatgattaataattttattgttattaaacgacaaaacataaataatactttatacgtgactatttttttttataaattttttaaataaaacatacggtcaaatgttagacacagaaatccacggctacactaattttgtaacggatgcagtacaaagagagttaatatgttggatcaaatccggccgttgattttgtgggtgatggatggagcaggcaaggcagctgacccgggaactgtttcccaaaccggatgcgacgaccaatgcccttgcccttgtaggacagagagaatgaaatggaagatgtggctggtctacttctctactacagatgtatttattactaacaagcatagtggcccgcgcagattgcgcggctagcatcattatattttctctcatataatagcatatatgttttctcattatattattcaaatatattaaaatgacaacataattttaaatttacaataactttacaaaactactaatgtgtaatatttatattatattttatatacgtgttagttattaattattttta

SEQ ID NO: 4210 - DNA, 26718 bp, Oryza sativa
aatatttcttatttttaattccgaatttcagggattttctaattggatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagataatactttaccactatttaccgataaatattagcacacttacttaaagttgaaacgattaaattttttcacaccttaacaagcataaggaaatcttaccatatttataagtcaatggcgtgcgagatttagtttgctggaaaaaaaatattgccatgactgtatctataaacaaacaactgctaatgtgatcaaacccgtctaaccttagacgtgacaaaactgtggtaaaacgtggctgacaacctaagggcatccacaatgtagtctaaaactagtccataagcaataaaatatttcattcagctacctcaccatattgtggaactagtccatagcaagaaaatagcaaaagctacctataagctataagcatatgtgttgctcatatagaataaaatatgttatttgtctctattttctctctcctcctaatactagttgctatctatatacattgataataatagttatagtctatatatgtgggtcccatttatatggactacttttgctatatgcattgttgttgccgtaagcacaacctactgctgtattgttgcgtaacgcgtacagcaaagcgcaagtggagaccatgcatcgatgcagagatgcatgcagctagcccatgtcgagaaacaggataaagaaaaggggaattgcgagatggcaaacgcccaaaacgggcagcttgttgcctggagaggaagagtgctggagagtagtagagcattgagcattgcagaacgtgggtgcaagtacaagcccactttacttttaagtttttttttttttaccaacgctgcatgttacccctcatggatggatgataatgccctttctggtttcatcagtacaatgtacagtacagtactagctctagtttgggatgatcacctactttatttgttcagcacccgtagtagttgtataatctatgctactagttgtatccaatgcccatccattcaagtgatggcatccaaataatacaatagcgagaacctatcatccaacaaataagcgaaacgacatatttaccaacgacaaataatttataaataaaacttttatatacgtgttcctaacgatataaaagcaaaggctaaaaaataaagttcgagatataaaagcaaaggctaaaaaaataaactttgattaaaaaactcaaattcaactccaaatttaatattgagaattcaaagctgataaatataagtataagtgtgaggccgtagtataatctaatctaatctaatcaacctgtttgttctctcactgcagttgggtcccacaacacagcaagggcgagtgagtgagcgagtggtgcggcggcacgcagcgacgacgaaccaggaaacgaagcaacgcaacggtggacagctcacgcgcggtggggggcagcgtggtcggcggcacgtgacaccccccgcccgcggcttggcttgtcgtgaacccagccagccatgtgagtagtgatcaccgggggctctacgccgtcgattccgaatccgatgggcgtgatcagacggcagagagaggggaggaggggggcaattcagcgcggggatcacgcatgcgttcacgcgtcggtgtctgtttggattctgaacaagaagaacaacagtgggtcgattttcagtgacgcgctgctgggttgtgaagtcgacaaatgaggttcctcctctctatcgtactccagccgttccataaaaaaatctagaattagatgtttgattcataatattaatatgtgttacattcggcgatagtacatctattatctcgatgctgctagctacgagtactagtttcatactgaaattttctctttaaaaattgttccattctaaaccaacctctttacactgtaataataattagtttatttatttttactctgaagtaggttataaaaagaaatagattattcattaatttataaatttcagctgtggggtctttaataattaatattgatagcgagtcggttaacaaattcagcatggttaacaaatttcatcttcagaacatactgtttatttgccaaatcagctctggatgttggtatagcaatctgacgataaacccaccttttttctgaaccatgatgaaccgatccaaccagctgacctgacatcagtttcatagtgaggtcctacaacatcccggtctgttcatcaatgagcagttcccaatttgacagcatgtagccaagctactgctaccagtactgtcctcttcgtaagtctttccaccatttttaatggctgacgacggtggtaaaatatattttaccactagtacttaagatagtagtgattcattggattccaaaagaaaaataaacggtttgaatcaatttatgttaccaatagagaacattatagttgtcggtaagaaattcccatgcatctaccaacctcatcttttctcttatgcatatacttatcagttaaaatttaaattttcaaccttaaatttatagttgattttaggattttttttattgaagtttatctttcagcctttgcttttagatcgctaagaacacatatataaaagttttattcttaaattatctttgtttgtaaatatgttgtcaaacaatggggccgtatatactccctctgtcccattataagtacagccataagtttccgtgcctaatgttcaaccgtccgtcttatttgaaaattatgaaaaaaatttaaaagttaagtcacgcataaaatactatttatattttaccatctaataacaataaaaatactaatcataaaaatatttcaaataagaagaatgatcaaagttaggtgctaaaaccctgtcacgccccgaactagtcccgaccagcactagcccgtgacgctccaaattaacctgttaatcgataccagtcccaggaaacagtgctgatatcacagggagacagaatatcacagcaacagaggtctctttattatagagtagatgtacagtcatgttgggctgcggacagatcccgagctcacaactgcatcacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaaatgcaagagcaggaaaccgtacacccggtacgttccccgatccgcggttttggaaaattcatttagttcgcaagcaccgacccaggtgtcgggttttccaagtcttttgtaaaactccagttttacccaagttgttaaacagattttaagtttgaaggcgtccgtcgatactcgcacagggtgcacgaatatcgagacgcaactagatggttacaaggggacaagatatagcaattaacaaaggaaggatcaaatgcgacaaattaggtaggtccgccaatctgccttgcagacgggacaaacagattaagtgcgatcctatcaatgcataatattttgcaagggatataattaaatttcaaatataggctcaagatattcaaaggtggcttgccttgctcgagatctggagcttgatcctcaaaatcctcgcactgcgggtcttcgggctccgaaactacacgcaaaacgggacaactcaacaaacggcaaaaataaagccctattaatgacctctaagcgtgcaattagatagatctcgagatttgagaaattttggaagttgaacggagtcaaacggatttacggttgggaagatattgaatttctaagattattggatttttgatctaaaggaaaaaggattaaattaaatcctttttgaaaaagaaaagaaagagggaggagaagtagacttccctcgggcggctagggcgtggcccgagagaagaagcgcggctcggccgagctaatgggccggccggcccaagaggacccggcccagagcgcgcgcgggaggggaggagagagggggccggtggaccgggctcaccacgcgcggtcccgggtgggacccgcttgtcagcggctcggctcaccgtgcggagggagtacgcggctcatgcgcgcgggcgggggagggacgcggtgcacgcgcgcggacgcgagagccgcgccctgcgcccctccgcttctcccccgctcagctccgctccgcctcgctcgcgcgccgcgcgctctagcgcgtaagccgcccgcgccgagccaagtccaaacccacaactgtatttattttgcgacggagggtgtatctccttagaggatcacatccagacttttgctgcgcaatgagcgcagcaacatgagcaagcaaatgtcaactccttttttccacaggtcttcgactagcacaatcgacatgagtacatacattgacacaaagtgaatgacaggtggagctatcatattcttcatacacgctggcgaggggggcccacacgacagtggcagcaaagctagtgcaggagcattggcttgcaaggaaggaaacaaagagaaaaaagacaggggagagagacgcagaagaattccttgaaagcacactatactatcatccaatcgatcgatcgattgatcaggtgatgggctacccatatgcacatcacagttcctgtacacagtacatcccccctttctgtttctctcagcatataattgtttcagtttctatgggccaccaaataataattcctctttgttttatactagctgggaattttcaggccactgatcacagtgttcagtacaccaccctgatcaacagtttaggaacaaaacatactcattagagtaatttgaaacacaagaacgccaaaaaatgattgtttatgaaaaccgattaattaattgaaaccctgattacttatgtgtatacttatttcatcagcagacagaatgttgacctatgaactgcaatgtgcgatctatctatgtgacaattagcaataataataataataataataataataataataataataataataataataataataataataataataataataataataataataataataataataataataataataataataataataataataataataataataataataataataataataacaataatcacagttcagtacacaatcctgatcaaatggtttagaaacagaacatactaattaacttgaaacataagaatgccaaaattgattgttatgacaagtgattaattgaagccctgatgattactcaagtgtacattttcttacatcagcggacacaacagttgacctatgaactgcaatgtgcaatctatctaagtgacaactatgaataataataataataaaaccaatggtgcaatgtgtttggagagggaggcatatggagcttagatatagccatcagtgcatcgctttcatgacggtggaatattggtataggttaggtgcagagacttggacgctaacacggtggaattgataaaaattttcaagctaatcatatagttttacaactggtcgaactatattaggtacagcttttggatggtagtagcatatacatagcttcctctatttcgacggctaagctgaaccaacttagtacggcacatgctacactcttttgcgtactaaggttggatagggtgagactatcaagaataaaaagactccttttgaatccttgaattttacagaaatttcaaatggattagttcaattccaaaaaaaaaaaaaattctataaattcctccattcaaggaatgcaaaagttagatgaattctgccaataaattttttaattaatatactagaagagcatatttttcactttgtttttaattttatattataatatactttttatattgtttttgtattggtacaatgtacatgggagaaaagcaagcaagctgcttagtttaattaggagtacacagtactatgctcttttgtgacctgtgagctgtcttgtaatactgacctggcgtcgcctcatgaatccgacgtgccactggccagcatctctgcggccagctggcacaagctgacaagctgtagccatcgccacgtaggatgggtaccacgacaaaaaatgacttgcattgctttttgcaagtgtttgtttagtcgccactactgtcgttgcaacttcttaatcacccctactttgtgtaccaatgtatgtatatatgcatacacgccccaagatggagtacattaattactagtttcatgtcacaatccaaagtaattatattttgggtacatacagagaaattaattgatttggaagctaacctctacttacatgttttgatggatacgtgtgtaatgtaaggcccttttaattcttttttttttgaaggtagtactatagtgttttgccgtgctggtaatcttgcttctaagatacgtcgttgcatcattattatggcaaatatataatagtaattctactgttttagcagctgcataattaggtgatgggatttgtcaattggatgctggaattgcatgctcaaccatcaaacaaatggtttagtttaaaaaacgtaaagtaaaagggaaatgaaaagatgggaaaaaataaaggaaattaaacatgggatcacgttggttgcatgtgcgccaaagactaagctccgtattctagaccaagtgatgactaactaatttttatagtttatgagcgtgcaaagatgtggagaatctgaattattctttttaattttttttgcaagtggggaatctctagtctttatgtccattttatcactttggaaaatggaaagaaaaataagacaacatcggtcataccgtactacttttgttctcctaaaaaagaaaggaaaacttcaaagtatgtatcactgcacatatgatcgaaaaaagaccaatttataaaagaagaaaaaaaaaacagaaacaatcactggtattggaccaaatagcacataaaattcagttaggggagcccactaaggagcatttgcaacaaacttttcatagaagaatatatgtaaacaatatagtatatactaatatgtagctctcccatattattgttgggatttctctctacagtttgcattgttagttagggagtgaacatcttcctctttttagctagtccaaataccttccttgcattggtattttccctttttactcgtccaaagcaacaatttccaatgggttattcatatcataagattaacttgattgcatataaatttcttcacggcaacgtaaatttatgaacatgattcaattaatttctatcagagtgtagtattttcaacatgatataaattaatttactaggtttttataattctgcatttttttgttgaaaattatggaggccatatgggaaagggtgacgatggagttgtcggtgatatggggtatggcagacagggaggagtatatactactgctacacaaagtcacaaaactacaccgaataaatcaaattatttcttcagtagcagcagcagcaaacagctcatcaggtgttggtgatacctatgttccgggcaccgatgcggccgtcggccaccgacacggcgactccaccggctgcagccggtgtccggcaccggcgatcgccggtgagcccagccatcttctttcttctacactgacagactagactaggattcgtctttgcctcgggattcccaccaaagcagagatgtcaaaatggtcccggtcaaactgccctacccaaccacattattgaaaattgctaatttaatcgttaacaaatcgtaaaataaataccaaaaccaagtggatcccagtaaacaatgctttgaacatgcaaattaacaactcctatgtgtctacatctcatgctaatgtgcaataacatgagaagctgctcctaagattgaacagattttgacaaaggtgagatctttcgaattttgaaacatttttcacgggcaaaacacagatcaaccaatcagaacgtcagtattagaggctattcactacttggaagctgttaacagtttttcacacttgacacggtatcagcagtcaaaaaattttcaatgagccactgtccatgtgcaagtattcctttttcttgttacaaaaataattatgaccgatctgaatcttaatggtgcaatgtgtgtggtttgtgcagggcataattctgggtcctaaagggagataaatgatgttaaaattcgttgagtcacatgcattatgaacagatctatccatgcatctgccttattggtgtggtgtggaggatgatgagggctctacatgcatatgcatatgcatcccatgtgacatgttcttcagcttccatccaatccaactatctcccagtcctcctcaccccacaccatccactcaacaacagcaaaaatcttttttcaatttcctcaatgagatcagcacagcaggctcaaccaaagaaacaattatcagcaatgatccaacaaccatacagttcagaaaagggggtaaccaggttggtgccaaacatcataaaggccacagcccacactaccaccccctcttgttaacacacaaacagtctcagggtgccattgtttagtatacaagcattgttgttgtagatgtatcagcaattaatgaaggtgttgataaggaaacataagagcataaatgcatgctgaaatttcaacctccaaattaagctagaagagttcatcaggaaaatgacagtaaatacatttaccactttacagtgcagatccatgatacagaccagtggaaatatgaaccggcacaatgaaaccacagcacttccttctgaatatctgatatcttcaggtacactagtcataagattgttacagaacataactgaatatgctccaccaagggggaaaagggggatatcatcatatattgagaacaacaataaataatgttggaagctgtatggtttgtttccttcttcaggctacttctcaggagctctgagtgaaggaatgatgtcatggttactacttcaaaacaatacatagcaattatatgccatacaatgtactgtccagtctccactatacagctactatacatgtgaagtgaatgagctcgcacatcactgtagtatctacatgtttcaattgctctactctgatcgtatacacttcaaatcttgggtaatagcttcaagtgtgaagctgtgtctcagtttctctgttctgatcatatacactacatcttgggtactagcttcatcataaagttgtatcgcactccttttgctatcttaggttctggccacttagcatcttctggtacatggatgcatttgtatcctagatttttgtacagacgcagcgcagcaatgttgtttacatcacaatgtaatgccatggatcggcaaccccaactctttgctcgctcctctgcttctgcaacaagcattttagcgattcctttacgacgttcttcctttcggactgcaacatttgctatatatgcaatacctgttctgcatgtttcaaacaaatctggatgatgtcaggcggcaaagtactagctcgtgtgttatattaaccctccaaaaatataataatggacaatcttctacagtttatacagagtgaggcaaatgaaaacaaggcttcacatatctgagcatttcatcagtgcaaaagaatagcacaaccaatgtttttgttgactttgtatccaaccaaaaacaacttattccatacatgccacagtgctgcagcttcatttagaccgcataaggtgttagaagaggttgtggcagtgttgagatggatgtcataagaggtgccatgctctataatgcagtgcaataaatattagaaaactgccacaagaaacgaactcagagaatatccttttatgttatcttgtatatgacatttcacatctggtgagattaaaggccacacagggcagcctttttggcagtgttttcatgatgatctgttggctaatttggaaggaaagaaacgcaagagtattcgaacaaagagacaaaaaccctgctcagttggttgaggatatcaaagaggaaataatcatctggaagtctgcaggtctcttttcacattgtgagaagtagaactgtttttcagccttagggctttttattttccctttctcgtggggtaaggttttgcctcacaacacgttcgacaacttcttgtcgatgtacccttgtatgtttgtaatttgttttcttccaatcttaatgaaatttggtcagccattccttcggccaacccggcgaaaaaaaaaagaaggctgtggcacaaatacaatgcgcgttctatcctaattcaacaagacggtttaatccctaactatgatagacttcgttgattgaactggatgttcattttaacccaggcaagttgcactgcatttaaatgtatttctccaaaaaatataataaaacacatgtttttcctctatgtttccaatcaagttgaaattcaaatttgctcactgtttacaaatattttcttgaaatagtcaacaatgaacaagaaattcatgatatttattgcattttcttcaaaattctgtaggtaggctgagccctcttgtttcacacagttctttcatcttgtacaagtaaagctaggtgagagtcacccaaggaaaggaaagagacatctccaaataaattccaaggcaacaaatggtgccctaggtggacagtcaatacaggaaaagagagtgcgcatgaagttgtgtttgtctagctgtagataactgtatctccctttggatcttagtcaaagaacaaaaaggaaggacagcaaacagaaaagtgtatgggggcacatacaagttataaccataaacgggagctgaagcaactcatgtcgaagcatcaggacaatatatagcttttttctttagaaacttacaaggtgagaatgacatggactatggtagttacaaaaaggataaacagtatagagaaaaaacatgtgatggtaaaattcaatgcgatgaggtacagatcatgataaattaaaacctagcattaagttaactatgcattcctggagaaaaaatggagcacaacattttatgtattatgcccaagattgtagttttcttagttttgattgattcaaaccaattgtgcttaagacttatattacatcttggcaccagtgatcaaaagactgaggatggtgaaaaccaaaaagatgatactgctatgtgcaaagcttgggagaaaattaagatgccacggataggaaatttgttgcaacaaaaaggttttatatgacgattgagttgccgggtcctatgcagatttactatgcatgctgctagtggagtttcactctttttaatttaatagttctttctgtatttcagaaattccaacgaaatataagtgcaacaaggcttaggtggctgttaacaaccaaatttggtaacatcggtgtcaggaaagaagattggatcaaagcgaagtcggaagcggagatcgagttcggaaacagagcaggaatcggccggagtccagatcggctacggttaggatcggctaggtctgagtcgggctaagtaagccggtacagccgattccgacaatatgacttgtacacgacatcgggttcaagttaatgtagttcaagatgattgccacgcacggatagagtcctgggaaggcaattgtatctattaattaggatatcttatgtaaattccttatagataaatataggcaaaagtctgccgcaaagacttatggtatcttaagagtttgttagagataatagtcatgtccggtatgggcatatcttgtaattctcgggcataaatagaccccgagccctatgtaatttaacaacacacgttcaatacaatctcggcgtatcgctaccctttttgctttagttttgtttcgacgagttcttgctttcgggttgagctgcatcgatttcgatcttcaacaagaggtaaaattcgttatgacggattgcgttcttaggattagtgcttccatctttatgatactctaatcccgtttatgtaattcgtcgagttatcatatgtcttacataatctctagcaatatcatcatctaacctgccatcggttaacttctgttaatagagggtagccgattaggttaaatattgatgttgatctagattatatgagatatctaccattctatgaaacttctagcggcttgattgtctagatatcgttattcttttcatacttaatgctgcatcagttgagtttgatctattaagtcgtgcttagaatatcgatctctagcctgccttctagttgccgattagaatagcatcggagtttcagctgatcgtatctgatttaactatatttattctatatgcctcattgatatgttaaatctgccctttatatcaagatattgctgtatctaaatatgttaggcctttgtttgatacattattcttgctttaatatcctggtatggagtagtatcggagtattagccgatacatgctagatttatctgatcggctatgctataaacatatatagtcctgttattgatatatatttcgatctaagtgatttatactgtctcggcatgatgaccgatctatcccaatcacttgatttaagtatacatcgatataaggagtatatatcattaatatctacagccgatcgagtagatttagttcttttttacttattcatgaccgccgatcgatacacagatgacatcggctcaaagataaatgatatgtcatcggcatctagccgattggctatcatttatagatttaaccacggcttctttgcttctatttcttgttgattacaggatcaaatcaactggcacgctaacacatccgaaggcgagctttggacctgcactggagttaagcagacctcccaggccacatgttttctatcaacagtggcatagttcagaaattctattcccgactccaatggtaaagagaaacgctttcctttagtaattattatcatgcaagaaacacttgtctgttatgagagaagggaaccattactttgtatacttaaatactctctccccattttatgggaaggaatcatatcataatttatcactgttctagacacaagtagtttaagacaaaacatatttggcatttgagttttgcatgcacctcatatttagcaaaatgtatatgaattgaaaaatgggaactcaggtgttcccccatttatgcaattagtataaaataatatgttattgtttttatggcattgcatagtcaagtgtagtcttcaaggctccaattgcacaataaatttaagttattaactagcatgtttttttaatatgacctgtgttaatctgttattgactagcacatatccttcagagatggaaaggcattacaacaaattatcaattttttgtagcttggtatgaactgttagaaattcccaagccaataaagtaagcttcaaatgtaatgggacgaataattacttggctgagggataccaaaaaaaaaaggaacatcaatgtcaggacaaaaaggaaacaacaccataagtagaatggatatggtaaacaggctttggaaaagtgagtgaatgcatttaaggtgcaaagaataagcaaaccatttatatcttgcagttgcatatgtgtatatgtgttagcaatcttataaggtgtttgaagaaaataaaggtataccttctctgcttgagaggccctcttctgggaagatagtctgccaccgtgtctactgtaagaatgccagctatggaggccttactgagaccgtgtttttcttggaagtcagcatctcttaaatctccacattcaatgctgatacttctactaagcgaattactgttaacggcgacaaggcaagttctcatgcagccaggtggaaccgaaaaaccggataggagggcaatgtaacgatcaatacgtagaacaaggtccagtggaaaagtgtaatctggaaagaacgagctgcaatgagtatcagctacttcccagcaatcctctagccgcgcatctcgaaccaggatgtctgggctcaaagatggcaacaattcaaccgccgggctggcacagcaaactcctgaaaacaaagtagacattctcatgggcacatgccaaccatgtgaaataaacccagataaatttacagttagctcatacaagaccaacatataaaacactgaatgtttagtgtagtaagttcaaattatcgcgatatattcattttgaggtagcatggtaccctttctaatgacaacactctaagccaaatgccccagttggagcaaggtattcaccaaatactaattcagtcgatttgctaaacgacactcccatcctttggggagaaccaaaccgattgcgtgctgtcaaattaatcttccccggataatccaatactacccaattgtaaagaggattacgattataacctcaattacttatcaatgccaagaaaattggagcggtagataagacctgcagcgggtttggtggcgaaggacgggcagcggtggtgccggacggcgactgcggcggatcggcggacggggtagagaggagaagcggaggcggacgacgtcggagagcgagccaagcttatcgccggcggcatcatggcctccctccccccgcctcggctcctccgctccttcgctgtctctctcctccgatttttaatctactactgtttgcccccacactttccgccttccaaactcgtttacgtaaaataaaattacgccttattagggtgtagcccacggcccacctttccgtcttcgaaaagagtttacgtaaaattaaagtgcgccttgtgaactgtgcagcaactaacaaggcagtggattccggaggcgagcgagagagggagagaggaggggtgggagcggcggcggcgcggcggcggaggtggatggcgatagcggccggcggtgggctcaaccggtcgtcgtcgagggggcagctgccgccgcaggagcttctcgacgatctctgcaggtagcccccatcccaaaccctcgatcccatccatctcgcgagtttcttctcggcttttgctcagatcaaacccccggaaaaaaactgaatcgaatcgccggtggaaacggaaaaatcgcagccgcttcgtgctcaacgtgcccaaggaggatttggagtcgttcgagcggatcctgttcttgctggagcaggcgcactggttctacgaggacaactccgtcgagcacaacccctccctcaagtcgctctccttcaaggacttcactacgctcagtaagctccggccgaactccaccttggattcatcggtggcgcttccgccgttggtttgatcgctgacaccgttattgttgttgtggtggtgtatgtgtgcagtgttcaatagctgtgctgcgctcaggccataccgcgcgcaccttgatgacatttacaaggatttcactcactataagttccgtgtccctgtctgcggcgccatcatcctcgatgacacctacgagaaggtaactacacccctaccccgatcaccttgtaccatattactttctacctagattaagtttagctgagtagctgcttatgttgcacaatgtgtgggtgtggcagcttggaaacaatgctaaagtaattctggtattttgtctgttgctgcaaataccttgtagatggtttattgtatagtcgcttcaatgcgtatagtttcaagctctatactgcaatgcactaggcacaaataaaaattacatctttggatctttaacccttgtagacctcaattcgcgcattctttttcactttgtcatcacatactcacaccccaagtttcattcactttttctccttctgtgcagtgcttgcttgtgaagggatggaagtctagcgccagctggagttttcctcgtggaaagaggagtaaagatgaagaagatcatacatgtgctgttagagaagtaaacttctgggctgaatcgatgttgttctttgcagttttatcaattaaattagacttataaaggatagaaatttgtataagtcactgaacaatagttttacatttctctagatcatcaagatgcttttttctacaattcaaatatcaaagttctagatattctaccatgctccaacacttactgttttcatttagtgtttgcattttaatccattgcatacaccatttgttgtttcttctctaaaaatgaattgcattgcctatctcatgtttaaaaaggaacaaaaaaagcttagcattggttagctaaatattgtcagctggtcctgtgcataattttttttaaagacatgcagtgatcacgtcttagctttcgtgaactagtttccatgttttgcacttccctttgcttattgcattactagtctatgtaagtgacatttatttacataacaatgcaggttctagaggaaactgggtgtgatgtttcgaagcttttaaaattggaagattatattgaagtttcaatgtggcagcaaagagtccgcctttatattataactggtgttaagggggatactgtttttgcgcctcaaactaagaaggagatcagtgtacgcaaatgttcagtgtttttatcatatttctttttgctcaactacattcagaatattttggactcgctatctgaaaacgaaaaggggaattgcgtgacatgattgcaaaatgatacaatatgactttgattgtttgattaatggccataatccttcgtgtgtgcttagcttatagtaaggaatagctcctttccgattaacaagctgttctacagatttttttttccataatgatctgctaaatttcaactcagttgagaagagactcaatttgaagcattctgtaatcactttatttgtacttaactgacaagttagtacatgttcagccacatatttttgcttgctgactgaggtactttatctttttatgctggtgtatgaatcacttgcaatgctagctgtcttgtgtggttgtgtttactaccttgtgtctacttgaagactgtagttactgtaactacaatttattgtttttttcgttgtagtttatccattgacccttttgagttttgaacctctctttggttaaagagagttaaataggcattactgagtcgtgatcctctgaaattgacaggagatctcatggcacaacatcgatgaactccttcctgctggtgatgacgcaatatctcgtggagtgaatgggatgaagctctatatggtcgcaccatttttgcagtcagtacctttttgacccactttagtttttttttcttggtgcagacagtcatcatgagcatgttggtttaatggcttctaaaatatttaacccgcatccacatttcctgagtgtgaatttgtttctacattgtttaattcctttacattttacttcttcatccaggggtctaaaagcctggatagccacacatcgtcacccacagtatcagaaatcagacacgtctgctagaggtttcttctgatcctccctttgcccatttatgttaggacctaaaaatgttaaattatttgtcaattatttttagcagttctgcttcaagtttcgcttgttgttttctaagttaatctgcagaagtagttctcaactgagcaaaatatcagctagtacataattaaagcaggtctgatcctggcatagtcatgaactcatggctatacttatgatcaacttttagtacatagtgtgtgtagtaccattggtgaacctggtgcaatgtactcctagtatgtaatttgtgataaaattggtgaacctctggtgctacatataccgtttgcctctataattgtgataacatctatggtaccacacatcatttgacaggtactgtgtggaaagcgaagaattcctcaactggagcggcgcctgttgagaaccccgttattactagaacaggatctgacccacaaactcttgacagccgcccaggtaaaagcttccgaaacttcaggttcgacacagcgagtatcctgcagtccatggaagcttccttcctacgtacctaggagcctgacaaagcatcaccccatgtgtgtatgcttgatgtgtatagactatgtaagccaagggcgtgtcttctgttgttaactcagctttttcttcacttttctagttgtatctgtaatcctgaatgcaacagatgcttctaccattgtgataatatccctacatttcgtgcacatgaatgttttttcttctgtccattcagatttgtgtttgaaatgttgctcaaaatggagtaagaattcctctgcattttgcatgatcttgttccgttattcttacattgtggttgagaactgagaactgataagcatccttccttagacaatgtagcgggctgtgcatggcccgaatgtgtagaattatgatgggcctagccttttgagtacggagtttgggccgatccaaccatttgtagtgatgggccgtgggccttggcgacaagcgaagctgaatgggctttgttcttttgctatctgtggagacgagtgatgcgccgatgacgtgtgcggagcgtgtggccaggcatcttctccttcacgctttcgctgtaccaccaccaccgctgctagtgctcgcgcgctctcctgctgctgctagaagcttctggaatctggagccgagccgatgccatggcggcgctcgtgcggcccgccgtgctgcccgtctgcgccatgacgggcggcggcggtaacgacaagcggtcgccgccgcagcagcggtcgtggtggggcgggaacaagcagagattgccgcaccagccgcggcggcagccgggcgggaatggtggccgaggaggaggaggaggggcgctggaccaggtgctcggagtgctccgccgcgacggcgagttcctccaggcggcagccggcgcccccctccgcgacatcttctggctccgcttcctcgagaagaagaagcagcagcggcggcggaagcaaccaaaacctaaacccaaacctccggagcagcagcagcagcaagaggaagcggcggcggctatccaagccccatccttcccacctccctcctaccagccaggtttgtcgccgcgcggcagagaagcatctcgattgggctccgttgcgcacgcattgttcctgttgctgatggggattctcccaattggtaggattatcatgcctggatcttatgactgctgatttcgaagccctgaagctgtatatcggctactcgaagcatgcaatcgagcagcaatttctcaaaggcaagcggcaacctcagcatcagcaaactcctaaaccaaaactccagcaacagcagcagcagcagaagaagaagcagcagcaacaagagcagcagaatcagacacttcaacctccggccttccctcccccatcgtaccctccaggttgcttacaccaagcagtgcccaattagctgttgcttaatcatttaagtttcatcgattgcattattaacttgttttatgatttttgctagggctgtcttgtatggagctgatgatggctgatatcgaagctctcaagttgtacatcaactactatgtagccattctcaccactcctctaccccagcattacgatccggagatactgtcccgttacttcacctcgcgtcctcatattctcgcatttcgcaccattcaggtaaaagctgtaattactgttcatctttgctcttactaagcttcaactgataaatctaatagttcagtgtgccatgcttctgtatctgtagataatcttcgcatttgtctcggctgcagtaaagatgcaaatttctaaaagaacaaacttgatcacagatgccacctacagctgtaatagcaccggaagcaaaggtttcaatgcttcacaatacatggttggccagcttctcaaagagacatttctagatcttgggcctacttttgttaaaggtcaggttttcaggttcgatagctttaagccatggtagtggccactcggttcggattaatgttgacttgcttgtcttctgtgtgcagttggacagtccctctcaacaaggcctgatatcacaggctcggagatttctgaggttaggtaaaattactgcaggatacaataacatttctgcatttctttaattgcttcatcatcttcagaagtgttttgttgatcattaaacaatctccatagtctttctcaaaattaactggcgcacaccccaatcataggcactcgccgagttacatgaaaaggttcctcccttcccgagaaaagatgcaatgaagattattgagggagaatttgagctccctgtatcacacattttcagttacatttctgatgagcctgttgctgcagcttcctttggacaggtaatcatatcttgcaaaacttttcccgttcttttttaaatattagagacaggagctttgtagtttctgattaagccttattatatttttctgtactatctctttcaatttttctgttatgctcagtgtactcttgtttgttgtactttaggtttatcagggacgtacagttgatggtgctcttgtggccataaaggttcaacggcctaaccttcttccttcagtattgagggacatttatattctacggcttggggtacgtatgcaactatatctccattaaatatataagctcatctgtttttgagtgtttttaattctgccaagtgctaatgcccacatcttgttcatagaagatatatacaccataggttcttcgcctactgtttgacaaaaaagaaagttcatcttctgatcctcagcatgagcataatacctgatgccttctattttgttgtccctaaacaagctttaccgtttccctgattttgtgtttaattaagagtgttaatgtgactatgataacctgtgctgacacaagaaacattgtacagtactttctttcaatacagatggaccttgtctcatttaagtttatctgtatttagattaaatgttcttgcacttcattttatttctttattttgcttacaaaattatagcattgcagcatttttccactatagtcctagcaacttgatgtcttttctaccatatatgtttcagctttcttttgtgaggaaggtagcaaagaggaaaagcaacattgccctctatgctgatgagttgggtaaaggtttggttggcgagttggactacaatattgaagctgctaatgctaccaaattcctggtgctttggtcttgtctcctacctatactttactaacatatgcctattcctgttttggcgttttatctcataatttgtacttctgtaggaatatcattccagatattcatttatgctggttccaaaggttctcaagcaacttacgaggagaagagttttgacaatggagtgggtatctggtgaaaatcccacagatttgctttccttatctaaaggaatttcatcagaaattgctgaatcgtcagagaagcagaagatcgaagcaacagcccgtcttcttgacctggtatttatgttcgtcacaagttatttctaaattatctgcttcatttgtaaaaagatgagcaccataaataaattaatccacaacaatcagtgctcccgggtagcaaatatttggaattgaagtcgtgctcagtgaatagggcttttttgtcagttagaaactgcagtttacatggttctttgcaatattgtgtttgtttcagaaacacgcagcttaattttataaatatctatcacttcaatattgatgttcttttctctctgctgtggtagaaatataaacattataacaacaattactacatttcaataaacatttttcccctctggacaaaatgttttaacatcttgttaattactatgatgataaggtcaacaaaggtgtcgaagcatcattagtgcagctcctcgagactggtttgttgcatgctgatcctcatcctgggaatttgcgttatacacctgaaggtcgtgtcgggttagtgttaatttatctttttatgtacgctctataagaaaatgtcttcttactataatcagcagaatcatgttatacagtgggtctgatgtttttgtaatggttttcctctgtcattctccctttgagcaatagtaacaccttcctaattatgttaggtttcttgattttggtttgctttgtatgatggagaagaaacatcagcatgctatgcttgcaagtatcgttcacatagtaaatggagattgggcttctcttgtttatgatttgactgcaatggatgttgttccaccaagaactaatctacgccgagtgacaatggtaattcatcaaaatgcagaatatttatttatttatggttattacaagatggaaaaaaacaaaggttcttatctcatactccctccgtcccaaaatataagggattttggatggatgggacacatcctagttttacaaatctggaaagggagcttgtagtgtaatttagtttgttattccattattatttttaatgtttgttgattggtaggacttggaggatgcgttgggtgaggtgacctttgaagatggaattccagatatcaagtttagcagggtgtgtagctttccctctttaagttcagttataaactgcggcatgtctctctctttatcggcatcttcctgaactgttaaaaacatcctttaggtgcttggaaaaatatggtctgtggcatttaaataccacttccgtatgccgccgtactacacgctcgtcctgaggtcacttgcctctttggaaggttagtttgtttagatgaaattcagtactgaactagctcaattataagtatgtgttgcttttttgtttctgacttgtacatatttgagcatgtgtttttttttggaggcttaccagcgtccccttttgtgtaatctgtagggctggccattgcagcagatggaacttttaaaacatttcaagcagcatatccatatgttgtgcggaagcttctatcggataattcagttgcaacaaggagactcttgcatcaggtattattattttacctcatttgtttacctgtatagtatatatgttaagttgatttaattaattgattcacttttcttatattttgtgcaacctggacaatatgtgctctttgaaacagtcaactcacccattttcgtttgtacgagatgtacagaaatcctgcaataaaatttgaaattctgagttttgttagttcacgatatcaaacgtcaaacacccaagggaaatggcatcgatgataatagagttctgacaccaattattaatacacaggctattttcaacaaaaggaaagagtttcagtggaacaagattacagtatttctaaaattagcatcagcaaggtcagttctctagttctgagcagaattgtgtgtaaacatcatgtttttttcactaaactgtatgaacagaatttcttctactatgatgcttacttgcttagttttcacgagatgcatctgatgatgttttcgtatgtgaaggggtaacttcaggtataatactggcgttttgcctgagaggaagggtttggatgttgcaaaacttgtagagatcagtgatgcatcttcttcactccatcttaaccgtgctacaccagaaagagcactacatactgcaaatctgtgcttgcggcttttactatcgaaggagagcattgtgataaggagacttgtaatgacagcggtatgtacttttccttgtttcccctctttacctgaatcgactggcccttttggctggatttctgaacgcataaaacacactaaactagaaatcaactgagctcaccatacttcctgttgcacagaacgcgaagtcacttgctcgtgacctgatctccaaagatgcatcgatttaccgggtgctcttaagtcgggtacttgccgatgtcatcttccagtggatggtgaaggcaactggttttaaacgagccggacagctcgagcctcacccacgcgtgacagcaggaaagaacgatgaagacctggggctgtccaaagaagcaccagccttggtgacattccagacagcagtaagagatcgcaggctgaaggtgatattctccaagttcgtcagggacataagagaggaccccatcctgatggtcagagtgagctggaacatgtttgctatctcggtggtctccgctgcaattggcgttcaccgtttcatcgtcgtcttgtcggaggaatttctgtctacattaccaccgcctgtgcctccgccgcggctagttcagattcagagcatatgaagagcagcaactatgccttggtgcatgaagtaacttttttactgggtatcccgtagctgtatataaacgttttcaggagcagaatcagccatcctgtagctgacagtagctcgatcagagttctccatggctagttctccgtaaatttgtcttctactattacaggcttcctttgaaaagggaattttgtgggaattaaactgatttttgtgaaagtactgtaaaattcttgtcatcgtgtcgcaaaggagcgaaaaagcttactaactcgtaacgactgaaggctgagatcgtgtacaggctaaacatttgcacacaaagcgaaaagtctaattaacacatgattagttaagtattaaataatataaatttaaaacccatatatttatttgtttttaaaaaaaacttgtatgtggaattttttttaaaacgcgcgcgcgcacacagtttataatagttcggtagagaaagtaaccgtagaaactgggccttagccaattgggccgataaatgggccgtgcgagcgtcgtgtaccggtcgacgagacagaagcagctgatgcgccttgtgacctgacctgacagagagagcaggtggagctgtgtgtgtgtgtccgtgtgatccagagcgggagggaggaggaagcggagggggatggtggggggaagagga

SEQ ID NO: 4211 - DNA, 5572 bp, Oryza sativa
aagtttctgaaggcttttgtcttctatttttgtttcctgtcaagtgtcaatatgtctctgccctttttgactgaaatgtgttcttgccaaaatactcctggctggcataggttaagctgttacccggtcctcattctccttccacattggtagcttgacagccccatcttttcgcttatgcttatgcttacgacttttttttacttaaaatctatacagcttattagtaacccaaaaaataatttatggataaaacttttatatacgtgtctttagttgttattttgtaaataaactatgatagaaaacccacaaaattgagttttaaaattcaaaatgttattagcataaacataagcaaaacggttgggctgtgaaatatcaacccatgcctgtccaatttgttcgaggctgactgatagtttcaattgcacttttttttctgcatcaatcttttgcaggaggcaatttgagcgtgccaacctagaagcaatggatgaatctgctgaatggagaatgaaatatgacacagagtttgcgaaaaacaaacagatgcaagatgaacttttaaaggtctggtctatttatattatgtacttgtacacagctttcctcagtttccttctgcagtgctcatttgagaatcttgtttacaggctaaggcctcactctctgcttcaactaagagatttagcctattgaaaaaggtaaccttttgggggcaaactttgatgcttctcgttgtaacaccctaacataatattagctctatgcttcctcagtaatattgagcgctttctcctggtttctccatatatttcactctcttaggtgttaccatgcttatgctcattttttttcaactcttttgagatgctcgttttcacaactgcaggataatgaggtgttgaagaggcagattcagatcatgaaacagcaatgcaattgcactgttacatcgaaccttacacaagaataatgacattactacatacttcttttgtagtttagcattcatcttccttaaaatttgacatatgaactagcgggaggcctagtagagtggtgaagtatgaagtaggagaaatagctactgtagcaagaatattactttgcttgcaattgttagtgagttttacacatgccattttgaagtggttgctcctgactagcaaactaccagtgcaaatagaagatttttggttcatttgagtggtgtattcagttataagttatccttgactggcccttacaaggctgtttggtatttgtaaatatacgttgtcttaatggccatatccagttcctttcttgtttggtccgtgcccacatttggccatgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgcatacatatattcaaatttcttgaagtagcaatatagatccatccaaaaaaaaagtacttgcattatataaacatcatgcatcatcatttggtgctaatcatgccttttaaaaatctactctagtgtcatcatcatgaataacaccaatgccagggactccaaaccaagcaatcgcatttatatccaaatgatccgttggttgagagagcatgagtacataactttcttcatgtattgtgacacataattttctgacatagtacgtccactcttgtcaacatgcaagatcaaaggacaaaccaaatatacagtgtttaaagtggctccgatagtgagagcacaaacaagataccaatacattcatggaatcaatagtatcttgccaatgtgggaactttcttccatcaacttgtgagcttcagcagcttctgacagaggaaacgtcttgtatattactggtttcaccttgccttgcacaacggcaggccatacatttttctccacctcactgacaatcagagctttattatcaaggcttctgttgcgtagtccagcagctgcacagaatcataccatttccacacatgctaaaatcagcgatatcgtttaggtatcatccaatcacataattgtgattctcagtaaggcaacaaccagcagtggtataagatcgtaaataacaaaactagaaacacaaaaatctagtatgagggacattgttgcctatagatcaacgttaccttgtatggtcaatcgtcgagcaagcatgggttgcaggttcacttcagttacagcgcctccttggaaaccaatgatgaaaagtctaccatcaacagctaagctgttcaggttacgctgaagatacaatccaccgatgttgtccagaatgacatcaacacctggtaaatatacttccatgtcaagagtcactaaagcatatgcaaacttggcaggtatcaaacattatagacagttccatggagaaatgccgttataagaaatccatctgcatataagtaccaattggctggggaaaataatatgaacatgaacacacaaaaatggtgaacgcgtgcgatataccctttccatttgtttcttctttgacacgtgcaacgaaatcttcagttttgtagtttatgcatacatcggcacccaaacctttgcaggcagctagtttttcctcactacctacaaacacatagtgtaacagcatttacttgagcgatctctgcaacatcctattatatactccctactgtatctattcttgttctactataaacaaacctgcagtaacaaaaaccttaattccaaggtgctttgcaatctgtatagcaaatgtaccaattccactcgatccaccatggatctgcaaacaccaaggatgcaccgtgctcaggaatgaatcatggagtcaatgggggattgaaaaggagagaagttatcttacgaggaacgattcgctgggggagaggtggctggtcacgaagacggtcgaccagacggtgcaggccacctcgggcaagccggcggcgtccgtcagagacaccccctccggcaccgggagcagctgccccgccggcaccaccaccttctccgcatacccgccgctgctgagcagcgcgcacacctgcaaggggaaaaacaaatctcccaaaattttacatcctatcacatagaacgtttgaacatctgcatgaagtattaaatatatgctaaaagaataactaattacatagattacgactaatttgcgagacaaatcttttgagtctaatttctccatgatttgacaatgtggtactaccgtaaacatttgctaatgatggattcattaggcttaataaattcgtctcgcagtctaccgacggattctgtaattagtttttttattagtgcgacggattttgtaattaatttttttattagtgcctaaacacctcatgtgacaccctatataatatccgatgtaacacgctaaaactttaaaccctagatctaaacaccccctaacctaacgtcctaatccaaacggcagcggcggcggcggcaatcaccgattcacctggtcaccgacggcccagcgggaggggacgttagggccgagggcgaggatggtgccggagcactcgaggcccgggtaaggggacgcgccgggcggcgcggggtaccggccctggcgctggacggtgtcggcgcggttgacgccggcggcggacaccccgacgagcacctcgccttcccccggcggcgggaggccctccccgacgtcccgctcctccagcacctccggcccgccggcgcgcgcgatcaccaccgccctcatctctccccctacctcgtcggggctcagctgctcgctttgctttgctcctctcgatgagtccacgcacgcgctgacactctgcgtctctgctgctgactcgtcgactggatattgagatgggccttgggcctggttgagtaaaattggcccagatagctgaaatctggtccagccttctaaaaaaagataagtacttcctaagtgctagtccttccgtttcatattttaagccgtttaactttttttcattcaaactttgttttgattgatcaagtttatagaaaaatattactaacatattaaaatagttttattgaatctaacattgaatatattttgataatttgtttgttttgtgttgaaaatactactatatttttatataaatttaattatactttaaaaggtttaactatgaaaaaaagtcaaacaactaaataataaataatatgaatgaaaagaagggagtaatacggtataaacgttgtttgctacattgtctatatattttgaaaatgaatcgattcggggcgagttggtattgactggagaatagaaagtctatatatctgtgtaattgaacatttggagaatactctcacattaattaaaaagatataatcattaatttggtggatcatacttgtactaaaacggataccttctgaggtatggcctgatatagacttccattaaaatgctattctcttacaacatttgagaggacaaatgactatactaattaatgcacaattttttttctaccacatgtctttctttttttttctctatccatatatactaaagttttcctctataaacgcctagagtcgacgaccattgtcacatttaacaagtatatttctctctttttttttcatttctcttatatgtcagcaacttaaaagtctgtttattaattgtctttgtatctgccctaattaactcttacattcaccagaaaaatgttcatacatcaggttgatatgacctaccgtaaatagtagtttaaagtttgtgtgtcaataataatgcaatttataaaaactatggacttattaattgtattttattattttaataattttaatgttagaattatgaatacgaagtctatacatcctatgctctcaatttagttttaactttttattttaatttcaaattaaagacttgcatgatgtaaccaatatgtacaacaactaacatattcagtcatcgtctcgagtggcaacgaatagagtgttaaatcatcaaattttgcttgtactccgtgcaaacatcccaaaaaaagaaaaaaaaagactggataattctctagtgatgatataaagttacaaactcgtgcaacacatggattgatggctacttaatgatattccatgcatatttatgaggttgtcaattttaattgtattttagtgtaacgaactactatacctaatcttgttttgcttttagtatgactagttactatacctcatcttgttttgtttggtattgcagaagaattgtttttatcttctttgttaagctacgcgttatttaaggcatcagaagtactatacagttggaagagaatcaaccagtaaccatgacaaaaatatcagttgagtggcggcaaatcatgtcatgctcgtgtgggacatagtactagtactactaatgggcgatagcaactcagcaaggcgaaagaaaagaaaagaaatgaaagtgaaaaagactgtgttctttatagatgagacggatattttgtacgtaaaacgaa

SEQ ID NO: 4212 - DNA, 300 bp, Oryza sativa
tggggaggggcggggcggaagcaggagaggcgggcgctgatggtggcgttcgcggtggcgctgctgatgggcaccgccgtctacttccgcatctgggcgcgccagtccaccgacccctccttcaccgtcgacgaccgcgaggagctccggttcgtcctccttcctctcctcttcattttactcttgcgaattggacataaggatctctcggtcgagctaaaaaacggaggaaacctgttgttgtttggtgaaatggatccgtggctgggaattcatggacgccttgcttttgaaatacga

SEQ ID NO: 4213 - DNA, 1070 bp, Oryza sativa
tagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatctttcagataccgatgtagccttggatgtgcccgtgcccaatgaagaggaagagcgcaacatgaaacgtaagtacaaaagtaccggacacccacccagatcccaatagaatccgcctaaatcctgcgggaaaatgtgatcccattcaccagctcttacatttattaacaagagaactattgtatttatctaacacctgaattatctccacctttcatttgatccctatttatagattacgctgcgttgctaacgggccgcacctcttatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctgaaggagcatcaactggagaccaccttggcgggcactctcagtgtctatcagaatgccacgggcaagatctgcggtgtctggcgacgagttccacgtgattacaagcgcatcatgcgcgacgatcgtctccatgttgtcctcctctggggcaacaa

SEQ ID NO: 4214 - DNA, 610 bp, Oryza sativa
cttgcgcaacgtttactgcccacgccgcatagttagccccagcgaatacaggattggtcccagtaacggttttaagttctgacaattcaggatgctctaatgccgtttgatgaaattcttctaggtattgtttagctttttcctcagatactgttttattgggactttcgctcattttatttttgatagggccatgctctttcaaagactctatctttgtcttagttttatcccttatgacatcccaatcaagatttatgcatgacaatgagctacctactgatcgtcagacacgatttcctgcacaggcttgagccatatactcatacatcgcatcttggccacgttttccacgggtttcaaaattaatctcaagttctacgcttaacgctttcgcctgttcccagttattaatataatcaacgctagaactcccctcagcgaagggaaggctgagcactacacgcgaagcaccatcaccgaaccttttgataaactcttccgttccgacttgctccatcaacggttcagtgagacttaaacctaactctttcttaatagtttcggcattatccacttttagtgcgagaaccttcgtcagtcctggata

SEQ ID NO: 4215 - DNA, 624 bp, Oryza sativa
tgcaggtcgactctagaggatcggtgagggaacacaggtcagtgtggggacaggggtcacggtggacacgggggtggctgtctctccacctcctcacattatgccaacaggaacgcagacacattcagacgcctttgcagaaagagatgccagaggctcttgaagtcacaaaggagaggtgtgaagaaatcctgcatctcagtcccacacaggcagctgtctcaggctttacaggtgatgagagactcatcagagccctgggcactgttgctgcacgcggcctgagagcagctccctccttttccacctgagctcttcctcctacacatcatagcggtgaccacagctccaaggacagctaggacaaccaggacagccaggccagcaacgatgcccatgatggggatggtgggctgggaagatggctcccagctcagggtgaggggctcttgcagcccctcgtgctgcatatggcacgtgtatctctgctcttgtccagaaggcaccaccacagctgcccacttctggaaggttccatctcctgctggcctggtctccacaagctcggtgtcctgggtctggtcctccccatcccgctgccaggtcagtgtgatccccgggtac

SEQ ID NO: 4216 - DNA, 824 bp, Oryza sativa
cccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgtggtgctaacgggccgcacctcttatttctttaagggtgaggaaatgaagtccatgtacaccacctacaatccgcagaatgtggtggccaccgcccgtt

SEQ ID NO: 4217 - DNA, 55792 bp, Oryza sativa
atacatttacattggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactgattcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagaaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctttattgttcgacaccgatggatctcggtatggcataatgacaaccaatttggcagaggtgtacaactgggtaatgcgaggagtttggatacttccattggttgctattgttgaattcatccttcacggcacgaaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatagagtgaggagatatatgggttcgggatctcaggatcttacacaacgctgagtgcccaagttttttacattccagatccatctaagttaagggtgaaaaagggtcgacaccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcttcttagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtgagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgttactatcaactttcggcgctgcctgttgacataaagtgaatcacgcccactcgtgatcgtcttgtcacatctaatgaataatgtatctcattgagttcacatatattgcagtgaaaacaacgctatataactgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttcatcaggtatgcttcatctattcgaagttcaaatggataaaaaaactaacttcttcgtacacaattgtaacatcttacgcagacatatcgtccaatgtgcaactttatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcttgtgtccaaacattgtcgacgatgatttcgtggtaattacaactattcttttcatcactcctcagtactatcattaacttaactatcccaaaataaatgtacataggaggatgtaaggaaatgtcaattcgtacaatggattgacacagtcagagttacttcaagtggcgggccgataacgcaacctgaaccgaccatacagttcattcatgcttggatggagtacgaacgttgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactattttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggtgatttttaaaaatcgccctcccagagggcggtaggcgaccacttctgtcaattttcaaaatgaaaaattatttttgtaaaacttttaataaaaaaaattaaaaataaaaaaaattcgcgcttctgggtactacaccggtcagggtgttgggctggactatttgcatgggctacattggaggcccaatttggccgaaaagaaagtggagcttgtctcaactcttgtccaaacagatttcagatgtgcactcaccagtctcattgtcagagcttgtctcaactctttcatggaccagaaaggatagtagtgatgatcctctagggtgtccaatagggaagatacaagagcaatagggaaaagaagaaacatttcagggataacagtaattcaatgtgcacctaccattgagtgtttaattattttttttgtaaaaaaaatcagttgtaagatggtttttcagtgccttctagattcaggatcattcgagtgagcattaaaagatggagatgaaattatatattcaagagaataaaataaagggatgagctcccatgtttgtttgtttttttactggcaacagctattttcatagcttgtgaatttccatttaatagtcatccacgaattcttgatgacatgaactgtccttatatccaaatcaatgttattcagtaaaaaaaacaaacaaacatgggagctcatctctcaaaacatgcaatatattgaaaccctatccaaattagacacgccctaagctagtaaattgaatctgccacctagtaagctaaaaatgggactacgaggaaaacgatttttgtggacgaggcccttccatttttccaggtggataagtttttttggcaccatatatccgcctgtgaaaaaaattgattttcgcagacctttttctacaggtggattggcagttcgcctatgaaggcggttttcgcccgtctggcaaaataggttttctagtattgtggtcacatgattccatgagatcaaattaatactcaccatctgtactcaattgacatagcctattcgtcagttcaatgtcagcgaccatgcattttggtagaatcaaagattgacaaaattagcacaagagttcctgatgcctcctaggcctaccactgcaaaagccataggagctagcagactgcatgggctaatgtatgttcctctcattgcttgcagcatttgtgtgcttctccaccctgcatgcccttttatggaccaaaacatatcatcatgcatatcacaaaaggatgaacgacgtaccatttgattccatgcatgcagttattcagtgccacatggcatgtgcttgtgttcagatattcagttgatcaccttttctttatcgcatgttaccaatgaaaatatagttcactccgtgagttaaccaggcaaggtgttgggggagtggctccggattgaggagccatcctccgaagggttgaagcgctccggagaccatcctcccagggagatgaccgtggatcggggccatgtcggtccccgaccgaggtggccgctccggaggctaccaaggatcccagataatcggatcccgtggacggcgagagccccggagcctggaagggatctggagatcgccggaagggctccgggaggccgtaacatccgtgggctccggagccccaggaagcatctcgagctccggaactcagagggtttccggagcctagcaaaagaactccggaggcggccagggacttcggagctccggaggcctccgaagctcgagatgctgcccggggcgaatcgagcctcaatatgccctcaacggctcaagttaggaatcaggcgactagtgggttggaataaatgcacactttgcgccccaaccacctctgagactgtcgatgatgaccagacggagcacgatattacccgggggatgcctttatccaggtaatagcgggctccctcgggaaccggcgctgctaccttaataggcgcctcctccttgtcacctatgagattactaatagacccagggctgacccattggccagcacctcagattcctcataggcctaggggtaccgaagtcatttcctgttgtataccccatgtattaatatgtaaaaaccgctctcatttgggtggattgaatgcagaggaatatatttacatttgttgagttcttgcaacaactccaggcatggaacggccatcattgcggtcatttgttgttgttgtagacagagtttccctggaactacagcgcacaggcctgaactaacaaaagaaaaaggaatggacggagtataatacatgattactcttcttctactgttctacatgtgtacgtattgatgtgttaactatattttttatcaatttttgtctatgaattgatggcatatatatactgatgtacactacattatcagctcaagggctcgacggtcttgatattttattaactatttatttctttggatttttaatgcatgccatattaaaattaataccacacaaacaatacttaactcgttctggagttagcgacaatgctgtttggtaaaatcataggttgcccaacctaacacaagggctccggtgcctcctaattaagcttaacacgtacggtaaaagccacagaagctcacagcctccatgaacagaactagctagctctaattgctccaagcaattgtgcttattcataaccagctcttttatagacaaaagagagataaacatatcactcaaggatgtattgctgtttgattacaggttgttagtttttccatgcctaaatgttgttagttaatctacctcagctcctttttacttcgcattttgttggcaaaaatatagtccaccgcgctgaactcaggaacgtatataccctcgaagagctaccgaatgtgcatgtttacaaggcaaggcattgccatcgtcgccatagatggtagacacttccatgtaacaaaacgaaaaggcaacaacaaaaatagacctgacaaactgaacatgcacaagatgagtatcagagtcatcagacgtgaggtcgttttgtttaattgttagaatgataaatcaaaattcggtggtctattctctgttcatgtcctgtacttgagtaactgaaacaaaagcagttgcctttggtcacaaggcttgataaactctgcctttcagaaacagagtacagagtgttatgtgtgcagttaagaaaaaaccagatcgaaattcacactgatgcatcattccattaagaaaattctcagtagttgcctcatacaagttaaacactgcaactcttcgttaaactgtctgtttcgcacatcgagctcgtgcgctttcagtttatgaagagctgcaagagagagttgctagtgttctgtgtccctcaatgccacgtccatgacttcacgcactatgtcaacttctgctcgatagtggaaagctcccgatgcctcctaggcctactcctgaatgtacaatctggtcttgtttaaacgttcacatacattcgtttgatggtattttataaccatataattttttttgcgaaacatgatacaaactaaggcgctcatataacaagaaggacggacctgccacctgctaacttgcataatctctatcagtctctcccattctgtagttttgcccctttctacacttctcggaattcaaaatatgcgacatggccccatgatctcacatactacacatgtgtactcaattgacccattgaacttattggttcaaattcgaggtcataaatttgtaaatcatgcctttttccagaatcaaagcttgatgaaggtaccacaagagctcctgaagcctcctaggcctacaacaacaaaagcaacaggaacagagtttttctattaggcctttttcggtacgttgggatattccttccgggggaaatcaaaccatgtggggagtcggggaccgcgttgatctccatttccacacccaatcccctccctcccaatcgccttccatcccttagcttgtttagattgcttggatggacagtggattggaagggattgctactgtttcaaacaatcaaaacaagaaaatggcagggaaaattcgaagaaaccagaaaattcagaaagactttatatatgccgctctccccaactccagaacatggtggtaacggttgccaaaacaattatatgtatgataaccattaattatgcattctcttttggttcctaattgaagtctttcctgcaatcctgctggacagtatatactgcatatgactcttccagttgaacaatacttcagaagaaaatttagggaagacaaagtacaggcacacaactagctatgactttctcgtgattttcttcattgtactgatggaaagaatagtagtaggaagaaacagccataacgcccctatcttattccagagcaaaaggataagcaaagcaatattagacacatgtaaagacatatatagatcgtttgagggttgttgagccgtccaaaatcatcagcatttcagtgggatgagatcactcattttcccttcaccctaagacatacgttaacctgtacaatacataatcaaacaaaattaaagtacacatcaaatcctagccatttcgtccacaccaactattgagctgatcactgaaagaaaggaaaccagctagtttgcatagcttgcaaagaaaaggtatagccatgaaaaggattctaaattttgctcagcttgcagcctttgcaccgataatgctcagccatcagaaggattccagcgtttgcatatggaagattgccgacgccattgttgttattttgagatcaagaacatggagcccttctgctttggtgaatgcatagaacttccctggcaagaaggccatgtctgaactctgaaatcgtaatacgcttcagtgcatataattccatgtggccgtgtgagtatcctgtttgagcaggagatgatggtgaccacaacaatgtgtaacactggtgatgtggagattgggttcagtagggagcagccgacatatatcatcgtgaatcaggaagatcaggttgtcgacggcgaagcagatgggagcaccaccgaggctcccatcttcttcgtcagccacggctgtgacggcggtggtggcagcgggtggctcgcggtgtcagtagtaccagcctggtactatactagttaaggtatggaataagttcacttgtggtcccttaacttatcaacgaatccaattttcgtccttcaaccggaaaacattggaggcccatttaagatattgggctggactatttgtatgggccaaattggtggcccattttaccccaaaagaaagtagagcttattgtttggactaattaaagagagagagagagaactacaatggaatcaatttaagcttaccaaattttaccaacgttcgatgtatttggtttggagcttaccaaattttgatcatgtgttaatgagaataaatttccagaaatgccaatttttatgtcttgtttggcacagctccagatcttagattcacgtttgatttaaaatttatatgttaaattatagtggtttaaaatcttaaatttcaattaaaatgcgaacataatgatttatctaaatgttatcaacgtaatcgcatatctagatccgtggatttatgtagcttgaaatatatagctccaaaaattcttggatcagagctcaccaaagatggccagagagagccgttagtatgataacaatgacaagagcttgttcaacttgctatggtaccaaactttagtaactcaaaaaattagcaggttaaaagtggtggcaaactgaacaagcccatagtcgtttatgtaactttttaattagctttgaataatgttccacgtgaaagaaatccctcaatcatacagtgatttttcccctgaattgaacagattatcatgctaccttttctctataaaagatgatacgagtgagtgcaagtgccaaatgctggaaatgggaatgagagttgatacatagggtgtacggcactatgatgtatgcgatgtctttgttttggtaggtttgggaggtatggggagcatttgctttacattagagagttattttcctgcacaaacttcctagctgactagaaggatcagcgagcacagtcggctctttgctattcagggtgtttgagctagggcagtccaccatttctccacggtgtccatggtatcccattgatcgattcgcatgttatctagtgcccacactgctcccatatactctttgtaacctgacagtgagcaaggatgtgtatttccatctcatcgctgatcgacaaagtgagcaagtcctttgtacataatgcatttcactaggcaatgtctgaaatcatgttcatcgtgcattatttgtgcttgcacagacaagcagggctagaagtagggcaagggtgccagggcttagtttcttgtttgtgtgtgtgaattaaaagtatttgctccgcaccatattcttacaccttccaaatgtggtctaaattttgttctaccgaaaactactctactttaaattcctttatcttacctttcaaaacgtagctcatcagtggttaggtcttcaaaagtttggtatttctttttctcaaacagttctagccaactcaagctgatcagtgctagaccatgatctagaggcagggatgaaaacggtcggaaatggtcggaaacggtatcattattttattatttttttgaaaacgaacgaaaatggtcggaaaatttccatatttatgaattcatctattagtgtcaacttcaatgacatgctgatagaaattaaaaaaaactaaattttgaaaacgataaccatcggtaaaaatattattattatattagttttgcggaaacggtatcggtacggtcgggaaatttccataccgttttcacccttatctagaggtgcatgtggacatggaggaaccagtagctatattgcccccctttgaaatgcaggattatcaaaacattggagtaggaaaaacatgagaatagaacatcatattcattggattcctgaaggatttgaaaacataggaaagtttgattgtcacacaagaaaaatgtaggaattcaagatacgggaagaagaaaacaagaggtaagacctcatacttacttcctccaaaattcctccacaatagttcattccataggaaattcaaataaatcggtaggaatcactcctttgtttcaaaggtgatgcgggggaacttgtgcaacgcacctttcaccatgaactcacaaaacaacacactttgataggttgattcactcgaccatgcaaaattggatctcttgctagctccctcaattccctgcaaggaaaagcaagaacaatctatggcagaactcccaatcactatccctagtttggcgcctgacagcacaaaacctaggaaaagaacaagagcagatacatcacaatatggaaacctctcggtagcaccatcagtttgttttggctcttgtggtggaaccagaatgaatttgtgtccgtgggcctctccatcatgtgggccatgaagtttactttccaacaagtgctcacacgtccaaaatggacttcggacgaagagaaaaaaacgttttagtccaagcatatccaggatggcccaaaccgaatccaagtcaaatattttctttcttatcttcaaactccttgttttcgaaggattcaatccatggggaactagtggatggagtccatcccaaccaaagatttgccttggaaatagatccccatccaaacatgtcgtgcaaggcccatgttcatcatcagcgccgctactcgcgcgtcaaccaatctatttgcgcaacatgtcttcattttgcaattgtcggtgatagaaaactccgaatgatgtgccattggatcctttggaaagtagacttgacaagctttacaattatgtaagctacatctccctagacccacgtgttgtttatgcatgccaatggttcaaatatctcatgtctgaaagtaatcaagtgacaaatattttgtaacatcaaattctcatatatttcatgcttagaatttgagaaaaatgatatcaccttttgttctaatccacatgcaaaggacaatgtgtgcaattggttggcagatccacatcatctcttcaagaaaagtcgttctcggcttttggtaatcacaaaatgtgctaaacaaagagaacaatgtgtacgcatgatatgtgtatatgccattagtttaaaggttcccttttttacccatagtacaataagcatagcagccataggatacaccatacctggtttgtgcaaataaacttatttgtatcaacatttgcacaaataagtttccaattgtttacaccatacctgctcatatcgaaagggcttcatagggtacaaatcctttggaattcctatatttttcatttgttttaatgggggccaagatttaaccgaatggcggcatgttcaggtcattgaattccctcaggggtggaatggtgatcaaagtaccaacttgacagggccgtctccaggaattgggggccctggaacgaaatataatttgagatcctaaatttacttttgattgagttgatcatttaaattagtaaattatattcatggtaatttgatttaaaagaagagtactgaaacattcaattgaccatgcatggatacatgcatgcaattcaacaattcagtatttgacttaattaccagttgtccagtcttactctaatatggttgacgaggtagtcggccagctgctcaaggtgtcattgttgatcaaggattcaaaagctggtttcgcatgcatgcacatgaacacacataggacgtcagttgtatatgctaaggctggctggttgtgctggtcactctgatttgggggccccaaatttttgtggggccctgcgctgacgctccgttggcatgccctcgttgacgggcatgcaagatcacttcaagtaacaagagaactcctggtgcctcctatcccaagcatagcctcaaattctcagagtctctgagagtttattcagctttttatttagaattttgccacgataaaccccagatggatggggcccttgatgaactgttcatacctcagtttgttacaattattctgaagttcagatcccttctctgtttattcatggatcaaggagagattcgaacatcacatatgactatgagagtgtattgtttgacccctctcagttactcgtatatagaacctgaagaattgtccagctgcttttcatagacgtgcatctctccatttagtggaagcattaggaaccttcacagccatccaatcaaatgttgagatgtaattaagagaaatctgcgaacatgtctaaagacaaaaataggcaggaaagttctctttgagccacacaaaaacagcactcatcacaccaagtcaggcgtaaccaagaatgtcaaggtatagtaaccaaattgtatcatcgaaacaccagaactaagccaaaaccccaaactttttgcggaataaaaagttaccctcaaattcgacggatcacggcctgaccgaaggtgttgcgccggtctgaccgcctggaagccgtcggtctgaaagaggttgtatctccggtctgaccacctgatcagctgccgtcgcctgaaaccgccgtcggtctaaccgccttcactccaccggtctgactgccgcgatgccgccggtgactcgccggttagaccgccgaacccgagaaaacacaaatcgaagaactcttaaagtagatgacaactttattacttctctctgtgtttacaaagtgcaacaataacactcctcacgaaaatctcgactaaactcgaaaccctaactaaactcacagctcaatgctctcaaaagtgataccgagaagcctcacgctccctctctatttatacatgaggtaggcagcctaaagccacgaaccaaaatcatactagaagtcctaatccacctaggaaaccttctcatacaagaaacaaactttacaaactccaatcataccaaatttggactccttccaaatttgacttcgcatcccatacgcacacaatacctccatcgtatgccatatggaatcttcaccaaccatgtgcattgaactttagcctaagtatcccgcatgatatctgaccatcatggacatcgtcttatcaccaagctgactcccgatccatcaccggcaatactctcccgaggcatcaagtcacctacacatgaatcaaacaaagaaaccatattccgagaccaagctatctccaacttgactcattagtagcaaacaacagtattacatacgcatagtatccatctagaagccataaatatgaaatccaaataaacaactcgaaaccgaaaccgacacaaagtcggctggtcagaccgcgcaatacaagccagtctgaccggcagcacatgcccggtctgaccagaccacatattcagcagttcctgtatatcacatgtaaatcctatcatctccaaaaccacttcgccaataatcttcaaatattaaaaccaataatcacagatgccaattgttcatgatagaataataataaaaaacactttgattttgcacaaatccctttatctgctagaccaaattaaactgaattccaacaattattcacatgtgaactttaccacaatgatctacttcgtgcattcgtcacttccgcagacacaaggagcttcaccgcagcaccatgagttcttcgagttgtacggtggaacagtagtggtctttgtgaattcatcacatggctgccactgtcccaaccccttggaccataaaccactctacatggagcatcgacatcggttatcagtcaatctgcttttataaacaagaggatttgcatggctgcaccgcagagagaatactagctccaacattccctttctgaatgagaactgttcataattctgatgaaccgctatgctcaagcatttgtcctctacctcttgctcgcagatcctgtacgcaggatgcaatataacagttatttgcgcaattttagtttaagcatgtagaacggtgaaccaactatcgacaagctaggtaaaagtaattaatagtgactatgtaggaacttactgaacatgattcttgtggcatggcaactcctgatgcatcctattctgaccaaagcaacaagaaatgtccatctatcatctcttagcttgagcatcgctgcagctccttcatcgacagtctactcttccatgtatatatagagctgtaggtaccattgaccatagcaatgttacatttctgtttcaatgcagcacctaccactaacatacgttatgggaggtgttttacactggaactaatttaaaacgtttcctttttctaattcaatggatcatatccatttatactattactaccacgcatctactacgtgtagtagaattgttagagtttgtaagtttttcaaatggtagtataactcataaatcaatggttgacatcacttctactacaataatactgatagtagaatactactagtagagatcaccgtaaatgtactccacgtacaatacaacacataataggagctggacattaccagactgtggagctttgtatcagtaggattggcacctactgatggattgtgtttttgccaagcaagtatggagagtgctctttacgcgcctatgattacacctgccgggtacccatgctttcggggcatagatggccataaggcccgaggcccgaaggctcggcccacggcacggcattttggcctggctcaagcatggcacggcccgacttgggtcgggcctgtgccgggccgtgcctgggcctccccaccggcacgctgggctggcccggcacgatgggccgccaggcccggcacacaaagtatagggactaaaaatagacatataaatgtcaccgtccaaagaatagggatgttaaatagacttattttagctatttatagatcacagcccaataggagggaggaaaattacacttattctgaggaaaaacacgatgcgccgtcgtgccttcgggccggccgggcatggcccgagtcgtgttgggccatgcctgggccgtgagtgcggcacgtgggttggcaggcacggccggtgcatcggtcgggccgtgctggcccgacaagcctcggcccaggcacggccaggcctaggctgtgccatgccgggcgggcccatatggccatctatatttcggggggtgatatcctacattggtgggaaacctgcaggagaaagctagtaaaggaacatcgaaggatatttgatggtgtcatcatatacacatcatggtgcatttggctgcagcgaaatgataaagagttttcaacaacgtttacaatgagacagtggaagatgtggtcaacatgtttattagcctgttcagaacaagggaagaagtgcttgctcaaatgtagcttcctaaagtttttagcctaaagttgtcttttttttccttactgtgttgctgctcctgtaaaaagggctgtcaaaaattatatttctaccagtggagcaacagaattataggtcagaaaaaagatgatggaaaaattcattatctagcggtatactgatagaaaaaatatttccgacagctattgccttgcacagaaaatataaactggtgtcagatcgatctgtgaaacttgacgctggacgtgtaactgtcagtaaattttcctgtcgataatggcaccatcagaaaaaatgctgttcatcagctaggttcagagttcagacgagcatcggagcatgcagttaatcatttaagaccagcgagtcaatggtgaggcccttgtgtgcataaagggctatttcaatcagacggggacgaaattgggcagtagctagctctgaacacaaccaatgaaatttgagtagatttctgcattcagtttttagaaattgccatagtgacaatcactgaaatcacagcagcatatagataaagcaaaattccgttctctgtggcagcaacagaccaacaatgattaacaattagaacatatatagaaaagtgaattcatgataattggtaacacggaaacaacccaaaaaacagtgtccagtgggtttgtaaagacaggaaattccatctgcctggctaattgttaccatcatgtactattatctcaatagctcattcctcatggagtcctggaccaacaaagacaagcaactgtgctactcccaatgcttcccatgctgactagctaggcagttcactgtgtgtagagtttccaacagccctacagattacaaacgtgcactcacctgttccattttcagagcctgtctcaactctcttttatggaccagaaaggatatttgtgatgatcctctatggtgtccgggataggtaaatgggaaatagataaaagaagaaccaatttagggataatttgtaatgtagttcaatgtgcaccagcctactattgaatgtttgattaacttttaaaaaattcagatgtaagatggtgaggccttccagttgccttatgggatcaggattattcaattgagcattaaaaaggttgcgatgaaattaggtgagagaacactgattaatatagggatgtttcgtgtcgtcaagaattcgtggatgactatatctgacagaaattcagaagctatgaaaattgctgttaccaataggaacaaaaacatgcgagctcagctctcaaaacatgccagattcaaaatcctatccaaattataaaaacctgtgaaatacgactataattgatcaagatgctgcaatcggttaagaacactggcattccatttgcaaccatgtttaagccaatgcaactattgaatcaagatctccaattcaaaatcgaggtaacatcctgcacaacattgtcaatcaactaccagttctaccactgttcctcataggcaaaatgtttggtcattgcaagaacctaaatcagctacctagtaagacataatttgccacatgctcacatgagatcacatactcaacatccgtactcaattgacccagccaattcatcacttcaaatttgaggtcttcaatttagcaaccatgcattttggtagaatcaaagcttgaccaaactagcacaagagttcccgatgcctcctaggcctaccacagacaaaaccacaggagctagcaaactccatgggctaattgtttttttaactttcattgcttgcaggttgcagcagttgtgtgattcttcaccctgcatgcccttttatggaccaaaacagatcatcacgcatatcacacaaggatgaataatgtactatttgattccgtgcagttattcagttgatcaccttttctgtcacatgtgccagcaaaaatatatagttcacccccatgttgaataatatatagttcatcatcgcttcgcttccattgaacttctccatcgtgtgccatcgatgccatggatctgagatcgatcgcgccaacagctagcgttgaactgaaaggaccagccatcacaataatgcctctgctactcgtgcagcgtcgctgcgtacgtaggcgaaagaaaaatctgttgtttttggttagaaggctttgtaaactctggctttcagaaacagagtacagaatgttatgtgcgcagttaagtaaaatccagaaaatcactgatgcagcaattcgttgagaaatttctcagtagttgcctcatacgagttaaacactgcaattcttgaataaactgtctgttttacacatcgagctcatgcgctttcagtttatgacacacaactacacaagtcaactaccagttctctgcataatccagtacatttttgcagtgttcttgtcgagaagatgacctctgacagcaggccagcgccacttagcattctgggcttatattccagccatagctagtatttggttcagtgtatatactccaatcatggagctattgtcattgcaaacacttgaaagtaagtctccatttgatcaaagctatgactaaatgaattatcatgattgagacagggcaagtagaacatagatagatctagagatcaaatctagctagtagcaacgctgaacatatctactagattagccaaacaaatggagtggtcatcacacctcgacaaatcatgtcaagggaatagttttgcataaaatcgccaatattcagacataattaacatattcatcaggcataacatccaccttcatctactcaagaaggcctgcatccttaaccccacgattatccatcatagttggaaaagtctcttgtgcatgtgtatcctgctgaagaactacaagagagagctgctgttcttctctgtccctctatgcttgtaatgacttgatccactacctcaacctctagtcgtgagtggagagctcccggtgcctcctaggcctacttccatgtgaaccagcactgtttgattccatgcacttatacttactgtatgaaagcttcatgatgcatgtactaattaattaattaatgctgtgatcgatgtttagtttttttcctttcacgttgcatcttgcatgttttcggcgaaaatacaattcactatgctgaactcaccgcacatgtgtattgacaattgcaagggatggccgtcgtcattgtaaacgcttccctaaaactgctcttccatctctttctgtgtctttctttttaagatgttggaacaattgtagatcgcaactcgtttaatttctttttcatctctttaggcatataattccttttaaaagaatagataataataggtttggcactttcaaaagctccttagtgagacggctaacctagacagttaacgttagcactccctggtgtagtcttggatgtgtgggtctcggtggtgggagggcgggggtcctcctactttgtaaatattttgttctttgttttttcttccccttgaaatgaaacgcagttctcctgcattttttagaaaaaaaaaagaataggtaaatgggtgactgtgtgaaagctttacaaagtcgaaaggcacattattttttttgtgctaaagtttgccggcctaagaagaaaaaggtagatcattacaaaatgctccacacactaaatggtgggcaatgccagatttcttccaccaacttgcaaattctttggctatgccataaacttaattaatgtaatttgtccatggaaagatttcagaccaaacttctgccgcatatatacatgcatcgaagctgaaggtccatagctacatgcatgtttggctgactaccaagcttgtgaaaccttcttatgtggtcatcttcctcaacttgattcgttggttggtgtcaacatagaggacaaaaaaattagaagttatccaggagagagctagcctatatctgcatcagcgtagcattatttgtttccagcctatctacaagttggaaggagaacatgatactgaaagttcatgtaacatgacaattctcgatgccttccaaacctagataagtattttggcttttgtgtatgggcatccatatgcatatatggacatgaagtcaccacgattcactatcactctcatgtttcaggcttagagttttctcatctctcatatatatggtccaaaaagatattgtatatatggttaaacattgtcaccttattaattcactacatgcaactatattaaattgggaacctagctagctacagggttgccagctgaaagtgagctgtgtaggttcagagtattctttaacttcaatccttctaatttttggcccaactgtgtttccttttcattaccctccttccattttgtttgaatgcgggaagtcacctgcttagagagaataaacttgctgttgggctgattttgccccaattactagtttggcccagctcaaaacaagaatgtaccccatccgttccatgaaaaacccaatcctacaactataaatctagataaatgtgtatccaggtttgtagctaggattgtttttttttaacagagtagtaaactctgttatgcttatcaatttgatattggagttgttgttttaacatctttctaaaatttgaatactatttattcttgtccaaagtttctaagtataaataaagttttcattcccgatgaacgtttgttagcataaagttatacaatttagaatttttgtggtagaaagttttttattcctttagaaaattgctagttaaactgcttttttactatcgtataaagtttctgaacatatattttttatttttgtagaaagtttatgagtaaaattctatttattatttgaatagactttggattgaaatggaagtttcataatgtagtaaaaaaaggttaagtagtagaaggtcttcctatcaaatagaaagttaaggtttgcacaatatgaagtttgctgtacaatagaaaaatatgcaactcactaatcctaatgacatgctaattacacaatgcgctaatcttgatagtgtgaacacgctaatcaatcacgcatggagaatcctcttgtgggtacgtcttcgtgccacatgtgacaatatgccaatagagtggagtaatattaacccactctttctagtgttaatttatacaaggcactacatgatacactagctagtacaaagaatgttaatttctagtgttcaaagaatgttctttcacttctgaggtgtggaacaaaatctgcacttggaaggggttaggtcaaaactacctacctaacaatttggatttaaaaaattggtggagcgctctctcagccattcaaccgaagcccttgcaaaaaagaattttaggttgtctgataacctcctggtggaacatttagttggagcggaataggcgtattttccaaaaaaactcccacaacggttgatagggtggctaccctaattcttcaagacattgatcaaagacttttggctttccaacccccttgatgctgcccttgtttttttcccttttgctccattttttgttattgtgttttttgtgttttcttgtctgtaaataacttttatttcgtctaatatattccggcagtccttctgccgccgtttccctaaaaaaaaagatacactagctagtatgaatatgttatgtattataatttgatatctcatgacagtatgacattggcctccttagggatccgcaggtagcaaacttgatcaatccaccaatcttagggaacagatccttatatatcatgcagccatggtgcaaacttgtatcggggggtgccgatatactgaaattttgaacaaaacttggtcaaatttgaacaaaatattgccaaattcaaaaaaatgaataacaaattaaaaattcctgccgaaataatatcatgggggggggggtccgatagaaccgaaatttcggaaatttctttccaaaattttgaaccatggttatgtggatcagatcaacaatcgccatcgacaataaagccacagctgatcaacaaaatttgtttttgtttttgtttttttttcaccggactgacggtgaagaaaaggcccaaaaaattttattaagattaagaggagatgttgcatctaaatatgtggcatccccaaatgttatcgtgacaacactccaatcttgggcaatacaatggttctgttctctacgatgcagcctcctccatcgagcaaccacacacacttgtcactcataacacttcatccatcatctttggatgaggctgttgttcgattcaacttctgtcgagcactagtttggagggacatcacgtcggcttctccatcattctgcttccgagagggaaaggtgctcaaatatatcgaactattcgctacgacatgcaatagctaggacactgtagtagttcatcaggcaatgtttaatatgttcaggtagctagcgaccatgctccatatgttttgtgaaatcgtaggttgcccaatcaaactcaatgtctcctggtgcctccaaggcctatagcagcctccatgaacagacctagctatctctcattgcttgcactacttgtgcttatccatcaccagctcttttatagagcaaaacgagatcagtacatatatatcacacaaatacacaaggatgtacaccagaggcatgtgctcatgtacagatgttcagttaaccaacttttttccttcttttttttgaaataataaaataacacctacaaggcatgtattgatgtacacactttcagttagcaaactttttttcttcttcttgtcttttttggaaaaaaaatggcaaggatggacttagcattcattattgataaaaaataaatgatggggggaacataacgatcactcttgtcaatagcatactcttaacaactctcttccaaccaacctatgcatccttctcaaccacttttttttctgaagttgcagatcaaatatttcagttgatccaaaaaaagttgagcgatcaaatattttagttgatcaattggtgaaacattaagttatacatggtgaaataaaaaaaatagtaattaaaacatttaaaaattttgtggaatacaacaagaacacacattgaaatatattgctatcacttatgaaacaatgagttttagcgggttgaatcatttgtttttcttcatcaaaatataattatgtgatagcttgttgtaaaaaatgaattacaacaaatacaatgttgcgtttggatcgtagattggataaatagtttaggagaaaaattattttgaagatcattacatgcatgcgtgcatgcatggagtggagagagagtaattagtatggtaggaaaaagaataagagcaggtagttgcctaaattttatgaaatataatgaaaatgcacactgaatcgtatgatatcttatcataaatatttaattacaacgaatacgatggtgtaatcagatattatatcatataagcagtttagaaaaaaatactttaaagattgataaatgtatgtatggatgaagtaatgtagggagagcagtattgcagatactgcaatactatttttcttccatcggtagacccatgtgaagcggtgtccggcccaatcacttgatgtggcagatagatgcaactatttgacaccttacaaatggcaccttgtcaggccaatgtcaaaactctagtttctcccaatgtcctgagattcatacctgacaaatttatttgggaatacgcagaaaacttgttcatcattgtatcaagatggaatgggtctatagtacaaaacacaaaatgaaaagagcaacaacgaaactagaccctggtaaactgaacacgcacaaagtcagaaatgatcggccaaaattgactggttctttctgttcatgaagtgtactttaataagtgaaagaaaatcagtgatctcggatacaaggtttttatatactctgtctttcaggaacagagtacagactgttacgtgtgtgtgcagttaagaaaattcagaaattcacccagatgcattaatccattgaggaaattctcattagttaccagatatacgagttaaacactacaattctttgaaaccggctgtattacacatcgagctggtgtgctttcagttcatgacacaaatcaactgccagctctctgcgtaatccagtacatgcttgcgacaagatgaccttttccagaaggccagcactgctgagcatcctaggcctatattctggcaatatcttgttaggatataatatttgattcgatgtaattaattattcagtatgtatgtgccgatccattgtgcaattgtcactgcttagagttgtatgtagctcaccattcgattaaagctatgatttaataatcagctgatcagttcatttcaatttatggttgaaacaagggaagtaaaatttggctgcaatttcaaatatatatctccaagattaggcaaccaaatggagtgtttgtcacaccaccaggagaaagtcagggaccagtttagtataaatcgccaagattcagacgtaagatgtacatcagagatagtccgtttctttagttttgaagtatatgcaagtttaacgaacgttgtatttagcgattcaaaactatatatccactttggtatttacattcctgtacacacaacaaaatgaaccattaggatgagagcgaaatgctagttcaaatttatgctcgcttagctatgtactaagagaactaccaagctccagttcatgaatatgaatcatgtccatgattacggaaaatcctcttttccaatcaatggctcaacaaggtctcatccttgggcctcatgattatacatcatatcgctttgtcctacagacaattcccatgcatctttatcaggtaagagtatgatgctggtgttctgcccccctcaatgctctaccgaaaacacgacccactgtctcagcatccacacatattaggaaagctcccggtgcctcctaggcctagctaccatgggcaagcgacagttcacaagacactggagccagtttcacttctatgcgaagttgtgaactaacactcattatggacgactctgtcccttttcagctcatagctcttggttcctcttttataagccaaacgaggcctttatgtgcatataaggaccagtgagtgaatggtgaggcctttgtgtacataacccaaaaaaaaattatgtagatttctgcattttggtttctagaaaactgcagtagtgataatcaattaaatcacagcagcacatacataaaaccaaaacgtcattctttctggtagtgacagtaagcttggaacagtggattcatatgtacttggtactccctctgttccataatataaggcacaactacttttctttgatgttccataatataaggcatgcatgcatgcatacaattaactaggacatcttctccattgaattattattttttaaatcccccactctcaagatctctaattctattagatgcatgcattatatttattaggatggtccaaactaggagatgataataattgtttcttggtctttgtgttaagggtggttgtgccttatattttggaatggaggatgtaacacataaacgacgcatccaagaaagagtgtccatgctgctctgaaaatacaaggaattccatctgcgtagctactctcgttactctcatgtgttattttcaatgggtcatggacgatgtagactcagcaaagacagggatagtcgaactcccaatgcatcccatcctgaccatgggaattgtttcaataggatcagtgagcagagtttccaacatccatgcagattatagacatgcactcaccagttttaccgtgtctctctctctctctctctctctcactcatcagttaacagtgctagctctcatgccattcatatatggaggatgagaagtgttctctatatctacacaaggtcacaaaatgcacaattattcaagggagcatcaggtgctacagtatcaccatgctaccatgtggcaccatatatttgatgagtgagggagagacagtaaaactggtgatcatttttgtataaatcgccaaaattcagacgtaacatgtacatcagggatagtacgtatcttcagttttgaagtgtatccaatttcaacaaaatttggagttaggaattgaaatctaaatatctatgttggttttagtattctttgtactcacaagtcacaacagatgaaccattaggaagagcgaaatgctatattcaaatttacagtcgcccaatgtaccgagacaaagcctatgcttcagtaccacaatatgaacaagtccatatatcagtactgaatatcacctagtccatcatcagctcagcaaggcctttgtcctgaagagaattcccatgcatttgtatcctgctgaacatctacaagattcagatgctggtcttctgtccccctcagtgctctattcaaaacttgatccactatatctctgagtccacacatatcaggaaagctcccggtgtctcctaggcctagctaccatggataagcgatagctgacaagtcactggagctactattacactgttacttccattcgagcattagctgacaagtctctgcttctcatctcttgtgatttttcttttataggccaatgaaggtctaacaatttccgttgcattttgaggcgttcatgctttagcttgactagaattttcctgccaatatatatggttttgcattgcatcttgactccacacaactcgcgaccacatggaatgcacttgctcatcaccgcggagctttcttctgttcaccatgtcaccatggctagatgcattcagttttaaattgggagaccggaactgcgtataaatcaaaatattaggcgaaatttatttgaacatttctggccaactcaacctaaccagtagactgtgatctagaggtgcttgtggacattcagttggcagtaaccataccaaatttaattaaatggcatcatatttggacgctttgacacttcatccatcatttttggacaagagctaaatgtgtttcaagtaacatctgtcaagcactggtttgatggcttcatcacatcagctgcgacatcttagagggaactgtttgaactgcatgtaggacacagttaatgctcaagaccttttggtaaattcagggtagcccaatctaacacaagggctcctggtgcctcctagtcctaccacagcaaaagtcagaggagcagcctccatgaacagaactagctatcacccagtgtttgctctacttgtgcttattcatcacaagctattttatagagaggaaagagatcaacatatatatcacacaactacacaaggatgtacttctatttgattacaagttgttagttattcagtgcctatgagaggcatactcatgtatagatgttcagttaagcagttaaccacctttttccttctttttttttcgaaacgaaaatatagcacctacaaggcatgtattcatgtaaattgttcagttagccactttttttcttcaattcttggaatgatgaatcaaaatggactggtcggttgatttgacagttctctgttcatgattcttttttcttttttgcttgaacacatggacatgcaggagtgttcagcttccttggtcacatgaagtgtactctagcaaatgaaataaatcatctgcttgtcttggttccaaggttttacatactctgccttccaaaaaacagagtacagacctcaacgccttgtggcgaacgtcatctcgtcgacgacacataacatgaacacagttcacacataatttatttttaatcactaataaatgttgataaaagggaagtccatattcggtgaataagcagacatatgcagttgtcagagaagacagatggaggcgagatgagatcggactatcctatcatatcaagtcgccactagaccacaaaggagctggttttcccagtacgtactgcactctggggtaactcctcatgatgtttcccttgggttccatggcttataccgagcactccaaaattcgtaaaactctcattgaaaatacagcacttgtgataacgtaactctcgatgcctcccaaccctacatagccacaaaacgaagtaaatgcattttcagtttggtggtatctaaatgattctgaactcactgctatatatcggcatgtttgtcttagcctctaatatctttcatgggccaaaagagattgtatatgatatgcatctgaaatcgaaatgtactacatgtattaactcagcagcagatgcagtcatgtcagattgggcacttcatctgttggggcctatccccactacttcctttgtaagacgttttggggttcaaatagattcatgtatggatccatttgtatgcttcatatatgtgtctaaattcatatggatattaatgtatctagatgacggatggagatgtccaaatgtcttataatgtagaacatagggagtatatatgtttattgaaaaattaccgatctcactataaattaaactgcccatgctgttgtagataaatttcagttcgacccaatgaaattaggtgacagtgttgaacataaccgacaaatttcagtacagttatgaatttaatatcctaggagtcttccggttagattcacaaggtggtggactagctagcctcggttcgaagcatcatcctttctaattttttgatattaggtcgttctctaatatttgtgtttttttagagtgttattttcttagatatgggataacgtaactaaaattccagcttatgcatgatgtgatattttttttatagaaaccgttatacggctaatcaataaaaccacagcagcaacagttattactagcacattacaacagcggagaaactcctggtaacttcaaaatgatccaaagaggatgagtatggtgatgaaaaacaaacttgatctctgtctagcacaaggaacaatacaaagagaggaaacattccacttctgtagtacatgtttgtacattattgcttgcttttcaaagctacattggctcctcctcaatttgacatgctatgagcctgcagtcatcagtgttggcatgttttgctctgtccatgttccattaacttgtctaaaaaattagttgcacattatcagcacaagggctcagaagtcggaactcatgatgtttgaataactcttggacttcttgttaacagattacagctatattgtgcattgttgcaatttacacacggatcatatgagctcttaaaatcaagtattgagcaccttatctttactcatgcttctttgacttctcttttatggaccatgacaccatagtatgtaaggatgtattaatatttgattcaatacagttaactatgaaatgtctacatgttcattgtgcttgtgcatacagcagcaggactagaaatagtatcattcaagaagtagttacaatggcaagagaacaaagaaatgtagtgatgtacgatagttcgaaattcctcagtcgaggatagcatatttttacaaccttgatctttccatgtctgcactctctatagtataagcaggggagttgcactatgacgctgtgggtaggggcctagcttcctgtccaatttcccggaaattgctagagttgctagacaacatttttccaatacctcctaggcctcatggcaaagtgatagaagcagtctccatgacagatgtatatctaactatccatctgttactgctagctagctattcatctcttatagctagctagatatatggaccaagagaggccatgatctatcgattgaaggatgtactatatatttgattccatgtaattatatatgcagcatctataatccagtatcaagttatgtatagttcattgtgcaaccaacatatgcagagtctaccgtatctagcagtaatgctgagcatctcttgaggaatttagctgctaaatgttcatgaaggcattttcctgcaaatatatggcaccttgtcaggccaatgccaaggctgctcaaagcaattaggttcaaagttcagacttcagacttcaaacgtgacaaacttttgattgacgcatcattcattaggaaggagtgtaattttatcatttttgaaaaggtacctagaggtaccatatttctggtgtaaaattcagtacctctaggtactaaatacctcaaggtacaaaaaattttagtgtaaaatttagttacctcaaggtacttttttaaggactataaaattctttcctctaggaaggaaggtgtctggttagtacaaagcacaaaatgaaaaaaaaaattgtgatgacaaactgaataggcatggcattttcatcagtcataagaaataaggttgtttcttcatttcaaggaatgatcaatcaaaattcactggtctgtgttcatgaattgtacttgtgtaagtgaaataaaaacagatttcttggttacacggttttatatactctgtctttcagggacatagtactgtgtgttgtgtgtgcaattaacaaaattcaaaactcaggctggtacatcaatcagtcaacaaaattcacagaagttagctggtacaagactacaagagtaaaatactgcaattccttgaagagaatgaaactaactattttacacatcgatcaagctcgtgggctttcagtttatgacacgagtcaaccacaaattttctacataatccaagctagcatccaattaaccataaagctcatccttgcaatgccatttatcataaaaattcagttgactaccaacaattctctaaataattcaatacatatatcatatccttgcacaccaatgttgtacatggcctttgccagaatgcatatggaatctccaaaaagcacatcctttggacgtgccaatgttccagttcattgatcaaccgccacacgaccgtgtctctaatcaatcgaatctatggctgaataatttgtcaactcgctctattccactaagaagtcccgtgcatgtgtatcctgctgatgatttgaaagaccaaaatgctggtctctagtctcctgcaatgcttcagctcctggtgcaccaaacaaggaagttcctggtgcctcctaggcctaacatagcaatgcactagatctaattttactcttccatctgaaccagcactcaccacagacgactctttatctctcttagcttggagctcctgatttctcttttataagcctaatagagtttgtcggtatggaggtttgggtctttccatgaaatgtactatagcatcgagaaattttaaaaagcggaaaaaatctagaatgtccgatcttgtttcgtattatcgtgtatgcattcaactacattgtagttcaatgcatgtgcacctaccatattgtataaatgagttaagtgtgcctgaatatatgttctgtagagatctgttgtcatgtggacatgagtataagaaacatttttgtttgcatggacatgtatttaaaagataaaaaatgttagtaacagaaaacttgcattaaaaagaactgacactaatcgtattggtgtccaactatagttgctcaaaggtgctggttctatatttttttcatcccgtgaagaagagaaaagaccaataggtactgaatttaaattaaccggcacctatgagctggtacctagctattatgggttttgtagtagtgagtccttccaatgaataactaaacttcgtgctaattgatacaaaaacacagtgaactgttataacaccaatagcccatgagttatttattcatttcacgtcagggtagagaagttatttttttcccttcacatgtgcttctatggaccaacgaagatggttataaagcataaggatcgatgtactttttgattcaaagcagttccatttccaccttcgaagtgttgtatttcagtatgccgctaccatgtgcttgtatactaatatactgatcaacatatttttagtgtattgaaagggtctcattcagtgaagtgtaaaagtttagaagcggtaactagctagcaagtagtttaattatgagcaatcagacacacacttagtggctttgctctggaggagcttaacaactctatcgtgcgctgaaggattacatccagtactgtcttcagcctgtggcagaaaaaggttcccaacgcctcctaggcctagctaccatgctcacacaccattggagttctcttctatatgaccatatgaataatatgagctcgatctctgcctctctgctcttgtgacatctttttgtagggcaatgaagaacagtattatctcttaattgcctgcaaaaagtgtagtccctttgaaaatgatagactgaaagcacggatcatgattcatgaaaaaaatgatcccgggatgcagagtttttattcagcaattagaattttagttggggtttgtcccatcaccttatggcttgattttcatataacaaaaatcattggttctgtgccttatggtggagaccagagatgtaaatcattttcattatctaaaaaaaattcaacaaatgccaaatcaatcacctcaacattaatttttcctgtggaatgcgattatgattattcaaccttttacaataagctaagtgcaggagcattccactggacaactattgactcttgatgtccaacggagactgatgaatgaagatcttgatctttcaacttgagaaccagttttgtaccctatgcctcccaggccaattgttgtccatggcaagaagacaggatctgccaccttgtcttgctcatcctctctatcagatcaatgcctgccatagttctccgatcctcctatctgcacttctttgtggccaaaagagctcaaatgcatgctcccatgatctcacgtacgtactcgacatttgtaccaaattggcatggcaaattcataggatcaaaatttgaggtctacactttgggggtcatgatgttcggtacaatcgaagattcgtagatgtaatagaagagctcatgatgcctcaatcacctgcatgttcttttatggaacaaaaagagaccacaccaccatatgtcaccactaagtgttgaacactcacggccgtcttgttgagccaattaatttagataaaaaaaaggataggcaagaaattagttatgccctcatgtgtcacaaaaaataaaggttcgctgtaggattatagattcatgaatggcgtgatatggcaacatatgtaaaatgttccaacatggtacatggatgacatataaaatgtgggagaatttaggattagttggagaccagtgtgcatcatctctgcagtttacttataacaattcaaggatttccacgatagatgattttatttttcgaaattcctatgaaaatgcttgtgcaaaaattcaaacttctctttggtcccaacactttatatagagtcaaaataataaaatgggatcttggagtcacaactcgcaagcaagttcgaagggttgagcgggaccagggtcagagacacatcaacatgctcgtaaccatgtacttgttcatttacaaactttttatatcattttttagagaattcttctatttagactaaggaagcttgttattgaactcgtatgattttctagagattttttgtatgatatattcatatcacacaaagtggaaaacattaatttgaactacatatgaaaagatcaaggactaacaaaccacatgatttacatgcacatgtcacactgtctggtgcatgccgtttaaaaaaaagaacgaaataagtggaagtcatgtcgatttataagggattcaattaacaataagcagacactgaaatcagctcactctgtcccaaaataaccgcagagagttttactgattggcccaaaatttaatgtgatcagctcaacaatgtgcaaggatatatctcacgtacaggacatggcagttgggatcacctagccattgtagattatgtgcaccaaggagaatgaaatccaacaaaggctagtagtaagcggcggtattgctccatcgcaagagtcaggtttacttggcgatggtaaacctgatgctggattggggggaatggcaactcctttcacctcttgggcagcgccttgcggcatcaccatgtctgtcccgttgtgagcaaacagctcctggtgcatcccaggcctagcatagcaaccgggccactggtctgatccactcttatcatttcactctatcagcttgcagcacttgccacttgggcttttatgtctcatcttatatggagcaaaattggcagcaaggtatttttgtttcgataatggataaaatccagccttttgcttcaacagaagttatatccgcgtagtacaatgtacctggttttaaaatcaaaataaagtatctaaccaaaaataaagagaagacacgttataaagccaccaacataaagggagaaatacaatttattcaacccctgttagtaaatttttgtttaaagttggcgaaaatttagtaaacctttgtgagtatcgatttacgcaggggcggatcctgttgtgcgagatcacccatgtcactgacagatgaattatttgatccctccttgaggacagttactttgcagccaagaagtattctgcacctacctttcatgtaatgttagtatatctctccattgagaggagagatcccagttgatcagcacacgagggtaaaatattaaatctgatgaaaattctgaatatccctaaagaaaaactatgcaggaaagctatcatcacgtcacgtaaaaactgcaccgaatttatcacaccaagttagggatttgatcctaccgaaagtacgtacaccgaccaaatttaataacataagtgtgacaacatatatacacaaaaatcatcaaaaggtgccttcacactgattttggcttctacgcctccaagacggaactgatgaggatatatcttactaaaccttgagttcatgaagcatattgatgttctacattacaccaaattatcttcgaccttccgataaatgtagtttgttgatgctttgtttctaattctgctttttccctttttcttttgggtaataactgattttgtcatttccgcaactcggcattaataagatttgatcgtccaaatccttcaactgacccggcatttttagaacatagttgtgcctcccaagcattcaattgcaggcatgatatgaggctgcaccaaggaaccttctgaatgtgtccaacatttgtattttggcagtgaaatgtctccaattccaatggactaatgtgctcaaacatttcgctgactctaggattttgcaagaactgcaatatgtacgcgtgcaaatttatagttagttactgtaggacggcattcatcaaatcgatctaatttgagcttgtaagctatttttttgactgaaagaaaagagagataatgaggcaagaacttacagtagtgtcacgttgtagggtgagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccaaatccgccgccttcgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccatgcggttttgtacggttaccatcggcttcgtaatctatgagacgatatacgtatgtgcggtaatcgtgtgaaaaccgtggtaaccgtccaccctaccgtggttaccatggcttgaaccgtggtatggtattttttactgtgatatgcatggacatatcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagtctcacgacaagacgaaaactttaggaaggatgttgaggagcgtggtggcacttatgagcatgccggtgggagtggatccgctcagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtagtacgcgaaataggctcggagcatgttgttcaaattatcacttacaatggctctaactacaagaaggcgtgcagactactacggcaagaatacaagacaattgtgtggcaaccttgtgtggcacacacagttaacttgatgcttaaggaggttgggaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacatgtttctccagagtttccttagaagcgagatcttttcatgcaatggatggcttcctctgtcttcatgcaaagcaaatttagtgggactttggaaggtaaatatgcacatgcatgtctatctagtctgtcttggtgggagaacttagaggcagtagtgaattctgtccaacctatgtactcattccttcggtttgctgacgaggacaagaaccccaatttgagtgaggtacttttgagatatcagttgctcaaaatggagtacgacagtctttttgcgaatcaaagggacaagtttgaagcatacatggagatcgtgaacagaaggatgcacaacctaaccaatgagactctcatcaatgccggtaaatattgatcataacataatccacatggcatattatgtaactcttacttaacctgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaattacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggttaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagaacctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttaggttttttctattatttttttcatttttcttatttcagttccaacatatcgcggttaccgtcgtcttaccgcggttaccgtaccaaaccgtgcggttaccgtgtccataccgtggattttgaattcaaaaatttggaaacgaaatttgtgcggtttttcgcggtaactgcacggttaccgcggtaaccaccataccgcggggggtcggtaaccccccccaaaacggtaaggtgaaccctgagggtgagtagtcctgatgcctcctacgccaagaaaacaactcattgtctttgtgaaacaagaaaggttcatcacatgctcttctagcctacaacacttcttctccttcacataatcttccaatgtatgaaccatcaggaccaagccaaagggctgtatatatatttgacttgatgatgatgcaattattcaagccatgggctggggaaagtatgccgaccgatgggatttatgaagataagatcagcgagaatgggtatacaatcgacaataggattaagggggtgtttagatccagcgatgtaaaattttggcgtgttacatcaggtcttatatagggtgtcacatggggtgttcgggtactaataaaaaaactagttacagaatccgtcagtaaatcgtgagatgaatttattaagcctaattaatccgtcattagcaaatgtttactgtagcatcacatcgtcaaatcatggagcaattaggcttaaaagatttgtctcgtaaattagtcacaacatgtgcagttagttatttttttagcctatatttaatactttatgcaggtgttcaaacgttcgatatgacaggttgtaaaatttttacgtgggaactaaacagggcctaaaaccatacaaaagtgaaagtaaaagacaactgaagcaaactgtcaatgctgcagactctcataagtcatagcatcccccctggcctacccgtgtacaagacaacactccaaaggaagattttgcacagctagaatcaacaaattggtaaagtaaaagctcccaatacctgccaaacctaaaaaaaaaagacattgaacaagcagtcacattatcatatggtgtactccaatatgctcttcttcgtcttatcttttatagagaaaaaggtatagcacaataattaaatgcactgtccaggtgaaaattccataggcttttctttggtatggaactagtattgatcaaggcctattagactgcaaattaaatagttgcaaacttcccatgtcgataggatcgaggaatagggtcaagaaacatgatacacaatggccttttacaaggtggggacgaaaatgcccccgtgttctaggccatgggatgacgtccttaggtctatcaaggttcgaccttgtttcttgtgatatttttagctattggctactactcccgaagagctgataatactaatggttttgaataaggacgcggtcttcgaaaaataaatttgaccaccattttctattataatatatatataatatcaataaatataaattttactaaagtactttttaacactaatctatacacattttgttaataatggaaatggattacactattctatacacatggttctatgtttatgacaaacattttcgaaattattcatactcaaatattttaaagtttggcgctgtctctgacggcagtagcctctcatccacatcctgcaacatgtcggtgtagtccccatggatccgcggccatcgccatccgccgtgatcagaaacagcctccggcgaactgatgtcatcaaggaaaaagaaaataaatggcgtataacaaactgttgtgtgttcgttttgatcagctcgtgttgaccagatttccattgacggtatatatatgtttgtgctgattagagagagattaattagtacctgatccctaccatgttcatgtcgatcagtggtgataattggtcgatctctggccagttccgagctgacggtggtaatttttttactttggttgttttttgctttgctcgtgtatgtgctccggtttcttggatggtggtggagagaaagattacagcctttgccgtagcaggctgttcattgcactccccttgtgaaagggcatgtagcctagtagttgcaatgacctgagtagcagcctaaggtcctgagtttaaatctccataggagtgaatttcagattgggttatttgaggactaaattccatattcaataggctaagttcctaatgagcaatgctacacgtactaaatttttcttactaaacttttactaacaatcatctcaaccgtttaatttaagtagatggaagttaaaaaaatctagatgcactcatagcatgacacatcagtgttagtaagaatctagtaagaaaaagttagtacgtatagccttttccgttcctaattaatttaaaaatgatgcatatatccgattggatgtataggcagggtaaaaaaaatacccttctctaaataaaaaaaattgtattatgttatttgagggctaaattccctgtttgataggctaagttcctaattaatttaaaaatgctgcatatatccgattggatgtagaggcagggtaaaaaaaacccttctctaaataaataaaattgtattatgttatttgagggctaaatttcctgttcgataggctaagttcctaattaatttaaaaatgctgcatatatctgattggatgtagaggcagagtaaacaaaaatacccttctctaaataaataaaattgcgctctctcttttcgttcttctgtcttggtggcgagcggcagtggtactgggctccgacgactgctccggacgacactctgccactgagagagatggggaatagtacacaagcaatgtacagttagttactacataggacattctcatctagctaggagaaatccgagattatgccatttgttaaaagtgcgtttcacctcaacgccacttggcaaaagggattcgataaaataccattcgttttacctcaatgccactcggcaaaatgaattcgataaaataccattctcaacctgtgaacagcacgctataatactatctgagaccaaattgtcatccgctcttcctcgtccttcaatattccttccaacgcgtggcaatgctatcgcgtcccagatcgacatggcgtataacctaagcacttacattgcatatgccataatgctgcatcgtataacctttcgaatgagaccaaccttcgtatttcgcctgtgaattgtctacaatggcaatggcacaatgtgctcagaaatttcgcaggcgcgcttggatttggcaggaactgcaatacacaagcaatgtatggttggttactataggacatatattcatctatagttgatctaattcgagcatgtaattagccatcttttggactgaaattaaccaaggagagatgatgacgcgagaacttactccactgttactctgtggggtgagaactcctgatgcctcgtatgccaaccaaattgaagcaagaaatgtactatgaaacaagaaatgctcatctcctatctagatttgaacatttctgttccttcacatgcttttcaatgtatgaactatcaggaccaaggcaacaagggctgtatatatatttgacttgatgaccattttgtaatgttatttcttattcattgtagaacctacctctctatctttatgtcgtgaattattggttttttttagaacatgtcgtgagttattggaggtgtaatatgttcacctcacttggaaggtttgacaaggaaactaaaagttctcatccatcctagcactctagcagggccgtccttaggggtgtgcggccagcgcgcccgcacagggcccccaattttcagggtccccctaagcccaaaacttcaaaactagatatacaactcaataagtaaattggtagcctaactagtctagaaatatgttatttttcttgttgtttcggcttcgattacacgcctttgccggttcgcacagttgcgccggttcgcaatcttgaatcgcctcccactgtggatctcgccaatcgccaatcgcaacgaacaagaggagtaaacgacgcctcacctctttctctcgtacgatcgtgccgcctgacgcctgctgcgcctctgacctaattctttctggtaatttctaatccggtaatccctaatattggattatcattttaggccattctagattgctatgaaatatattacggagaataaattattttcatattatatcattaattaagtttttatccttcaactttccacagggcacccgaatttgacgggacggaggccagtccacacctcgcctcacccctaaacacctaaatcctaatccatccattccaaaatataaatatagtaactattggctatgtatttggacatatcctcatacagatacataacaaaaatcactacactttaacaacaaatcaagtataatttttttttcttttcaatatagctaacatgaatatttgttatgaaactatagatctaaaacaatgtatcacagaattacatatttaacttcaattttatcacacaactacagctttataaactctaaattttatagttattaaataactttatcacaataaaaatgtggttgtgtaataccataccttataaataaatctatagttttgttaaattcgcctctctcttttttttaattgggccaaacaataagactcagtttcacatgggcttgaaatgggccttccgtgtggcccatctaaatagtccatctaaatagaacactcacacaccattcctctctcccaaacaccgccgccgccgccgccgccgccgccgccgacgacgacgaggaggaagatggcggcggcgcagccgccattgccgtggggggacctcccggcggacctgctgggcctcgtgctcctccgcctcccgtccctccccgaccgcgtccgcctccgcgccgtctgccgctcctggcgcgcgggcgccgcgcggggtcgccacccgcggctgcccccgccgctgccgtggctcgccctccgcgacgggggcctcgtcgacctcgacggcgagcccatccgctgccccacccccatcccccgccacggcgtcgtcggccacctcgccgtcgacaacctcgccttcctgatacaccgcgacggcggctgctcccttctgaaccccctctcctcgtctgcttcagcggcgacggcggcgatcacgcctctcccatggctgaacctcgccgccgtggacggagcgatcggccagccgggggtattcatcgggatcggggcctacgtcaacgtgtactccaaatcggtcctctcctcgccgctcgattcgtcgccggatcccctcgtcgccgtcgtcacatcgggcgggaggcacgtcgccgtcgccccttgcaagcggcgaggcgtggtcaccatcgtctccggcctcatggcgccacagattcccggactgaatcctactcggttctccgacattgcgttcttgggtggaaacctctacacgctcaccaatgcagaagggctccttgttcttgatctcggcagcaatggcgtcgacgatccaccgaacgcgtcgcatcgtcggtgcatcgccgatgatcccaaccagcatgagtattacatcgatgggagcactaagaacaagtctttggtgctgagatacctggtgggttccaatggcaggctgttgatggtgaggaggtggatgaactgtcggcagcagtattacgcgggtgacatggacaagacgcggggattcgaggtctttgcggcggtaatctctgatggccatggccagtgggtgaaggtggacagcttgggtgaccaggcaatcttccttagttcagagtgctccaagtctgtcactgctagccaatgtgcagatggaattcagcaagattgtatctacttcatgcataggatctacgacaatccgacgaaagagtgccacggcccatgtgttgatcctcttggtgactctggcgtgtacaacatgagagatgggacaatcaaccttttgcggcccagggcggtgatgtctgagctgcgctggaaacgccagtatctgacttggttcttcccttctgatgagtaatggtaactcctttctaagctgaacatgttgctctggtctggaatattggtatggtcgatatgtagccaactatgcagatgttaaaatccttttcatggatgaacgaatgttgaaagctgtgcaaaatttagaatcactgtgatggctataaattttccttgcaagctatgaaaaatatattgccttcaagcggttaggttaatagttggtgtgcaagaaatggctaaaatttgatgcattgaacattcatcagtcctgaatgaaaatttaagtatgtcttcatctgaaggaaaatgcattgaatgtcctgctgaaatactgatatttagatggcttaacagccctaggaggatcgatctgcatctgtccatgtgttttacattgcctaaaacatttttcttcccgcaataagtgcaacgatgaaaaacatgatcaaaaaaatcatagcgctgtactttcactcccgtagtttcttctgaactattgttcaactggaagcatcatatgctgtaaatagtccagctggaaggcttcaatggaccaaaagggaatgcatatctgcaaataatatctttaccactatacgattccatgcaatcactagtccagaaaatacatgcagtactgttcaattgaaattgagtattattgtcgtcaaattatattgaaaaaccttgatcggcaaaccaaattccagaaaggattttcaaacatcattttagcccctaggcaaaattactgatctcccttaaccaaaaatccttcttatttttcttttctaaataagttcagagctctattggctagacacctctaaaagaggacttctagatgctgatgtccatgcggacatagcagaatgagctgaagccctagcgcccgctaagtccagtacttctgccaacgcccacagccagctgcatgtatggaacattagatctctcagccagatctttacccctaagcggccatatcagcactgcgattgcagttcaatgcaacacctgccacagtcatattcttccctcgtaacagaagaactcctgatgcctcctacgcctacaatagcaacccaattggcctagcgtcatgagcctttcatttatctctctcttgctgtcagcttgtagcacttgtgctcgtttgtctattcttatatgcagcaaaaaggtgagcaggatatcatatatgaatgcacaatctaattcccatgcagttattcatgtttgcagttgagttcagtgtgcatctacagttgcaaccttaatccttttgatggttataccttttctttgcaagatacacaaaataggattgccttcagataatcaggccggcggtcagtgaagaagaaatgggtaggttctaactacaattttttaaaattttgtttcattatgtactggccaaattattaattaatcgtatgtcttaatctaaatgaaaatgtattgaaccttattaattgtctcctttctattcagtccaccgaatgctaggtagctctagaatgttcttagttagttttgaaggataatatggccatttcatggcaagcaagtgattagctaaatatgcatactatggtcaaaagtgataactaaacgtgaacagaggaagtaacaatttgcatggcatttgagatgttcacgctttagctcaaccagaatgttgctatcaacaatctatggcattgcatcgtagctggactcgcaattatgtgaactgtgcgtatcttcttgttttttttttttgggggaaggaatgcaaaagctttgcttttttttattaatagagaaggagaaaacccacaaaagtattatatacatggtctatcataaaaataatagacctgtaaaacagaacaaaagactactctctgaaggggatgatctctgtgattttggtggctcctgtcttgatccacgtctgtgctttttccttaatcttagtgacgaccatggttgttgtggtagctatgtgccagaagatattggcattgcgctcgcactagagcccccaagccgcaaggttttcctcgggacgtggggtatgcgtgatggcttgtaccaccagtcttctacgtttgtgcaatcgaccttcatgaatttggaggtctaggtttgcccatctctggacagaagtccagagtcttctcaggtttggtagaaaaactcctgatgcttctcagacctaccatttggtgtagcactcagcatgaccatgtagactacccaggtctgaactcagaggagagatccttatatagtcttaccttcatagcaaagagaacaaaagaaaaagaaaagaagagaagaggccaatagaaaagaatgctgcaatctggctacatgcatttagtactcaaaatcgggtggacataactgtctataaataagtgttaggcacttaggcctatatcttgcatgatcctgcagatgtattcgtctagttgatctctgcctattgaaccgtactcatctaggtgacacgtccagtctcaacaaggtctctgtatattaaaaagcatccacttctgttcatgatcagaacaacaagtagcagatgattatgcatatgcctgaacaagcactgaaaaagttttggaatcatttgcatataattaatataatttactctgtttcttctttagataatttactctgcttctacgtaggtacagatctgccaaccatattagaagagcatccaacatgccagtaatacatttttcatcaagttatctataaagcagtggcacattatcaggaaaaaaagggctcagaaaaacctttttttaataatccttcggttttttctaatgatggatattacagatattgtgcattcttatatttacacacaggtcaaatgaactcttaaaatagtatagagaaacttcagtcgccattgctaaagataatttatcagtagttctaacaccattggatttaagtaggcaaccatgccatttagtaatatatagaagggtcagttataacacatgaactcctgatgcctcctaagtctaccattgcaaatgtcattggaggcttggagcagcctgcatggactactgttcatgtctcaccggtagctttgcggcacttggttcttcttttacttctcttttatggaccaagacaagtcaccatatatatcttgtagggatgtattgtttggttcaatacagttaagtatgcaatgtatatagtcatgttcattaggtgagctagaaataggactgggctgccagggattaattagctgactaagggcccaactcatttcatgtttacttggtagttggtatatattaaatcaccatatctaatgagaattaaacatttttgctttacacagattttttaatctacgaaatgttgtctaaaatttgttctgccggaagctattctactctaaatttcctggtcgtaactaactttatgtattagtttctaaaaattgataataatacatcgttcaccattttttattctaccttaatttgtcaagattatggaaacagttttggagagctcaagttgggcaatagaccatgaatagatcctagaggtgcttcagcccttgtttagtttccaactttttctttaaatttctaacttttccatcacatcaaaacttttctacacacataaacttccaatttttttcttcaaacttccaattttagtcaaacttccaagtttgtcaatatctggaagatgcttaccaggacataactaaatgtcatcatgttcaggtctttcaactcatgacaaagtagtgtgaaatgcaccccatgagctggccacaagtgacaaactgccagtagaactcccgatgccttctatgcctatgatttgccaggaaatgctggagctatttgagctttaacatccatatgaacctgcactgagcaccaatcctcagattttgtttcaatccttttatgggccaaataaaatattgtgatgagatatactatctgatgatctgatctttcttaagaagaaaggccagaagttctggtattacaagatggtcctcttgattgtccaatagggggaagatataggggcaactgcctgaacaaagaaataaaggagacttcgggaataattttattgtggttcaatgtgcacctactagtttaccagactacatactgaatgtatgcatgccccactatataaaaaatttcagtgggaagccctaaatgccccatggttaattaacttcacttgctagatggtgattaattaaactttcagtgccttcagggccatctgaatgaacattaattagaaggtcgagataaaattaggtgcactgaaacatggatatagggacggtccttatcttcaagaattttttgaataattgtctagtggaaatacaaaatattcagaagatgtatggatatatacttgttgcacctagacatgccagatcgaaatcgccacttagactcttaacagtggaatattattatgatcattcaacctgttacaatcaactagttagtctataaagcattccactagccagtatgtttaagcatagtaatttacagtccttgaaaaccaccaagaggcatcaaaatgtataatttttagtacaaattttgatacctcctaatgctgtaggtaccaagtgatactaaatgttataataaaaaaatgtggtaccttccggtacctttttgattgtaatttaaatcactcttaagcaactattgactcaagatcaccaatgcaaaatgcgcgaggcaatgctacaggttgttgtagcgctctgcttaacaggctagttgttgtctatagctagaagctggatctgccactttggcgttgctcatcatctctaccaaaggcacttttgctgtagatcttctcatttatatagttatttgagagcagaaaagatcacattctcccatgctctcacatactcaatatatatgtacccaattgaaattcatccgttcaagagagcgatcttcaccgatcagtggcgaacccaaaataaaaatatttactgcgttcttttgcagtagttcccaacttccttctctctttttccgcgcacacacttttcaaactactaaatggtgtgtgtttttgcaaaaagtttccatacaaaaattgcttaaaaaatcatgttgatctattttttttaaaaaaaattagctaatacttaattaatcacgcgctaatggaccgctcggttttccatgcaaaggagatgggttcccaaccccctccaacgaacacatcctaaattactaataatctctgataaactgattaatacagtataaattagctagagttgattaattacccagtatcctattgccccaagaattgttggaaatatggtcatatattggcatattttaatctaaaatgttaagacaataatcatggcataaacagtgtggggtgatctagtgacaacatgtagcataaccagtagcatgctaaaggtatcatacgcatcatgaacgtcatgaacatgaacatagcaagaacgcaattgacttgcgactaacaggactaacagcgctatgaacgaatgggttaacagcaggagaaggatataccctgagaatggccctccgctggattgtgaggcagaattgcctccgttggtgttgacgttcgcggctccagctccaggcgcgccatctccggctctagctccaggcgcgccatctccggctccagctccaggcgcgccatctccgactccagctctagcagcagcggcggctccaggcgcagacatggtggacgagcagtcgtatgggaagcactccccaaaaacctgatcacccgcctacccggtgcagatctcaggcgaaggtgtggttccggaggccctgctccttccgatctctcgtgtgcgcaagcaatcagaagcgaggaggcgagagcagcacaggcgcgaaggaggaagaactaacacccgggaaagaagcaagcagttcattctgatcggactagcggcctccttctatagcaggagagaggcagtcgtgggaacatgggcgcaaaagaatagcgacatgatgtgacgtgacgcacgcccgccagccacgcccacgagatcagaagcgaggaggcgagagcagcacaggcgcggaggaggaagaactaacacccaggaaggaaagaagcaagcagttcatgcggaggaggaagaactaacaccattctgatcggactagcggcctccttctatagcaggagagaggcagtcgtgggaacgtgggatcgtgggcgctattctgatcggactagcggcctccttctatagcaggagagaggcagtcgtgggaacgtgggatcgtgggcgcaaaagaatagcgacgtgacgcacgcccgccccgccccgcccacggcctcggcccggcgcgcgcgcgcgcgtggctttccaactcccacctcaaccggttaacaaggagcctccaataactccctatttaggttgagatactcctcgcttaaatcctgaggtggtattattatccttaacacttattatgggcctttgagatttaataggataaattgggcctagcccaattattctaataagaattactatgtggaaacgaacatgttggtaaccccgccttcttatagaatcaaaggccaccaaaagtaacagaagattagctcctgatgcctcataggcctaccacaacaaaagtcaccaggaatcatctccatgaactgactactaattcctctcgtcccttgcagcacttgtgctcatttcttgatgtgctcttttatagacaaaaaggaaaaaaatatcatcatattacacaaggatgtactatttcatcccatgcaattaattacttattcaatatcatgcactaatattaatttcagttgttcattgatcacttcttttttttttgttgcactacgcatgctagtggagcccacgagcagacagggatatcggatcgcaacaaaacatattgtccgtgcagaaaagatggcttttttttacccaaattaattgccaatttaacgttcctctggaaattaatgcaatatttgacaccttgtaattatgtatcactgaagtgttttgcaaccttgacagccaccagattgcatatttctgctgccgtttaattacttagaacaactcaaggttttccacggtgattttttttctcaaaattcctacgaaaatgcatgcacgaaaacacactctgtttgtgtacttttgttttccattgcctagttaaaacacggatgtctctctctctcccttttttttcatattgtaattaatcagtacaaccaagaaaaacatgatcaaatcatagctagttgcatgcctgtattttgtgtttcccatagtttcttctatggtattgttcaattggaagtgccatatgcagtaatctgtcaagcaggaaggctttcagggactaaaagacatctgcgatcgatctgtgctactctatgattccatgatttataactagtccaaatatgtttttagataatgtactagtccaaatacatgttgtatcgctcaattgaaagtgattagtattgtcttcaaattacatcgaaaaaacatcatcatcgatcaaaccaaaattctgaacagattcacaggcatcatagattttgatgggcaaaattctgatcaaaattcttcacccatatatctgtacgtccatagatttgatcaaaattcgatctatatatggacgtaaaaatttgatccatcgtacattttgcccatcaaaattcttaaccaaaattcataggcatgaggatttttatctatgggcaaaaggtttactatacatcaaagagtacatcaggacgcaaacctttatgcgtcttcacggcagcatccatgtatgaaacattagatgaggcgacctgtgggcaggcggacgacggcttgaaccgaccgatttcgacgaacgagtcgtccaagtgggtcgagatggttgatatcattttgctaggcggcttgaacctggatttggatttaacatgaatattcctctaaatggaccatcccatcctatccatctccaaatcaaacaccaagaaaagtgcgttcgtcctatcctcatccatcccacccctccaactaaacacaacatcagtcattccatcactgttttgtaccgctgtcaacactgctctggcagttcaatgcagcacctggcacagaggtaatttcgacgagtaatagaagaattctcgatgcctcataagcctaccattgcaacccaatggcctagccctcatgactctttcacctccccccccctcttttcttgtagctttagatatgtgctcgttcaactattcttatatggagcaggaaaaaatgaaggaaggggagatataatttatgaataatgaataatcctattttcagtgcccccttattcaagtttgcagctaagctcattgtgcatgtacaagt

SEQ ID NO: 4218 - DNA, 14192 bp, Oryza sativa
tatgtttccttcaggtaatcaggtcaacagtaggtgaggaggaaattaattggctattatttgactagtgttctttaattttgtttgattatgtattggccaagttaatgcatatcaaggaaaatgcagtgaagcttgttaaatacgtgatccgaattttgagcccacaatatattcggattaaaagctgatgtttttgtttgcttaaccgccatgaaatgtacatttgtttgtctttttgcccaaactattttttctccatctgctttcaagcaaaacgggtctattaattatttgctcttcttgtaatcggtagaatgtacaacgaagaaaaacatggctaaatcatggcaagcggtgtttatcatcccttggcgtttcttttgataaatcgttcaccttgaagagtactctctccagtaggtaggatgcccagcatcctcaggtacaagaacactcagaagaccaaactgtgcagtctatccaaaattcatccccatttcctagatgaatttgtcgaaaaccgtaccctgtcgaatgtaacatgacaattacaatcaccagggacaggcagaagtagcatgtctgcaaggccagcaataagaatgagctgcagcatgtctagcatttgtttggtcctctaaagtagtaaccgaacaactcccggagcctcccatgcctagcatatagccacccactggcctggtcctcaactctctagtacatcactctttcatttctatctgtcaattagtagcacttgtgcccgttcatatcaccttatatggagcaaaaacagattgctttcaggtcagtagttggtgaggaagaaattaccaggacctgaaaaaaaatatttgttttttttctattctgtaatagcagccaagtttgttgttttcagagtttcagtaatttgttgttcaattggaagagccatatgcagtaatctgcaagggtgtaaataccataaatctgcaggtttcatctctttcgtcatggaccagaagagcgcatatatcttcagtagatttttactgctatatgatcgatgcaattataagtagtccaacaagtaagtatatacggtattgttcaattgggcaccttctaggttaaagttgaaagtgagtcgtattgttgtcaaatctatctatctattatatactaaaagtccattaaacctgctacaaacgctcctaagctgccaagtggcgcttctaaaaacactcttaggttgccacgtggcagtttataatctcacaatcgattttcatttaaattgatgggcccattagattagatctattgcttcgtcttaatattctctgtagatatgggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaataaacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaaaatacaaagacaaatacaaatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctataatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgataaaaaaagctataaaacaaaataaacatttagatatactgttcccttaagataagtatgttataaatggtctttttaaaataggatttgctatactataaaaaatataatttatcactccacaaatatggtcatgtggcgttttagcaagcactcttagaatgccatgtggtactctataattttgttgtcaaatttcattcaaaatagtggacctattattttggattatttgattagcccgcttccttttaatctcatctatacgagcgaaaccatttagtgatgttctattgaaaaaagcaaagaaacatacgaacacatgataataaagctataaagcccaaataatactaatataagttggtagaaccatcgaaaaaatatagacgattttaaaactaggattttctatacgatagaataaaatttattactccaaaaataaaaatgcaagttaaactagatcaatataaaaaaaattaaatgtgtttacacgcaattttttttgattatttttaaattttatagtcaacttataaggtgtattcaaatcttgataacataacatagttatattataactaaatacattggagctgacatataataagtaatatcataatatttttttaaataatttaggcgtcatataatagttaatgtcatgataatcttcgaaataatttcacatcataatttatggtcaaatatcacttaacaattatataacactaactgaaatctacatgcatgaaaaatgaaacaacattatgttttttaattatatctgatttaattttagtttgtgtgagattaagattctcaaagttttttttttatttttcataactattggattggtatgctcaggcaatgatcttgctataatacgaccccttaatctatcacaagaattatggtcatatacgtttttctttgccaaataggtttgataacaaatgaacaatcctataacatgagcatgaaactattcatgatatattttcttatagtagaggaattataatataatggtcataagtgataattgatgaatgtaatgccataaaccacagtgacataactataagtgcacctcaacaaattagttattataaataattttgggaaataaataaaattttagaattagtaaaggtgtctcatgcaattatggacaataggtgatgaaaacaaacaagatgctaaaatatagatctttgtcaaaatataaacaatgaaataatactctgaacattgtcacggtcacgtgtttgtttagctatatatatttttagtgatcaacttcactcatttctaaagatgacattgtatttgtaccataaaaattaagcagctttgattaacaccataaacaaaattgtgtctaaataaaacataaagaaactatattttatgggaataactgaataactatttacatcacatccatcttctctttgtttccctagagggcaccgagcatggataccacaactatagcgtggggcacacatatggttgacttgaggcaggctcagtggaggccaccattgataatagtgctcaacttcctacttactggtgcaatcgtctttaaggatgccgataatgaactaggattaattcaaattgtgctccacactggttgtgagactgtgagaggcacgactatgtcaacccatgcttgaaggaatcttgatggttccccccattagagggacatgtctattttttaacggtgctatcctaataaccaatagaagcattagttttagaatatttatcagtagatttagaaataagtgttggcataaacatttaggtacatagttgaaataatgttttatgtattaatgatgtattagacttattttggtggtttagatggagttccatttattaaaatcatatctatcttttaagaacaatgataataaataatggtgataatagcagagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttacataaaaaaaatatcatcatcaaacccaaatccttttattttatttttattttgaagactaacccaaatcatgaaaggatttccaaacataccattttcgctcagataattttttcctaaatagtaatatgtcaagtgcaatgcatcagaaaccacattgtgctctaattaatctatcaaaaggatatcacaacgatattgaagtccactccttgcttcggcatcctctccactgtgtacttcttgtgattgtgatgttaaatcgtggtgatggactgacggtcaaattcagtgtcatgctgcatggttggagcggcatcagaatccatgcacggaacaatggtcttcaagatatcacagccctgttttcccacatcaccaggtatctgaacaatgtcattgcagttcaatgcagcaactgctgttgcggtgtttcgccgaagtagaagaactcccgatgtctcctaggcctaccatagcaacccatgatgctcataacaataagcgatcttattcactctctgtcagcttgtagcacttatgcttgttcatcgatatctcattttgtaaggagcaaaaaggggagtgagatatcatatatatgattcgaagttgtattcaatgtgcatctatgaattagtagcacttgtgcagttgtgctcgtgcatatcaccttatatggagaaaaatatattgttttctggtctgtagttggtgaggaagaaatgaccaggacctgaaaaaaaatcttatttctttttctattcttagtaccagccaagtttgttgtcttcagagattctctaattgttgtttaattggaagcgccatatgcagtaatctggaagggtgtttactactgtaattctgcaggttcctttttttttttctcaaacatgaatgttcaattgggcaccttctaggctaagataaaaagtgagtcatattggtttcaaattacataaaaaaccaccatgatcaaacccaaattctttatttatttgaagactaacccaaatcatgaaaagattttcgaacatatcattttcgttcagatattctttttcctaaatagtaatatgtggagtgcagcgcagcagaaacctcgttgtgctcgaatctataaaaaacacatcaccaccatagtgaactccactcctggctgcagtgtctgcaccacttcttgtgtttgtggaaccatgttttcgcaagcacctgctgatatctcagcagtgtctttgcagttcaatgcagcatctaccagtatagaatttgacataagtaacagaactcctgatggctcctaggcctaccatagcaacccacatgatgctcatcacaataagctctttcgctctttaccagcttgtgtagcacttctacttgttctttgttcacctcatcttataaggagcaaaaaatgggagcaagatatcatattatgaatgcataaactgtttccatgcaggtaaaattgtcaaatctgaagaagtaaatgatcacaagaaattttccttaccaaatattaaccactcttattcacaaaaaaataataataattaaccacttgcttagcaacccatgcaagaaatggcatatcatcaacctgaccgtaaacatgcacctggttatataactttacacaatttttgaagaattccttgggccaaaagggagaaaaaaatagttctatattctaagagatttgcttcggtctagcaaaaagtactttggggtactgatacctcacgataccaaatcgtttccgatcgttggatctagctgggtaagatgggcactattagatccaatgatcggaaatgatttggtacctcacagtagctagacatgatggacattgttagatccaacgatcggaaataatttgatatcgtgaggtactagtatctcgaggtactttttattgaaccggagcaaatctcttctaattagaaataagactaaaaacctactccttgcattccaaaatataacaactttagtgccttcaagatttgtcccaaaataaacaacctcttcttcaccaatattcttttaccaaccaatcacaaccctccaccattcaatttttcctaactttacttcttatccaatcacactcttctcccatttaattctaccaactttcttaataactgtgtccgacccctaaatttccttatattctgagacaaagatagtacaagattttacgtgaacacgtgaagctaagtgactggaactggaatttgagtttggaatcgataccatatgcacctgatctcagctgaacaaattaagtgcaaattctgaaaatctgcaacgggtccaagaagagagtgcggaaattgctagcaactcaacagagaccgagactgagacaatccagtatgttgacgctttttcgtgatagtgttgccattgcttatcaaccaaaggaactccagcatggggcacacagtggcagtgaaatgcaggcatccaacttgattgctatgtgagtacatcaagaaatggataacaaccagaaactccgcttaacttttgattgataagtacatgtacatgaagaacttcatcagtacagcatgtcaagaaaaggagtaagtcatgcctttatgcagatgaatatgaggaaggccaaccagaaacaaaaggatgtgacccttcataagttcccgttgtggatggactcacggaattacaactcctgatgcctcctaggccgaccatagctacccattgctttgtcttttgcctccaggaaagggcttatatatttcattctctcttaaacaacatttgttcatttctcagttagggactctgttatccttatatgtgtatctgcgtgtataggtttatgatcctttatctccatgtatatatagtatttgatctgatgcaatcactcaacattattgttccacttcaatgcaaagacaacaatagtgtggagaactgaaggggattcaaattaaatgatcaaatcaacagcttcaggaatagcatgaaggatcagtagataaaggatattacacaaaattgagcataagttcatacattgatataattgaccgtacattaattacaattctttaaaattgtttaacacataaaagtactaactgttcaatagtattgaagcagtgatgcatgatgcaagcgagccatacatgtatgatttagtttagccacttcaattaagttgttgtgaactgaaagcagcgagtcaatccgtatagcctagctaacaatcaatgagagtcatcatgttaaattgtagatctttgatcagattagcttgacaagcaacaattaattgggttagggtacggtggaacacacgccggcaaccacctcgttcgttgaatccatctggcctgctacgtcaggaaatgccctttctcagcttggatgttcctacgaactgcggtattcttgagccagagcagccagctgatggtggaacagaaatggcaccatcacatgctgcgggtctccttgacgaggatcttggtgacaccggcaccgcgtgacatgacaactcctgatgcctcccaaggccagcaaccgacgctatagctgtcttgagtgggcactattccatatatgctccttgaaatgttcctcatcttagaaatgtttctgctagaacttgtttgaagaacttgaagatgacgttcataacatgaagtgagaaagccaagattttctctcctctcgagtaatttaccgtccttgagaaagacggattgtgccattatatcttctcatacatatatatgtttctaattccacatcatcatgtaattaaattaatcatgatatgagctatgattctctcttagtccaaattgccttggcgagggatctcatcgacatgcatgcctgttgtcgttatatttgtaaaacacacctcttccttaataaaactggctagcattcttttttgagggaacaggcaaggagctcctacaatttcagtatagaagaagagagttgatgcaatttataaggaaaaccagacccgaaaaccttaataatggcataggaaaaccggcgaaaaccctgacattgacataccgaacctaagaacaacagtccaacaaggaaaaaaactactaaaacgaagcctgcaagaaggttacgtcgacagaataacgacatcgtccgatccaaacgaatctaaggtttacacttggagaattcccttgaagtacagttgaacgagaactccaatagcaacgccttcaagaaggttaacggtgcccaacggcatcaccgttgctagccccggcaagcagagcaaggttttcaccttagagtccccttctaccatagcaaccacaacagaagccaccaaatgccacctgcacaccgaaggcacttgcactattcaaatcacctgcacaacgaccggactggaccgagcggcgaagcagaactgatggctccaccagacagccacacaggtgacacaaagatgatacaatccaattgtgcccacccctagtctctgcataaaatggacacatccaaaaaagaaccaggtaaaacctcatcccatgcacaaaagtttgacagaaacataaatattagtggctaacaattcgtagactaaaccgtcactcatgctcctgggtaaaagaactcctattccacctggtccaaccatcgtgaagcaccgcaatagtatcccgaagtcctggtgtgagtagataagttgggggctttgatcactagcggttctatcctcgttccatgtggttgtcgttgtcaccgatttgatggatccatctcaatagggattctctcccgctcgttttctgcaattgtgcagccactgtaggttgcaactattgttgtcagtcgcacgacctccatatctgaaccaatttgagcgagaactagtttcaggtgaaatggtgaggcaacaacaacatagctttgaagcaatcagatgatttctcattccgatgcctcctattcctttctttttgttgagctggtcgaaggaggtcaaccaatttcattaagtttagggaaaaacaaggggaagtgatgttggtccccttggggcccaatttgtcggcatccattacaaaaaaataacattttttccaaatgtccaaaacctatttttgcgtgtggttgagccactcgtttgcctgaaagtgtctgcgaaaatttctatttttccatgcaggcgccccgcacgtggaaatccgatttccgcatgcgggtgcttatgtcatatgcatgcaaaaattaaatccaaaaaaaacccaaatatcgaagtcctagctcggtgtggtccgccgccgctggatccgcacggaggagtgccccgtgttcgctcctcgcttcccgctgggctcctcccaccgccgccgccagatccgcgtgggggatagccccgccgctaccaccgtcgcccctggcctcctctgctgggtagtggagggctgtcccccacacgtcgacgggtaaaagaggtccgtctgggaaaatagacttattttcgcatcctttaagaggtctgcttgcgaaaatagattttttgcatgcggggcaaggagacgtatgtgaaaatggaggtcaatttttgctggcgcgaccagttacggtccacctgcaaactataagggtcctcgtacaatatttttttctgtagtaatgatcttattgtagttgtatttgtaaaatgcctcctatatattccaattattctgctggtagcatcatcggaggatggacatggcagacaccacccagttgctggcttgctgctggcctgatgataacaaggaaagaagccaaggggttcggagattaaaacaccggaccgtcgttgtccacagtcagtttacttttggctagcagtggcttccactcctaaaaattggctaggaaatataatgcttccttttttctgatatgtgctggctgaatttatgtgttcaatttatcctaaaatttgaatgagacattggggtgagatggtatcctacaggtcaaattaaagcagtcactggtagtatagcagtcaaattgttgggcatgcagcattcagcatatgatctactagttccaaagacaaactggaaaccaaaacagtaatcatgtctactataactctgaagggaaaattgaatcataagagttctcagggcctcccaggcgtaccatacccacggtaagaactcaattctttccatatatacatggttatactctctgatctttccttgtcaaatgagaaaataaatttgtaagatcgaatcataagaactaagccaaccagaggggggtgaatggttggtatacccaaaaatcaagaacttttagcggaaataaaaattaccctcgaaatcgatggatcgcggtctgaccgaagtagatgcaccggtctgaccgcctaaaaaccaccggtctgaccgcctgatcagctactgtcgcctgaagccgccgccggtctgaccgcccttacgccgccggtcggaccgccgcgatgctgccggtctgaccgccggagagatgccggttagaccgccagaacccggtgaaacacaaatcgaagaactctcaaagtagatgacaactttattgcttttctctgtgtttacaaagtgcaccaacagtactccttacaaaaatctcaactaaaatcgaaaccctaactaaactagcaactcaattgctaagcgataccgggaagcctcacgctccccctctatttatacccgaggtaggcagcctaaaaccacgaaccaaactcatactaagaatcctaaacaccttaggaaaacctctagtacaagaaagaaactttacataaccaatcgtaccaaatttggactccttccaaatccgactccgcatcccatacacacacaatacctccatcgtatgccatatggaatctccatcaaccacgtgcatcaactctaaccttagtatcccgcatgatatctgaccaccacggacatcgtcttaccaccaagccgactcccggtccatcaccacaaatactctcccgaggcatcgagtcacctacacatgaaacaaacaaagaaaccatattacgagaccaagctatctccaacttgactcattagtagcaaacaacagtattacatacatatagtatccatctagaagccataaccatgaaataatcacggatatccaaagaaacaacccgaaaccgaaaccgacacagcgtcagccggtcagaccgcgggccggccggtctgaccgctcacaaagcgccggtctgaccggcaaccaccgcctggtctgaccggtcccgacaaaccagtaaaccctgttcatctcctcaaaattgattatctccaaaaccacttcgacaataatctccaaatatcaaaaccgataatcacagatgccaattgttcatcacataataagaatcaaaacacacgttgatctctcttcaggaattgtacatggcaaacacctgttgctgctgctggtctgacgataagaacgagagaacatgcagcagcagcaggcaaaaggggccgggctttaaaactccgaaccccttgacctcagcaactttgtgacctacatgtgccatcgacctgcagatgattcaacttcaaagggattataatatgcttcatgtctgagatttgaaggtagccactctttaagccagagtttgactgaaactaatccaaattgttgatgcagcagctgacttctgaagaaaccatacgatttttgatgcctcctaggccaaacgttacacccagagaattgatcaaattatatattatagactataagtacagcatactctcctttttatcaattcaggatctgctgatcttgaagaaagttacatctctgaaggtgaagaaactggttgctagcatcataacaagaacaataatatattgtcactgaaacactagaggtaaataaaaaattcctcccggccggcgtatgtaattctccatataactatcccttgcaccaccggagaatacacccgggtgagttttgcaccgtcagataatacttcaacgatccagattgatgtatgcccccacccctgaatgcaggctagtgtccagtgcaaaagctgctcatctctgcccccctgaagcagtgagggggaaaagtattttatggcacctaggtgtatgcttacggttaaaatagttatataaaaattttataaaatttgataagttaggttacaataatataagatactacacaaaacatgcaagtcgaagcagcgtgaaaccagatagcatagtacagcacctgctgcaaccgccttccttgctgcacacagccaccaacagtgattatctcacgcttgtctaaattgatttgcagccactgaagattacaactgttagtgaccatcacacatccaccacggagtgctgcctaagccagattttggctcaaaccaaattgaagtcgctgaggcacaacaacttgaattcaaaacattcgtacatttcccaatgcctcctaggccaagctgctgtgtttgttgtgaagtggcttccctctccttgaggcattgttcatctagatctcactactgttagcatttctttgtgctccatagcttgctcatcagctcatggatagatgcgtatgtagactagaaggatatatatatttatatatgatttgatatttgccacaagaaaaatgtgttagtcctgatgtactcgttgttggggctctagcactctagcacatagagatttctgttgagctctatggactgatagtagtcactaagatccatgtttctgtcaaacttctgtgcttgggagaggtttctagttgtttctatctttttttttaggatgttgcattatatatgtagaggccggggttgggctcagttggcttgtatcattttggtgtaattgactacgtttgaataaagcatccattatctaaaaaaaattaatgttctagcttaattggacaaattcatctgaaaacaattacgatttggttaaggaagttcggtattgttgtataggggctaaatgatgtctgtgaatcggctcagattttcggtttgatgatcatgtttttttcaatataatttgaaaacagtactgttcactttaaattgaacaatgcaacatggagccaggcaactcagtggattaagtttgtcatcagattgtactaaatatctaaattccacacgattatttttttagtagatgcagtcattatcctgttcaattgggcaactagcaggctataactgacaagcaagcatgatgataagaatggaacaaaattgagcaggcagcagtcaagggagtcgaagatcaaaacaccggtcccaattgtccacattcaatttactttttgtctagcagtggcctccactcctaagaattggctaggaaattgatgctttcatttttatgatttgtactggcttaatttatgtgttgatttagtcagaaatctgaatgaatcattggggggtaggatggtattacagtcaactttaaggacttgttcagtagctggtaatagtaggatcagatgtgatttttttcttgggactggcagcaatatagaatagtgtatttggcaaaattctgaaaataaggtacccttagaaaaataaatgaagtgaacatcctgctggtgcatattgtagaagatgcagaaaaaaacatgaatactagtactccctccgtcccaaaaaaaaatccaatcctgggtttg

SEQ ID NO: 4219 - DNA, 32883 bp, Oryza sativa
  unsure (1)..(32883): unsure at all n locations
cccaggattgggttttttttgggatggagggagtatgtgatttcaggcagaccttaattattgtgttcagcattcaacataataaaatgaatcatgagaactctcagcgcctcccaggcggcatagcacatgcaccttaccgctcagtgcctcagccaccgtcatatttccaatgtcatatttcccgtttggtttggtctgttattcgaatggttttaaatttaaaacctcctcgaaatgtaactcatatgtttgagtattggcttttatgtgtttctaaagacatgagaatctgcttttgatgagcgcagcagctctttgttggtccatttggctaagcaggaatggagtattgtttggtaacaaaatgttgtcttctcctttgcaggttattactttagttacccggtggctatgcacctggactatccttcacaaaccgggacttcggaatactattgcgctggtatcacgacgtttggaccaggtggcgcagagttttttaaccaggagcatggatggcagtctagtctacggattgatagctactaattttatgtttccttcacactcctgtgcttgggatgaggttgtttcttttatggttcctttttggctgtgtgtatttcgtgcggaggccggaggtgagcttagttggattgtatcatctggtgtaattgactgagtcttaataaagcttccattatctaaaaaagtgcctcaacaactgcttaagccagatattggcttaaactaatgcaagactgtcagggctttgcccaacaatgtattttcattttaaaaataaaatatttacaagaagttaaaatacatagtggatccaaaattttacaaagtttgtaaccaatcaacaactaactntgcttcagggatctttattctgcatatatgcaaaaaaaaaaccttatttcataaattgagccgtctaagactggaaagtgggcagaaacattatgaaaaataagcccattcctctgttttcaaatatgccaagatgccatgaagaagatttctagaaaacctttttgcccaaacctcaacttgctaaggcaaccatctgcaagaaatcacgattggaattccaaataattcgcaggtgttgccaacatttggtgttgaaaagtaatgcaaattgttgatgcaacatcttacaactgaagaaaccatacgatctccgatgcctcctaggccaatcttcacagaatcgttcatcttgatctatcttctgtaccattcgtcttttgtggtcgtttctttgctcattcatcaagttatatattatagactatcagtacaacgtactgcactatttagtacaggatctgccactactacaaaactggtcttttgtggcggccaaaacacattttcgctgacggccacaggcaccgccagaaagcaaaggccagtaaagataaaacatcttcgctgacagcgaccaatcgctagagaagagatgttttcgctgtcggccagcttaagacagatgctagcgaaaattatcttcactggcggcagccatacgaggaccgctattgacaattgaattttgctggcggctgtgttaagccggccgccagcgataatcgattttgaggcaaaaaattgaaataaccacgtgcagttaccctttaactgccagcaaaaaaaaataatccacattcaaaaacattgatgcattttcaatttttaaatccacatcaagagatctaattcaattcaaatccagatttacatcaacatgtaaacatcaatttcacacaccatccaacagtccaaacatctacatcgatttctcacaacattttcaacattcaaacatcaacacatagacatcggtcatcgtcgtcgccagcgaccttggaggttgctgttgccgccatgtaacaccctgaaaattcctgataataaaaatcactaaaatttcaaactttttaaaacttttgcatcatgttggttgttatgattcctattgcttgccaaaccataaatgatcacaagaaaagaactacatttaagcaatagatatgatttacgagaatatatttaatcctacaaataattatgcacaagatattaaaatcaaataaaagaaaagttattattaacctattttatcaaatattaaaatatttgaataatgtaggtgggtgccataatatgagtacacatgaaatgatgattattcaaataaattgagctctctgtatatataatagaattatgggagtattaattcgatatgtagatcgatattacaccaagttcctaattgcatttagggattgaaatttaatatattaaacccctccatataaactaacatataaataaattgaactaatgtgctattgtgttaataacggtctcattagaaaattatagaatctttaataaaccttaaatattggacaatattaaattttgggcaaattcacatttgaacacttaatacggtcacccaaatgcttaggagtaaatacaaatttaatttacaacttttctcaatttataaatcaaccaaaaccctaaaagaagaaaaataggaaaactttgaaaaatatataataataataagaatatgttcaatattaaatttgaatataaatttcgatggaataacttagacttggtgtattttacgttgtgacaaaattagtggcaatagtatattttttctaattgcaaaataccttctaaaaacaaaaatggccggctagcactgttcattagcccccctaggtgttcgatttggttcctagccatcctagccctcttcctccgcactgccgctgccgcgtcatgtcgcgtcgccgtcgccgcgccgtctccaacccgccgcgtactgtcgccgtcgccgtcggctgcgccgcgctaagccccgtgcgccgtcgcgtcgtcatcaccgtcgcccgtgctgccgcatgttgccgtcgcccgtcgcgtcgccctcgagccccgcgcccccacaccgagtcgtgcgcgtcgcgtcgccatcacccgtcgtgtcgctctcgagccccgcacgccatcatgtcgccctcaagccccgcgcgccatcatgtcgtcctcgagccccacgcgccatcatgtcacccttgagccccgcgcgccatcatgtcgtcctcgagccccgcgcgccatcatatcgtcctcgagccccgtgcgccatccgtcgcgtcgaccattaagccacccttcccacaccctataaatatcccctcccatctcccttcttccccacaccctcttggctgccatcacaaggccccaagagcccccgagctcgtcctcccctctcagccactcctcctcccttctacacatttcatcgaacaccttgtgggcgtgctgcatcttcttctctactccacggccgcgacatcgaacttcgtcgttcctccacccctcggtaagtcctcactcctctggcctctcctagttccgtagaaactagagccccctttaatttcgccaattagcaaccgaagccgtgccggttcggccgccgttccaccgccggcgagctcgccgtggacaagccatcctggagctcctcctctccatctaactagcaaaatggaatccccatacgccgtagatgctcaagccctcaccaatttggtcggaaaccctccccatcgccctagcacctagccacacgtgcccagccatggtggccatgctgtgccactcgcccccgcgccgtcctgcgccgtggcagccggcgggagatcgccggagccttgccgcacccttccctggccgccgtcgggtcgccctcggccggccttgccgtgcgcgtcgtgtttcccctgctgctcccgctcggtcgggaggaagaaggagacggaggaaggagaagaccatccgagccactgacaggccgggccctctccttgcttttccctaagaaaattaattcagtagaaaaagaaaaggaattctgggtcccacctgttggtcactagggttatggattagattacggattaaaaaaaatcatttatgaacggtagccttttacaatttttcggatttattccaatttgaatctttaaactagcgtaacttattcgttttaactccgattcgagtgaaacttgaacctaaattcatctaaattcataagctttccaatggtatacaattaactgtttaataaaatatatttataattataaattaattaatatcaaatgattagataatagttaacctaaatagtgtgccaataaataaaaatggatattgtacagtagaataattatctttaatatgttttgtcactgtagcaaccacataaattaattataatcaatgtttgaaattaatggatatataggaaaatattagtgccatttattaatctatgtccaaatataattaaaacccatgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtaggagaggtgagcaacccttagttaaccaagcagtaaatagaaactattaaaataaatgattcaatatattaagatattatgcacacatatattgtacatcccattatagatatatggtatcgtattaatttgcttgttgcatatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccagtaacagaacctctagtgtataaccgttctatttagatagatgcatgtgtaaccataatccttccttagccattagctagactgaaccaccatgtagatagatgcatgtgtaaccataatccttccttagccattagctagactgaaccaccatgacaacagaaagactaagaaaccttagctcttagcttgattagagtccattagcaagcgcgaataatatgagcaaccttaggttcgaccttagcaaatatattttgtttgtgcatatttgattgttgcttgaatattggtttttctcgcgtatttatagactttgtgtatcggttagtcgtgaggcaacgtctgcaacttccaggaggtgaaggttaatcaagattatatcgagaatagggattatcctgagcaggcaagtcatcaccattccttgaacatgttgatcccaattgcgaaattgttttgtttacaaataaaattgtatgcaatgatgaacatcctacttgtgattatgccatgccttgattattgtttacccttaaaatccttgtaaccatgattacgtatgagtccctagtcaattatgacaattgcttagaaatgccattctagaatcatgcatactcatatttatcaaatgctatatgcttgggcaattacctttgggaaggcaattgagatgcggcatgtggagacatgagcgccacattgccatgatgttgatgacatgatttttgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctacatagatggttcacccctgagtgatgcaggtgcgctacgatgggacagccgttgaggtaaggccgagaggcgtgccctacatcggtgtcgccattggtaggactgccatgagtgtgtgagagagagaacttaacttgaaccataatttaatatgtgtgagacttctctttcccgggagtgccagaactcctcacactgctagaaacatggactcctagagtgcatgaggatttaagttcatggagcaggtactgccaatgcgaggttatcgaaaagctttgccgtgacgcgtctcatgtgttgggacgaggctcatgtgttgggcagtcgcggagcgcgggtaaagtgtacatccactgcagtgtgagtaaaccaaatctattcgaatagccgtgctcgcagttattgagcaccgggacatgtattacacttggctagactctaaattcttaacctgtgtgggataggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcaatctatgctaggtctcatgcttgtgaaaagatttgcaaaagcttgctttacgcaaaagaacctggagcccttccttgaaataccctctatcatatgcattgttgttgtggtggcttgctgagtacggttggtactcacccttgctatttatatatcttttaggagagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgctgttgttctctgatagttgttggcctacctggccctaacgtaagtatttaactcttttagcctgaattcattcatgatatgttgtgatccaactatgtatgtgtgtaccaactactgatccagggattggtacagataaacacagaagatttccgatttccaaaatcgggggtctacacgccaacgaagccatcccctcggctactgctgccgccgtgtccctatggccagatcggggagagggaggggaggggagggagggcgtcaccggtctccaaccatcgcgccactggatccgtcccccgtcaccatcaccgccgccgccttgaggctggaggaagccactgtcgcctagaggggaggagaaggcaatcgcacctagatctgagagagggaggggagggagggcagggtcaccgcggccctccgacggctagatccaccgctcgcgcccctcccgctgccggatccgccgcctgcggccctgcgacggtcagatccaccgtgcctgcacccgcacccgtgcccctcccggccgaggatcacggcacccctcctggcccctcctggtagccgtcgtcactatcgctagtccgccgtgttttccaacactgaggaaaggctggagaagaagaggaggagatggaatgggagaggaggggataaggaatgggaagggataaaattagtggagattttaatatagagaatattttttcgtagtcggtgctcgttagctaccaccagcaaaaaaataatttttcgctggcggttgtttaagtgggccgctagcaaaaatagctatattttctctggaggtctacgtaacccacccgccagtgaaaattgattttcgctggcggtttttagccccttacccctcgttacaatttcacaggcgggatacacaaaaaaccgccagcgaagaaaatatggtaccgccatgaaaaatctattttgcagtagtctgctgatcttgaagactgtcacgcctctggagaagaagaaactggttgctagaatcataccaagaacaaaaatattttcactgaaacatttgaggtaaataaaaaattaatggcctttgattttttactgctctttctttagcagggtgcgtgaggtgtgttttggttgtgtgcactttgttgtgcggagcccatgagtgttctcagaattttgagattagtaaagcttccattactaaaaataagataaaataaataaataattagtgtctctctgcggcctttaactctcctatcccttgcacccctggtgaatatacctgggtgagttttgcaatgtcagataatacatgaacgatccagattgatgtatatccctacccctgaatgcatgctggtgtccagtgcaaaagctgctcatctttactcccctgaagcagcatggggaaaatatcctttacacctaggtaccatggtagtatgcatgcggtttaaatagttatataaaatttcatacaattttgacgacattatgagaatataaaacagtatgcaaatatgcaagtccaggtagcgtgaaaccaaatggcccagtacagcacctgcggcaagccatgttccttgctgcacaggcttcctccagggctcccccatcgactcggcagatcgaattcaacagggactttctgaagcttgtcgaattcaaattgcagccactgaaggatgcaactgttagtgactaccacacatccaccacgcagtgccgtttttgccagattttggctcaatgactagctgaggcacaacaacttccatttaaagcattcatacatttcctgattcctcctaggccaagctgctgtctgcactgaagtggcttctagctccttgagagttgagacgacattgttcatctagatctctctaccgttagcattatatttctttgtgctgcataggttgctcatggatagatgcgtatgtagactaggaggatatatttatatatgatttgatgtttggcataaggaagatgcgttagccatctattcaaccaagccatctcagtgaaggatctataatatttatggtgtgatctgtttaactgttttgcaaagtcacaaaaaagatgacccgaagaaaatggagggagcatcctggtgttgtattggagaggatgcagatgtgagttctcaaaaaagaaaagatcagatgtgctaacatttaatttcactcggttattagttcagtacatacatacagtcattattttgttcaatcaagcaactagcaggctacaactgaaaaattaatgttgaccaagtaggatcagccagatacttgctggatgttcatctgttgaaacgggcaagcaaattttcacaagatactagctgaataatgtcgttttgtcacaagataactcgtggacgcgtagctgaagctgatgtagatgtagcaaattttcgagatgagcaaccagagtagaagctttgctactaaaacttgcatgagcaggatcatcatgtcaatttttgctaccaaagaactaatttcctatgaactgaacctatgtataccatatgaactagcactcaacatggccccatctgtactccaaaggtgtagagttcgcgtgtgtgctttgagctcctatatatcatgctaccaaatgagtgtattattgtcttctttgcatggaaaataaaaggggaaacggaaagagagaaaatttcacaaaactatatgttttggggttcaagttgtagaaaaccacacacattttttatatgtgtccatcaaaagtaaatgaagagagtatttagggtgtggacatggcatcgtgattgttccacctaggataaagctcccaagtctacatcctaggtggaacagccatatcatctcgccggtggccatgtttgttgacagtgtagttttatgaaattttttaatccaaaatatatgtagttaagtgtgcccaagtgttaaagtgtgtgtggtacaaataaagcagtgttagggcctacttgctccctgcatttgtattcgttgagttgatctcggtcgaatgctccgatcaaggtctttataatcactcgtcctgaagctgctaatcagctggtcaccattttcgtaatcattagcttcataatcaccacatgtccactattgggtggaaccaataaggcataccaagcttagttcaaaatgccaaaacaataagaggatccaagtaggagacattgcagttagctgatcaccattttaggttaaatttgaaggataaattttctcctcacaatataatgtatacataacaggtggtctgcaggttgcagctcaacagattgatgatgaagtaccaatcaggatcagtaaacttttctctgatttcgcctgattaattatgcgggtgatcagaaagtaaatgacatacaactcctatcttccagtggttcagaacatctctactgcaatgaacatgctgtcaatatgcagttgaaggtgcaaaagaacaccacgaaatgaaaagagatagccatttgcatatccccgtggtccattcttctaatatatttttgcgaacgcacaaaagagttgcacaccaatatattcttgtaatatattgacgtgcaatccttttgcgcgttcgcgaaaatatccccgtagtccatgggctcatgacatgaaaactcccgaatcctgatgcctcccaggacaaccatagaaacccattgctgtgacctttgcctccatgaaaggattatctcagtctctctgaacaaaatatgttcatttctcagtttgggagtctttactcactgttaaaaaaaaggaatccttgctctttatctgcctgtaatagaatgttttttccaactgatggatgtgaggcttattcatatcttaaattatgtccatcaccctttaagacagataaataatttactacctgtatcaccatcactgcgggatctgcccttggatgtgtgacttcttcatatcttaaaaattttgttcggctttggaacattagtaggttcaatatgtgtttaattacattcctattactgctagtcagttgaaatgatcagtatgaccaaagctatgcaaaattttgaatcctgtgatgggttaacatcgctttgtaagcaatgcgagatcgcagtggtggtcttcaagaaagcacttggtgaagaacaatttgctcgaatctgacaagcttgctttcatttttgttcgatgtcatctgtacaattgaatttggtgtggtttggtgtgaaatctgaatgaggcaactatggtgcgatctgtttgtcaaattcagaaataaattagcccgaatggaattgaagtgaacacccttctgatgcatgtcttggagatgcatatgcttaaacaaaatgtctccttaaacctagtacaaccatccacccaagtcactgaaagttttagtctgtgatcaaatgtaatactaatatctactccctccgttttacaatgtaagtcattttagcatttcccacattcgtatagatgttaatgaatctagacatatatatgtctaaattcattaacatcaatatgtatgtgggaaatgctagaatgacttacattatgaaacggaggaagtaaatccaagcaatttattacttcagtatgtgaagtcattcttgtgttcacttgggaactagtagcaggcaaggcaaggccaggcgtgcaacagaatgagagtagttattattattattattattattattattattattattattattattattattattattattattattattattattattattattattattattgaaaagaggagagtttatattgttgttgcactacatcaagcacattgattttcaaacaaaaatcttatacacaacacatttagcactagattggaccgaggtctcgtatcatcccattgtgccaaactgaaagagagctcgaactacatacatggatggagcagcgcaaaacctatagcctagcagagcacctgtggaaagccatgcccatgaggccacctgtggtggcaatgctatccaagtcgcacacagccgccatttccgagcttggaactcgacagcttcttcgagggctccattccgctaccgtcgactcgatcgctggatccaactcaacatggagatttgcagccactgcaggatgcagctggtagtgaccatcacacttcaactatgatcatatcaagtggtttaaaccattgtttggctcaaagcaggagaatattctggggtgccacatcttctctttgaagtgttcatacatttcccgatgcctcctacgccaagctgctggctgtagtgatggcatctggttcgctgaagcattaatttgtttaacttgatctctctactggtagcattttgtaacaagataactccttactcctagccgtggctgtagtaaagtttcgagatagagtgacttgagaagatactaacagatactacacattttatagcgtaaaattttgtacctctcggtactacaataaggtttccactaaaaattttgatatctctcagaaactgtaaaatttgtcttagagataagcaacgagagcataggctttgctagctacctaaacttgcattagcacgaccatcatgtcaattagaattcatcagcaaacactaatttcctaggaagtgatctccatcgactcttctttcgtttctcagcttatgttcatttatctcatttgtatggagcaaaaaagtgttccaccaatttaatgaatacactgtggcactgcttggtggtagcaacaggaggggttactattttggaacacaaacaccataaaacttctctgattctaaaatgtacgagaaatttctgaaccaaataataacccctagttgatgggcaatttatgaacaaattaataaggcaaaaagagaagcatgctactaaatcactggattgcaaaggattttattacaagtacacttgtaagcatagtaccagataataattgatatactctcaagcttaggtcacaaccaaaacgcatacatcttcaagctgcttagaccatgcaaaaaaaggttacaacctccacatggagatcatttcttcttcggcatggagttcagggtagcaaccaaacatgcccctggcccgccgtagacattgtttgtcattgtcccaggtagaaaatgtcctaatgcttcccatacttacctaacataccatatgaactagtactcaacatggccagccccctctatataccttgctaccaaatgaagtatgcgttgtcttcctttcatggaaaataaaaacgggaaagaagaaacaacaaatggagcaatataatctgactacatgcatttagcatgctcaacgttgaacttcgctttatgatcagaaagagcaaatgatcaagcatgcatgctgaatgaacacaaaaaagttagttaatttgtatatatgtaatactttttttcctgaaaagaatatatgatatatggttattcttcttctacatacgtactgatctttttttttgcgaggacatatgtactgatctagtatccatatttttcatcagcttatgtattaatatagagaaaattcgatccatagcacacaaaaaaagccggtaccaaaaaatagcacaaaattttcctctttccatcagaagcacatgccactattttttcttcgatatcacattttccatccaagtccatcggttagccatgattaggagcgtgaaaagacaaatttgccctttattccaaaccttagtttggacggtgagggcgactggatgtaggcgaggcggtggggtggtcgacagcgatggccctcccatcccatggcctcagcccccatccccaagctcattcggcgttgttgccactgctctccaagctccgcctccaccatccccatcactgagctcgttcgtcgcctcctcccccaacgcataaggacatgtactgcttgattcaaatattgttaactatgccagggtcttcaaacattcgtgttcgttgtgtttgtgcacacaccattagggcctaagacccttaatatctaaaaataagtaagtatgaagccttaaggcctctttataattaacttcagttattaatgacccagtggttggaggaattttgcaaaagatatcttataccgatggatataatcacttatgagtgatctagactcaaataatcaggtatactactctggtaacagcccatctacctcaaccctagacataggattcctttgcggccatctgatagctttacatcgatgattgctgagtttccgtgacaccagtttttgagatgagtagcaaaagaactcccaattcctcaaaggcctatatatgacagcaaattagcaatccactggcctagtccacttaacaatctctttcatttctctgtcagcttgagggcttgaggccaacaatagctacccattgccatggcctttgcctccatgaaaggcttctctctctgtctctctgaagaaaatatgctcatttctaagatagggagtctctggctctctgctccccttcatctgcttgtttaggtttctctcctctatctgcatgcatgtatattgatatggtgcaattatcgaacactgtcattccacttcaaagcagagcctacaactggaaaagaagcggcttcagttcagtctcaaggttctggcaaggataagttgatggctatgcctctttgtaccttaattcagagccatccctatcaatcaatgatgaaatcaacggctcaggtctagcaaacaaaaaaaaaagcatcacatataagtcaaactatgtgggagtgatatgtacagtgaaagtaaacaaaatggattgttattcttgttcctcttgtggtgtcaagtatttagcatctgatgaatgaaacttccggcttcacatactcaatcaaaagaaaaacaagtgcactgaacaacatgtatctgtattccatttttttattgacgatggctaagtgaagtttgaatttggtgattgtcggtgttatagataaggtatacccaatagtcttgggtagggttcggcagggcccacaatataccatgttttatatagaatcatgcctcatatacgaaagatgttttggataaggaaggaaaagcagagttctattcaggcactaagaactactcggatcatatccatacttgtctccctaattccacttatccgagggtataaatacatgaccccttagaaggaggggggacacccctcttacccctccgccgcccccgccaccactggtgttcgccttccccgccaaaggaagaagatggtggcagcgccgtcatcggcatggcaggatctccccaccgacctgctggtcctcgtgctgctccgcttcccgtccctcaccgaccgggcccgcctccgcacggtgtgccgttcctggcgtgccggcggccacccgctgcttcctatcttaagccgccatcatattgcagggagacgccatttctgtctcctattgcaatcaacagaaaggaatcgtcgtcatcagctcatttacagacaggaaaaagaactcaaccatggatgtatctgatatcgccttcttccgagggaagctatacactctcagtagagagcagaagggcttgcttgatgttcttgatctctcgatgacgaaaaaaatgtcatcatcaagatgttatcagtattcagtgcatcatccatgatgatcctaaacagccggtaatgtatcgttttttaggactgatcatcagtatgtgttgagtccaatggcacctaaggtcttcgaggcatggagctgtggcgcagtttctgacttggttcttcccggctgatgtgtaattgcagcttaaaatgttgtttggttttgggacattactacgttcaatatgtgtatttaccttcatatcactgctaatcagttatgcaaaactgggaatcctgaacattgttgtgtaattaagctatacaaaataggtcgtcttcaggtcagtagttgatgaagaacaactggctgaatttatgttatgtggtttgctcttcatttataaaaaaaaaatcgaatgagcaacttgctgatgtcttggacaagatggagatgcagatgctaaaacaatgtctccataagcctactgaagtcatccatccaagtcactcaagttttaagtttgtgatcagatacattttaagtttgttatcagatatacattaatttcacgcaattatcaattaattgcatccagtctattgtgctctaatcgggcaatgcaacacgaaaatggtgagctgggtagagcagctgcggcaagacacaaggccgcccagttattcctggcaatgtcatccctgctgcaagcagccactatcattgatcatggtgctcgatggcttccttcctggctccacagccatcgactcaggggatccaactcaacagggattcccactcgcttgttttccacgatttgcagccactgcaggatgcaaatgtcagtgaacatcaaacacccaccatgtctgaccaatttaagccagattttagctcatattaaggcgaaacagtgaggtaaaatcggcttaccattgaagaaatcagagggtttccgatgcctcctagcccaaacattggtaactgataagtgttcatgccttcgttgcacagtagagggcacatgatacaagcaaagctttgctgctggtagcatctgcagtggttggacatgacagaaactggcctgttgcttctaatctaataatgataagaacgaacgaacatggagcagacatcagtcaaatgtgcagttataagctagttcaatacatgaaatcattatcgtgttcaattggacatttgcgcaacaagcgggctacaactgaatgttagctatatataggttcaagtcatgaacttattgagtaaaagggcatgtagcctagtggttgcagtaacctgagtagcaccccaagatcctgagttcaattctccaaaggagcgaatttcaattgggttatttgagagctaagttccctgttcgataggctaagttcctaatttaaaaaggctgcatgtatccggttggatgtagaggctgggtaaaaatacccttctctaaaaaaatgaacttgttcatcagttcaaactgaatgggagttgcattaattgtcgttatattacatcgagaatcaaaatttccaacaggttagtatacgtacagcattgacctccaaactcattaaaaaaaggcaaatgtcatccatgagtttgtaaatcataattatttacaggtctattactccatttttatacattcatcatccacgaagagaaaaataatggtgagtcgatcaggatttaagaagagcatccttcccctcgaccatgggcctcctcccccttgatgatagtgggggtgttggcattggctcgttgtcctagaccgcgccgatgcagatctagtccacggacacggccgagctgcagcggcagatccagatccagtccaccatcttcaaagaggttagtcgtcaagttcaggtgaacaaatttttggtgtcatctctagattggaaaaaagtttgttgctgttagatgtgtgtctgcaatattgacaaggggttgtgttcaaattgttgtgtataaatgtctgtgtacaaaaattgatgtgtaatttgggtttgattctggattgatgtggatcgagtggcttcctttttttttactgatgagatcctaagagtgatggttttttatccagcactgatgagccatagaatgccggcacaaaaggctggttccgactgacaccaatggcttgttctgtactagtgagaccccctttgttcattggcagttgcgtgaggctgccattgacatgctccgacctcgacggctttctccatatggctccatctctattgactcgacggattcaagtcgacagggattatctcgcacttgttttctgcgatttgcggccactgcaggatgcaagggttaatgaacatcacacatccacatccaccttgtttaatcaatttaatccagattttgactgaaactaaggcgaaatgatgaggcaacatcatcttatctttgtcaaatgtttatgatgcgggtaattttaccatccttgagaagatatctagaggtaccatattttctcctccagataccaaaatttggtacctctagatactaagtatcttaaggcactaaaaattctcgtgtaaaattttggtacctcaagctaccttttaaaggattgtaaaattcctcttatgatgctgcctaggccgcctaggccaaccattgcaagctgctgggtgcagcggcctcctccagctccctaatcatttgatactgaagggcagtgaactgcctcttctctttttgtgtcagttcacttcagtgcgccacaaattacatacaggttcgcatttgcgaaaatattgtgtcatccctcagctatacatgtggcatcttgcatgatatagagataaagaaaatctatccagccggtattactgaattccagagcagtcaccacatgctgggctccagcgactgtgccgccgaatgctttcgctcgccgcggtttgccgcttggtggcactggcttggcagtcagcacctacacgactacatcctctgacatgagaagtcctgatgcctcctaggccaaacgccactttcaaaatcttgaagacgatatgtcatgtagaatacttgtgaaattcccggcgaagaactgcaaggagttgcctttctcatcatgctattttcctttgtggcttcgtctcgtattgtgtatgtggagcagaagggataggttcatatatatagatgcattgtctgatggcagcaatttaagatgtgggatggacaattcagaatatatgtgaaatatccgtgtcaaattttaaccccatagcttgatttttgttggtaggtcagatcagtttgtctcttcaattgttcaactcaatgcagcgagttatcgaccatgccagctataccacttgacttgacgagttaatttcgaacatatagcttggcaaagaataattaacaccggtaccgaggtttgcaatttcgatcataattattaggagtagctcatatcaagttcataactacttacatgtttttttatggggagtgaaatactcctataacacctatacgtgttcttagtaactgaatcgaaaagaacaacaaatatttataccatgttgaaacacgaattagtagtagaaagcaaaatcaagaaacaaattttgtcgaccagccaccatggttgtactataccagttgcccaagggagggtcgtggtggcatgtctggtcactgttgagaggttcttggtgatgcctgcctgacaatttcaacaggtgacatgcaagctcctgatgcctcctagcccaacacccatagccaccatctacatggctggagtggcttctgttccatgaaacattggttgcaccattgttatgtcaattgaatatgtatccttcagtcctttctcagcttgtgcaactgcatctcatatttatagagcaaaagggtgtaccactacgtacattactaatggatgcacatcgcagtctagtggtacagaacggagtgtggttgtttctgaaaatgtatgacaaatttctgttacttcaattcttcaattcaaagtagaaagtcagtggccacgcgaaccactcatgattttaaattgcagaattttgttacatcatttcagaaacaaacaattactggaatccataagttcattattagttggttgattcgatcacaaaaaggcggcgtggattgatcaaaatctgtggctgctagccaactcggagctcaagaagactgcgcatctccttcatgcatagggtatatgacaatatccagctagcatttgcttctgtgcacatgccgatcatctccatgattctggactgtacaacatgtgagatggggtaatcaaaccattgctgcctgagtctgtgatgaaagagctgcggcacaagcgccactttctgacttggttcttcccggctgatgtataaattcttcgtagcttaaaactgctgtttgctttcggaacatcagtatgttcagttatgcatttaccttcttactccttctaatctgttgaaacgatcagcacaaccaaactgtgctaaatttagaatcctttaatggcagagcaatttctttgcaagctatgcaaaattggctgtcttaaggacaacagttaatgaacaaaaatttgcaactgtgctttcgtttttatttgatattaactggcaaaatttatgtggtttggcctgaaatctgaatatggtgtgatctgtttggcaaattcagaaacaagatggcctgaataaaattgaagtgaacatgctgctgatgtcttggagaagattcagatgctaagacaatgttgccttaggcctagtacagccatccaaccaagtcaatgagagttttagtttgtgatcagatgtaccactaatttctaattccaagcaattatagttcagtacatgcagtcattcttgtgttcaatggagaactagcaagctacaacttaatgtgggtcaaataggtacccaggtccctaatttcttcagcaattctaatcagcaacaacgcaatggcaaggcttacaactgaacgaaagttgcattgttgtttcactgcattgttgtcgtacaacatgtattgctgctggtggcattgcagaaattgaacatggcctgaacatccgcagatagcagccaagggggtcagagattaaaacgctggcgccaattgccattcaatttagaacaatcagttggacatggtctgaacaattagtttcattttagctagctgctatcagtagcagtggcctccactaccaacaatcggctaggatctggcaagttagagtcctttcatgttgttggtatttactgggtaaatctatgagttaattttgtctgaaatctgaatttggcatcgggggtcaactttcaaagacttgtttcagtccaaatgataatagcagggtgtgattttttagactggcagcaatggcatggtttatttcagaaaattcagaaaataaggtggccttagaagaacaattgagtgaacatcttgctgtgtaccagggaagacgcagatgatcccataagcatactttatacaatgcgataccgggcagttatttgttcactacatgcaaactttattagttcagtgactgaattgtctagcaggttggcgtacaacattcaggattcaggaagagaagatattcggaagaggatttgagctgaagaagcaggacgtagatatccaactgagtagagcagttgcaccaagccatggcgtccgagtggatcattggcagtgcttccatccttgttgcacgaggctgccattgacaagctccgagctcgatggcttcctctctgcctccgctaccattgactccacggttttatggactgtctcacgcttactttctgctattccaacgcactgcaggatgcaaactgttagtgagtgcacatccaccatgtttaacaaacttaagtcagattttggctgaaactaaggcgaaagtgatcgaggcaacataagtttaccttcaaagatttcaaaggatttctgatgcctcctaggccaaccattgcaagctgctggggtgcagttgcctttgtctccctgaaggactgaaccaatgttcatcttcatcactatcctatagcctatagcatttattgtgctccttcattcactcatgggtttacatatggatagcctagaatggatatatatgatgtgaatgagtcatgacataaagcaatcaagtgaagtgcattgaattgttttgttctctttgggtgtcaggctttcaacaatgcaagccatcaagttctcactccgtctaaaataagtacagtgtattgtgttcttcaatagaggatctgctgatctggaagactgttacatctctttttttttagaaaatggattaaaatccggcctctacatccacaatggatgtatacagcctaaagtcatacaagagtacttagacccgaattccttacaataaaagagtaccaaagtgacaacacttaaaagagaaaagagaaacacaagactacaacaatcttcttttaaggttccacccatattttgcatacaactccatgacccttgcctccaaaatcttgcaacattctttcaatttgtggtcatcctctttcttaagcaacaaagtctattgaagcacccaataagtcctcttgaagatcagatgtaaaaaagaattagttttggagccggacactggttgctagcatcagaaccaaaatagcaatcgtgtccactgtgatttgagagaagaacgggagataagaattcccggtgcctcctaggcctaccacacccatggtaagcggttaagtgcagcagacactgaatttgttttactctatatatgattatagtcctacaccttttgatagttcatatgatttctgatgccgcagccagaagcattttttgtgctccgttattcgctcatggatttacatctatatacatagactataagggatacatattatgtgatacctgacataaggcagtcatttaacactgccagtacaagtgaagggcagtgaactgttttttccccctctttgttgatcaggttgttagtcaaaatgcaacctagcaagttcaccttccatctagagaagtgcagcataatgtattgtttagaaactgattacatcataccatcaaaaccaaaatagtagtcatccgctgagtactgaaacattggaagaaattgaagcatcatagataccggcacctcccaggcctaccaggcaaacccattgtgaatagccattgaatttacctttcatccactatgccaaacgaaaaaaaattgttctagcaactcatttctctcatggttacttcctctgatctttcatcgagcaaaagaacaataggcctgtactgtagttattccactgagagatctcaagatgcagtatagccatccgacggagatagtcaaactatcaaacaaagcgcagatcaaaataggtgatagttttgaaaacacggtaagatcgaacttagagaggcaagaacttgaattcctggactggacaaacaagtgaaatctcggtacctcccaagcctaccatagccacgcagcaaataagctgaatttcgagtttggcatccatcaaaaacctgaattccctgtggttcattctcctgtgtctctcagctttagctactactcaccctcttgttatctcttttatatatgggctggattgggagagcttgtatatcatatatgtcgacaaccaaatgtactatctgattccatgcaataattattgattcagcacttgcagctagtcatgttcagtacatcaggccaccaccaaaatagtgctgccgtgatgcaaggggagccgcataagtctgatcactgatcagtttgggcacttcaattgttcatcagttcaagcagcaagtgaaactgtatccttgctaccactcaatgggaatcatgcattccgatgataaattgcaagtcttagaacagaatagcttggaaaacaacaaacagttaacacaaagggaggatcaaatgccaccaattgctgtgcggtgctgcatgtatccacattgctatgtcagcaaatctcaccagagttgtcgctttaaggatcgtattggcattagcattgtcgagatggaacagatgtggaatgttactgcgactacatggtgccattgcatgcttcggttcgccatggagaaagctcttcgtgatgccgttgccagttcgacacagtcgtttcgtgacatgaaaactcctgatgcctcctagtccgacagccatagcaacccagcagcatggctggttggagtggccactgctccatgttcctcgaagagctactcgtgtcagctactccatgttaacttgcaagaacttgatgatgcgcaccatgaactcttgttcatgatgatctctattaattcttgctagctaacatgagaagcgagaaatacaagcaaggttttgtgcaatctatttctcgcgcacgcatcacttttgccacctcatctggccttcttatggagcagaaaatatatagcacggcatcatgaatgaatttacaatctgaatatctctgaagcagtctgattttttatcaaatgcaggaaaaagaagaaggggtgcacatgaatcaatgcagcacatgaaccaatccacaccacagacttggagatatgtccaatcagtttgtagactgcgactatggcgtcgtacgttgtatgatgcggtcaccattgccgccggtgatccctgatcacacggcgccctggaacgaaactctcagggaaatcacgaactcacacagatgcacaatgaaaagacgaggtgaaaactggcccatctagtaaaacatactcgaatgaaaaactctgaaaaatgagaaccagacgcgctccaggaaactgaaactctgaagggcagcacaggtttacaacatagaaactaatagccatgcatgccgcgatgatcctagtgatgccacacattcacttcatgacatgacaactcttgatgcctcccagtccaacagccagagcaacccagcaccatggctggttaattggagtggccactgccccatgttcatcgaaaagcaactcgtctcagaaacattattgccgctacaacttgcaagaacttcacggtgttcatgatctctctcaaaacaagaagcgggatacataaggttttctctctaatctcacttttggcaactgatctccttctgtatggagcagcgtgttgaatagtcctacattggttgtggaagggcaagggacctagctaatatataagtgggagggcacgggacctagctaatatttttggtaattggctaaggggagcctagatccattaaaaaaattgattttgtttgtaactagcaccttgtgttggtccatttggcattgccgcaatgatatagtttttgataaccaaaaattgtctaaccccatgcaggttgtcttcatgtcttccagttgactccattcttggtccttgatgctttcataggaggagtagaatattttgcgcagtgaagctacactcttgaaatcgatagccatgggacttttgttcacatgcatgtaaaaggaaggtgtaggtggagtcactgtgcaatcttctttgctccataaaaggatcatcagaagtaccaaaagtgactatggaagctttgatgttacaatatcacctctaggaaattccttaattaatgaccattcctcaagaatttcagtggatatatatgatatatggttgtgcaagtttcggtagcaaagtttcttgatggacagtgtttcatggagaagaggccaatccatccattgaactagttgctatggctattggcctaggaggcatcaggaactcctgtatctcatgataaattcatcagccagaatcaccaagatcctccacacatggccactgaaattctcttcatctggccaaagagcaacacaatgcacatggagacccaggaggctgtccaccaagccacagccccaaacctttactacgacaggagcttgacatgccgatgcatcctcgtcgtggtcgtgctgctctccggaggttgtgtggcagtggtagtctatcgtgattgcaaagttcttttcttttgaatgaatcgggaagccgccaatttcatagaatagagaatgagtaaacagtacataaccaggagaaatgaatgaatgtacaagcttagggcctttggaccaagctaactatatatagagtgagccagttgccgaggtttttcgcaattgcaaagttcaactcatcgaaaatgacaagtactgttaagttctagagtaattttaccatccaatatttggtaacttgaggtaccacattttgcacacaaagttctgataccttgagatactaagcaccttgaggtaccacattttgcactagaggtgccaaattttacactataaagtacctcgagataacgaatatttgtggtacctcaaggaaccaaatgttggatggtcaaattaatcttttagagcaattttacactatatatagagattttctccggtccaataaaaagtatctcgtgttaccggtagcaaatcgtttcccatcgttggatctaacaatgcccattctgcgcagttagattcaatgatcagaaacgaattggtaccgtgaggtaccggtaccttgaggtaatttttgctggtcggaagcaaatctctatgtataaatcttacacttcgatcactcccactatatatgtttgtggatattgatatattagaatgttaggcagctcactctctggaaagtgtgaacatgacttatatatctcaagtttttttacaggtaactgcagcattgacctgaatttacttttatgaaatgatatctcaccaaaccagatcatatatactaagtagtaagaaatggcacatgctgaggggggagatgaacaacgtatcacacaaccagagaaaagtttttggtttaagccacatacccaaatctttttaagaacagaaaagcatacaacaaaaaggtgaaagcaggtcctgccagtgtgttggcttaggagacacttctctgtctggctgcactgaatttgatccttagctagtgcagccattgaactagtccaaagtcagaagatcaagcctgaaacagtgagatcataaggaggccccgctcgatgacattgatggccatagattccagtgatcatcaatgtcaacctcgtgcaggaagcatgccagtacgttatggcacaacgaacacagcactgcttgtagttgttgtagcaacggcagtggcattcttgtggcgtatgttttttaggtggtttatatatggtggtagaattttattatcaatagtatcatgagtagaagtgattaagaaatttgatttatcagttctcctatcaacagaaaaaacatattctactatgaaaggtctagattagttgtactatcaagaaagaccatttaaaaattgtaactgaaaattcttatgagaaaattgccgcccgtttgtttcacaacggctgacttgtccgcttaatcttggtccaacagtatgaaattaaatgactgtcatccaattggctcaggggatatggaggctaatggacactataattccactccaaagaggattcctctgcaaaatgctactttgttcatactttgaacaattcacggtcagtcatttaggatcataaccgacgtagcgcgatgcacatgaaaagtgtaggatcgtaaagggcctttcccacccaaaagctagccaataaggtgaggggctcctccacttatatattaggtatcttgttctttcacaaccactgtaggactattcaacaatctcctctttcacatattggtgtccctcagccattcaccgctccttcaccgtatccccactgtcgctcaggtatacaggccccgcactacacaggcacagatggtccttcaggcttacacacattgttcctcgagtcagagatgttgaactagccaagctctgataccaattgtaggatcgtaaagaacttttcccaccccaaaagctagccaatgaagtgagggattattcaacacgctactcttccacaaccaatgtagtactattaaacacgctgctcaataccaatgtaggacaattcaaggatggttttttttaacatccttgttgtttggaatcctttattagagcattttggtttaaacttgttacttatgttacatgtatactagctgatttgcccgtgtgttgccatggagtcttaaaaaaaatctttggcattcattttaaagcctaaaaatatttagctctccaatcattttttgtcataaatattttcgattcttacctagttagccagagtcatgagacatagagctatgtttctttgacatacacattgtgagcccacacatcagtaagaggatggtgatggtagatttactgcagccaccactattaatatttaaagtagtatagattaagcttcactgttttttttttgttttgctcttttttttgttccttctgtttttcaaagcccttcttcaaagtggttgctaatccttaggcctgaggtgtcgagttcatgtcagggcaatctgattttctgtttgtatgggatgtcacattatgtgatggatcgtgacgcgtgcatatctatcagcctcaatggtcaagctctgtttttcattcatattaatgcaggaaagaaagctagagagcagccttgtcgacaaagtttgcatcaccaaaaattccattggttatcatcttcaatcaagttagatcatttgatcctgccaacatatataagatcgtcaaatcaccatggctcacctcatgtccagaagtttagacataggtttaccattacagatttgatttttctggatgacacctcctttttttagatgaaaggcattgcgcccagcttttactaaaaagcataagagtggatgacacctcctttatgttgcaggtgggtcattgttgctctcgcctgattggttcatgggccacatacgaaaatcaattttcacagacagacctcttaacccatagcttgttttttattggtaggtgatcagtctgtcatttcgattcttcagttcaaaaagcagcgagttaacgcccaggtaatcctgactagaggttatcctgatattaagtttcaggttttcgaacacatagcttggcaaagaataattaacaccagtaccgaggtcttcaaattttgagcataacatattcacagtaaactcacacatcataagttcgtaactagttacaggtttttgtctggggagtgaaatgcttccataagacctatatgtgtttcctggtaagaaatttacactaggttgataggagaatcagtagaataaaaagcaatcaagaaactaatgtgttgacgcacactcatacgaccagctgcgatctctttgctgtgcagaggttgcctattggcccatttgaactggtgacatgcatgttcctgatgcctcctaggccaacatccatagccaccatctacatggctggagtggcctccatgaaacattgctgaacatttcgattcttcagttcaaagcagcaaatcaatggccacgcgaactactcaaaattttaaattgccagaatttcgggcatattagttcagaaaaaacaataattggcacccataagttcaatattagttgggtggtgcagattgatcaaatgggtatatgactagagcgccgttctatatatagagagaacatcttgtaagcagaaatatcagtttcacccacctgagaaatgtatcgctgttattgattgcaatcctactggtagctgcactgctgggctccattcactttataggatttcaagtctgggtattcactcgataattaattaatttacatattaaatccatcacaagaatacaagatgatatttagtaagagttcactcaccccctaaactatgatttccccagtccccagctggtcgtgttgtggcaggcgacactgatgcatgtaatatatctccatatatcaaattattttagaaattttgggtattcacaagaaggcaggcctcattgtgattgatgtgcctacggtaatgagtatcgcgggacgaatgactgtgttatatacaccatgcatcatctcactgggatcaccttgacttgcaatggctgaaccggctagagatctcctgaaactcttctgtttcaccaaatttgagcaaaattgcaatggatccaaaataaccagaagattattgtggctttgatctcagcgacagcagcttgaatcgttggacaaagtgacatgagagctcctgatgcctcctagaccaaaaattactcatagcaacacataggctgtttgtggagacctggagtttactctacctccatgaaatacgtgttaatatatctccctgtgtgtgcgtgcgcacgcatgtatgttggtgttctattgggtctatataatatttgatttgatgcaatcatttaatacaagtaaattccaattcaatgcaacactaacatctgaaagcctggagatatatgtcatgttcatcctaataaaattcagaaaaaacagacacagtgggctacctaatattcttagtaattgaatcctgatgaaggagatttatgccagactgattgaatagcagaaacaaaaatcagtgactgtgcacatgtcagtgaaatacagcctcctacggagttcttttcatatgcatcacctacgttggttatgatcctacatgaccgtgaattgatcaaagtatgaacatagtagcatttttcagaggaatcggcctctttggagtggaattatagtgtccattagcctccacaccccatgagcagattggatgacagtcatttcatactgttggaccaagattaagcgggacaagtcagctgttgtgaaacaaacaggcgccaattttttcataagagaccttatagtagaattaatctaaaccttttgtcttctttcatccattaaattattactagctaccgatagtagaacgatttttttgttggtaacagaactaaatcaatttcctaatcatttctacttctactaatgatactacaggtaataaaatactaccaacataaaccaccgaaaaaaatatatgccactgccgttgttacaagcggtggtgtgttcgttctgccacactgccatgcttcctacacgaggctgacattgatgatcatactggaatctatggcaaaccctccaccgccatcatcgcaaggtcagggcctccttatgatctcactgtttcaggattgatcttctgactctggactagtccaatggctgaactagctatgaatcaaatacagtgcagccagacatagacgcacggtgacatgaaagctcctgatgcctcttaggccaacagccctgcatactaacacattggctggacttgctttgatctctgttctgttgtatggttttcttttcttaataaaatttgggtatgcggcttaaaccgaaaagttttctctggttgtatgaatcgttgttcatctctccctcatcagcatgtggcatttcttattgtatgctatttggtcaatatatttgctggtttggtgcgatgtaatttagtacaggcaattcaagttcaatgctgcggttacctgtaagaaaaaaactggagataagtcgtgttcataccttccagagagtgaattgcctaacattctgacacatcaattgatcaaagggtatgatttaagcagcaatgaattctgtcttgaattgttcttattctatccacttttgctgtcaggaatggaacttcaccagtgaaactataaccacctagaaaccagagcacagtataacatctcatacttcaagttttggtggtctaagcaaaaagtgacaaatacatcaattaactaattacttggacaaatagaactcgtgtagtttactcttaactgaattatgtttcttccaaagtttatccaggagcaatagtagtttgatcgatggacatgattgtgacgttgaacctaataaacctgagagatgcagtaacccatttgtgtattgatctttctaaaaacatttatatcctcttgcaagtgattaaaatgggcaaggcctgatcgatgcaaggtggccgcagtgcaaagatgcatcaatgcatttgaaaagtatatctggtttctccaggagactatcattgaattatttccaaaattcaatatattttttgaaacttcaggattactggtgggtcctagcaagatattctatttgccaaaaattccaatttctgttgattttgcaaaaaaaagaaagaaaaaaaatcaaatttagcacaatatgtccaaattttgattttttttccttctgaaaattccaaatttggaattttgatgaccctggtatgattttgcgttcgaaatagtgaactctggctgtagtgacctacatatcaatgagagagaacccatggccatggagtaaattcccttgatttgataaaaaaacaatggattttattttctaacataattctaagagatttgctccggtccagtaaaaagtacctcaaggtaccgatactctacagtaccgaatcgtttccgatcgttggatctagctgggtaggatgggtattattagatccaacgattagaaacgatttggtaccgtgcagtaccggtccctcaaggtacttttcgttggaccggagcaactctctaattctaatggatccaacacaatggaaaccaccggtgtaatagaaagtttcaatggcattgaaggcatcatcatgatgcatgcaagtaaaaatacaatggttactcacttgatttgatgtgattatccattgctctaaattcatccagatagacatgtgtatcaaactatgccatcatccagacagacatgtgtatcaaactatgccaattgtatgatagggataacatgaaaattgatccatcagtcttctttgtagccgtggcgagagttctttgtgatgcctgtgatgtcgtctcatctggttacatgggagctcctgatgcctccaaggccaacaatcattggtgtagtagtgctttttgttccatgaaaaaattttgcttgtattgacacattggtagtgaaacttcctccactctctggtgtataaacttgctagttatttacttatttctcagcttgtgcaactccatgtcatttttatgg

SEQ ID NO: 4220 - DNA, 364 bp, Oryza sativa
tttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttcttcacactaccaatggcctggttgaagttgaagctc

SEQ ID NO: 4221 - DNA, 16510 bp, Oryza sativa
  unsure (1)..(16510): unsure at all n locations
atagatgaacccttttcaatgggaaattgtatctttttcactagaaccaaccaccaaagaagtccatttctatggttaacaaacataactccggtgccccacttacattacaatatatatttcttgcacgcatgatcgagcactatatatatatttatatatagtagacacaaagggtcctacactataatgtgcactcaagcagatatcaatagtgcttcagaaagttctccatgcggtgaaattaagacatatacaacagtgtgtttgtactacattctactcgtgtcaaaaacatggagatgttgttttgggaactaatatgcatggccaccaatttaaagtataaccccgatcaacaattagtttctattacaatatatatgtatatatacaacctaaaggagttattatattataaaagtattattcaacacggcactatcacagaacagcttatcagtgccggttcaagataactcgatactgatgatggttttccgtcccaaaatacaagcttgcgccatgcatatgttctcttggcactgatggggagatatcagtaccgggtcttacaaccattcggcactaattgtttggcaacatatcaatgcggagtgttgctattaatcggcactgatgagtaacgcatcagtgtcgggtcttgccagttggagcgtgataactaattttggtaggaaaaacatcagtgccgggtttttaagagtactcggcactaatgccactcacatcagtgtcaggtattcttatgatccagcattgatgatctcaaccatattatttttgtttatttaggatatatgaacttaaccttttcatacgtactcggattgcaacaaaacatatatgggaattgtagctctcaacgagatctatgattttgtagttgacaaatttttcatttgaattcttttaaatattcaaatccataatttaaatctcggtaaggatggctcaaaaggaaaaaaaaatattcatttgctaacaagattgatgtgtaggtgagttggtaaagataggtgcatgagaggagaggtttttaggttcgaatctacaccatgacaagaattatatttgagttgaagaaatagtggttgcaccttcatatatacatagctatacgcttcttgacgtcaattcttgtttgtaggattatttacacttgcatcctatttgtgggtgtgtccaatgtctcacttcacagtccatctctcagtcgtgccgaacaatgtctcactgcacacagtccatctcagtcgtgccgaacacatataatgtactcaatcatgctaaagtgaaattgttgcaacataatgtttgcacaagacttcaacagagagatgaacgttgctaagcactcctgtcgtctcacattcctataggagaaatgtgcatgatatggagaaattcttttctctgaggaaatccttgtctcttttctttgcggggtgtatggatgactcatttgatatactttcagctagaaatcttatgttgttgagttttgaattttgctgcgccctcttacgccaaagaaaagatcgattctttttttttgttgcattgttgttcttgtgtttgtgaatttggagtagtcgctacacaccatatatattgcaagattgccaaacattttgatttcaagggcctacatttaatagattgagattataaaatgttccatgcgactcccatgatatcctggacaaatactcattgttaatatatctaattgcttcgtataccaaatagaggaatttttatggtccagcaggcagtttcagtaccaaatctcgtccattggattgaagggatctaacggtgtttggcatggaagggcatcactgtaatttagcattagacaagcgattgaatcggcttgagtatcatgaaagaaaccctacgtcgttttctctcgatctgaaatcatgtcagcgctgctcctgggagggaggttgatttgctcttggtttgtacttccacggtggcgcttccttcgtcgctacaatcgttatcgttgatttcatcgccaccgcgttcatcactggagcggtcttgctgttgttgctgttgcactcctcgctaaagcgctcatcgacaccgcaatgctcgctgccagcaacaaacaaagttgggggaagtttcgatataacttatctgtggggcacgaaggatggtgagaagatgaaatccccgaaggtattcaattgggcagagatcaggaaggagtagatgaagacaaatgtgtcattggattggattcatgaggtatgatatattctttcattcaatgagaggacgaatatggagagacgaccgcgcgtggcgctagctgggagagaggatgagtagggagaaaaacactacgacaccacacaaggataagacgacacaagtgcgttccgaaagcatgcccatcctacctagcttgatcggacggtcagatttgatttgttacaacgagatataggtacctcaagataccacttgttggatcaaaacaaatttctttagggaaagattgtccccagattcatttatttggacagaagagtaagtttagtattattaaataatttgcaactatatagcttaactacgaagctaacggcccggcgagaaataactaggaagctaacaagttggacaatacagttgatcaaacgtgaaaccagaaaatttttacttgtacaaacatgcgatgattaatcttggtgatgaacaattgtcaaaggtaagtatttattgaaaatgcagtgaacagtgttttctgactgtcggtgaacagtgtgttggcactgggagcctgtcaaactaagcaatgcgcaccaattagatcggaggtgtccaggtagcccgacggtcaaaccggcagactctgggagggagtcagttttgggttgttttcgtgaaatttctagattgtttcatatttatgactactaaatcatttctatacatatgtgatattgtttgtgtgctgatatgagtcaagttggtgctaacttgtactcggacatagagtttcattgttgttcatgtgcatgtgttgcttgaggcccgtgggagtatagctggtgatggattgggactaggcttgtgaaaagttaaggtctagacaatcaatgacatgatgcgggatgctcaggctagacaacatgcacgtgaaggtgaaagttttcatatgacatatacctggtgttgtgtgcgtttagaaagagtcaaaatttggattgcagtacaagtttggaaacattagagtgcggagttgtatggggatgctctttccctggtttgataggtttcctatatatgtgatcaatattcctagttgtagttggattcgtaactaggggcaaccacgttgtgggcacaaatagaagaggggttgattctaaaagatttcgactttctaggagatgagtgttagggtttgcttcaagatttcaatcctagttcgtgaggagagatgagtccattagatgtattttgtaaacacatattgatgcaataaagttttgtcgatacatgtttttctgggttccgacacggtcagactgttaggattatgccggtctaaccggcggcgagcaaccggtcagaccggctgtggcgagaaggcagtaggcaaggaggtggcaatttgaccggctagactacattggtcagactggcggcaaagtgcggtcataccgttgtacgtatggcggtcagaccggctacgccaaggatttcatcaggttagagggtaatttttttaattctatggaaagatctaatacgaatgttatacaagggtaatgattatataaatagaaagtatagaaattttttgttgaactaatatacacattttaggaggaaatattatacgtagaaaatttaacattttttataaaaaacactactagaaaaataatttattgccacgaaaaaaattgtagcatcaatgctaaaattgttgcaatagatacatgttgccacaatcttaaaatcgttgctagccgtggtaataaatagcgtggtaataggttattgcaacgatttttatttagttgcaataaattttgttattgccataaaatgtatgtggcaaaaaatatatattgcaacacttcatatcgttgcaataaataactattgccaccactctatgtgtggcattagttctacgtaccaaattaaatatttcaatattaatttatcatcctaactattttcttttgatatcttgtcatggctaggattcgaacccaagatctctccttcacgcgcgctctccatgaccaactcacctacgcatcaattttgtttaaaaatacatataattccatttgagactgcttaactgagatttgaatcatgaatttgagtatttaaaagatttcaaatgaaaaatttaaattgtagatctcatcgagaggtataaatttcatataaaatttgtcctaatccgtgtccatatgaaaagaataagctaaattatgagatgataaattttttattgcaacgtatttgttgatcatggcaatagaaaatagtgaaagtaccatgtattgtgcaaattgccacaaaaattaaatttgtggcgatagaacatgtttttttgcaatagcaatatttttatggcgatagctcatttcctattgcaacaaaaatactgaataaaacaacgattgtaaatcattgcaacaaagtatagttatttgccacagaaaaattatcattgcgatagtacaatatattgccccaaattattttcgttgcaattaattggtggcaatagctcaattatcttgtagtgaaaatgaatgtatatcatttttaaggatggtaaatataatcattactcttgtataacattcgtattagatgatatgtaaacacaacaaatatgctataggtagcataaataaaatcaaacatatactcttttcaataaataaaatattttaaaattttgatgatataaaaataatcttgtcgtggaaaaacctaatgcaacgcactcatgaatataatagttttatacaagtgtctacacttccaataatatgctgcaaatatttctatattccttccacgcctaagagaaaaattgaccatatcttagctattaaacggtcaactaacaacatggctataaatgtgatcaaaataaaaattcaagggcatacaagggagtgaataaaacttacgggtatataagggatcagctaaagttctagggacatgtaagtaattttctcttaaatattttgttcacatagttagggaatatggccagaaacaagcaacaattaattaggtcctcagtgctaattggtttttagaattaacttgcaagcacctcaaaaaacacaactgcaattaatcttttgaattgtgtgtgttgatccctatgtagctaaacatgaaatcacataaataacctatgaaacttagagtggagacgatactaaatggcaacttcagtggaattaggaatgaaaagtagcaaatgtaatatataattaaaaaaacataatgggctattaataacttctctagtaatagaaaattttggcctacttcttcaactgtccaatgctgaaaatgtttctttgattttggtgatttcagcataaacatcttggattaatggacgatctccaggtgactccagagagcattgtagaccaattttcagcatctgtgtgatacatctctccattatgctcatttcatcaacgtcattatctaaatcatggttccttccttcatgtgtataccgtggaatgatactggcctctaaaatctcaacaacattatgtggatatgcacagtccactaatttgtgaatgtttagcccatccttgaacatgtcatcagttggatgctttcctgtgagcatttctagcagaataactccatagctatagacatcgcctgcagttgatatttggcaacccatcccatattctgcattcaatattaacagaattgttttaaaaatattctaatttgctaagctggcttcaagagacagtatatgaagtaagtattcagtccttaaaataacaaggttagtagcgaaagcaagaattcacatgtgaagaaaacaagcttaaatttcttggatgatagtcgtatatgtatttctgaataagatacgcctaaattagtcaatatgaagaatatatagaagcatgaatgttcacctggtgcaatatatccaactgaccctcttggtcctgctatgcttgataaactgttaagccctgctgaagaatggttacagataaagtcactaacatgagcaaccatgtcctcatccaaaagtacattacttggcttcaaatcacagtgaacaagcggaggtgtgcaccagttatggagataatccaaggcagcagcaatgtccgttgctatctgtataattgatcctagacctaatggtcttctttgtcgatgtttttgtacttttggatgaagccaactttctaggttaccattagccatgtactccaaaattagagctttaaactcttttcccattggatcgaaggaggaacatagactaatcacatgcatgagatttcggtgccgagtgttccttagcacctcgcattcagccaagaagttatttgatgctccgatttcgtcaagtttgaataccttaatggcaactggctctgcatcaattttgaatctacctatgtagaccaccccaaatgccccggaaccaaccaagttgtctgatgaaaattcattggtagctttggcaatctcagcatatgtgaacttccactccttacaagactgatcaatttgctttcccaggttatttcgcttcttgtaaagaaatgtggcaacacatatcattaggaatgtagcagcactagcaagtgggacaactattgggatgatataggatttcttgtttgttttggatgatgttgatgtgcaaagtggtaattgcagcattgaagaccctgtgcataattccctattcccttgtacgaacaccttacttgaattgctaaatacaccatatgtaggaaccattccctcgagattgttgaaggataagttgaggagctgcaaagagctgaatgtctcaaaaaattttgggatttcaccagacaagttattctgtgagagatccatctcattgatgcctcttaaactcgtgaaggagtccgggatactcccatttagaaaattcacttctaattgtagggactccaagtgaaggcactcaccaagtgtatgcggaatctctccagataattggttgttggaaatgttaatagagtcaaggttaattaaactaccaatcttagatgggatgggtccactaaatccattgtaagacaaatctaggccttttgaaagtgaggagatcgacaagagctcgggtggaatgattccattgaaggtattacatgagaggttcagcattaccaaatttttgcaccttcctatgcttgaaggtatggccccactaaagttgttctcttggagataaagctcacctaatttttcaagttttccaattgattgtgggatttccccagaaagattattgcgatgtaaccctaggacaaacaagtttacaaggttacaaagtgtttcaggaatgtcccctgagattaagttttctgctagatgaagaacagtgaggttattgaggtttcctatctctgaaggtatggtccctgcaattctgttgttggtcatatataacgtttgcaagcttcctgggagattgccaatggaactaggtaagattccatgaatcctgttgttatccaaatatattgccaccagtttggtagagtttatttttgaggacaaggatgtccagtctacagattcaaataggttggcaccaaggtccaactgggtcaagttttgcaaagcccagaaagaaggaacaacaccagtgaatgtgttatcacggacctctagcacttgaaggttcaaggcattaactaaagaggttggcagtgtgtcggtgacatgggaccgggagtatcactactaaaggcttggacaggagcaatcacccacgaggcctgacccccttgggggggtcgggcccgagggtgacgtggccgccccccctctttgtctccccgaggggtcagaccgcttccgtttcagccctgagggctgaggcgccccgaccccttgcaggtttggcgccgcatgagtgggttaggtgagcgcagcgggactcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaacattacaagcaaggtgttgtatgaagaagggcaaacatgcagattgctaaactgacgcgtggtggacaagaatgaccgacatgaccggtctgatactggtcatgtcatcagcagacagccatgatcccacgacgcgcctgcttccgacgaaagtggaggtagatatgggccgtcccatcagaagatgattcggagggcaaccatgcaaatctccgtcgattcatgaagagaagggaagtcaaattggtaaaaagagaggcaagtccccacacaaaaaagagaggtggtgcatgtggtatcccttgagatataaaaggaggaccttgcccactgatgagggggattcggatggggagagctagattgagaaaaagggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcatctggcgcgtcagatagggggctttgcgtgtgtttttctaagctctcgtattctttcgtgggcgccaagcttttcctgttcagcccaatggccgagcaagcaaacgcgcccaacctttctccgagcatcagcggagacgacggggagccaaacccacgccgtcgagctcgtactccaccgccccctccacgccaaagtcctaggcgggaggaggcgctcaagagggtcgaaggatccgcgacttcgacatccacgggtgatggagaagggcggcgagatggggagcgtcgcatcctcgtctacggtgacggcagcacgccccagggcacgctccaagctgcgggcgcgctcctacgtcacccgcccgtcgtccctgacccggagtctccagcccaacgttggctggacgacgttgccaaattggtcatgacggcgcggcagcgcctagatgctggtggacggacctccgccacaaagacctctggtactgctgccaccggctccgcgtcgtcaagacgaagggcgcggcgagcggcggccgctgttcgccattcggccgccactccttcgtcaacgcctccgacccgggaagatccgcgtggggggccggacgtccgcaccagcatcgagcgccggcgtaatggccgacgtgctgcccacgcaacggagggcgcctcctcgtccagagtgtcacctcaacacggacgcggggatcagccctccgtgcccctggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgttgggggtgacgacagggtcatggcgaatttccttcccatggccctgaaggggcaggcgcggggttggctaatgaacttgccacccgcatctgtccactcttgggaggatttgtgccaacagttcactatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaaaatcgcctccaaagagccccagactaccgcggagctttttcagctcgcggaccgagtggctcgtaaggaggaggcatggacccggaacccctccggttccggtgtggcagcttcggccgcccccggatccgctgctcagacagggcgacgtgacaggaggaggaagaagaggtcagcccattccgacaacgagggtcatgtcctcgccgtcgagggcgcttcgcgggccacccgaaaggggaggcctgcgagcgacaaaaagaagaaggccagcgctcctagcagggagcgcccaaccggcaagtggtgcaccgtccacaacaccttccttcacgacctcgcggactgccgcgcagtcaaaagtttggctgagcggacgaagaagtgggaggaggagaggaggcaagagcgccgtgagggcaagtccccggcggttccttccggcaatcggcgaagtgaggccaagcagaaggcccccgccgaggacatcgatgatggcgatgatgacctaggtttccaagagcctggggccactattgccactgtcgatgggggagcgtgtgctcacgtttctcgccggagcctcaaggccatgaagcgagagcttctggccgcgacccctactcatgaggcgacgcgccgggcgcgatggtcggaggttgccctcaccttcgaccagaccgaccaccccctgtgcgttgcccggggaggacagatcgcaatggtggtttcccccactatttgcaacgtgaagctaaggcgtgtcctcattgatgggggagcagccctcaacatccttttccccgcagcctttgatgctatcaaggccccggggatggtgctccggccgtcccagccgattatcggtgtgacgccgggtcacacttggccgttaggtcatattgacctcccagtcaccttcggtggatccgccaatttccgcacggagctggtgagctttgatgtggcggacctcagtctgccctacaacgcggtcctagggaggcccgcgttggtgaagttcatggcggcggtccactatgcctacctccagatgaagatgccgggccatggcgacctcaaagtcgcgctcgcttgtatggagcagcgcgcggaccacctcgccgctgcgtccaagcccgagggtggcgacgaaaggcttagcacctctgtccccgccgccccgaggcagcggatgatcacatgcgacgaggtcccggtcaaggaggttgccctgggcgacggcccgtccaagaccacacgggtcggtggtcttctggatagcaaataggaagacgcgctcgtctccttcctgcgggcaaacgctgacgtcttcgcatggagaccggcggacatgcccggggtccccagggaggtgattgagcaccgtctcgccgtgcggccgggcgcaaggccagtccggcagaaagtgcggcggcaggccccggaacgtcaagccttcatccgcgaggaggtggcgcgacttctggaggccggattcatccgcgaggtcatccatccggagtggatggcgaacccggtcgtcgttcccaaggcgaacggcaagcttcggatgtgcatcgactacaccgaccttaacaaggcatgtcctaaggacccttaccccctgcctcgcatagatcagattgtcgactccactgcggagtgcgaccttttgtgttttttagatgcatactctggttaccatcagattcgcatggctagggaggatgaggaaaaaactgcgttcattacccccataggaacttattgttatacgacaatgcccttcgggttaaataatgcaggtcctacttttcagcgtactactcgaatttctttgggtaaccaaataggacgtaatgttgaggcttatgtcgatgacttggttgtaaagacgcgcaaccaagagaccttactctcggatctagcggaaacttttgagagtctccgctccgcccgcatgaaactgaatcccgataagtgcgtgttcggtgtacctgcgggcaagcttctcgggttcttggtctctgcccgaggcatcgaggccaaccccgagaagatacgagctatagagcggatgcgccccccagcaaacttagggatgtgcaatgcgtcaccggttgtatggccgccctaagtcgattcatatcgaggctgggagagaaggcgctacccttatttaagctcctcaagcgctccgggccgtttacttggacggaggaagctgaacgtgccctcactcaattgaaggcgtatctcagctctcccccagttctggtcgcccctgagccaaatgagcccttgctactctacttagcggcgacaccgcaagtagttagtgcagcattggttgtggagcgcgatgaggaaaatcctcattccgcgcatccccaccctgtgctggcttggcccgggagagagcagggaggagaggcccccgagccaaacggtggcccaaggcccccgacgaccggagctggttctctgcccgcttgtcagacggtgccaggtgcccccgacccccaggatggcccggcggccactgcgggaaggccgcacctatcatcctctgaccccgaggctaaccctgtgctgactcgacccgggagagagcagggagaagaggcccccgagccgaacggtggcttaaggcccctgacgatcggagttggcctctcgcccgtttgtccgacgacgccaggagcccccgacccctaggacagccccgaggccactgtgggaaggccgcccctgtcgtcctccgaccccgaggtcgtcggcacagaagacaagtgcgccccgcgaggccacttggacgaagaacgcccctgggatgcggcccctggcgaagaggatcggccccaccgaaaggtgcagcggcccgtttacttcgttagtgaggccctccgggacgccaagacccgataccctcaggcccagaagatgctttacgctattctgatggcttcgaggaaactgcgccattattttcaggcgcatcgggtaaccgtggttacgtcttaccccctcggtcaaatcttgcataatcgagagggtacaggacgggtggtaaaatgggcaatcgaactttctgagtttgatttgcactttgaaccacgccatgctatcaagagccaggcccttgccgattttgtggcagagtggaccccagcacccgagcccgtctcaatccccgaggctagctccgacccctcgcagctgcctcacaccgcccattgggtgatgcagttcgacggctccctgtctcttcagggcgtcggtgcgggggtcacgttgacctcgccgagcagagacgtcctcagatacttggttcgccttgactttcgggcgaccaataatatggcagagtacgagggactccttgcgggactcagggtggcagctggactggggatccgccgcctccttgtgttaggcgactcccagctggtcgttaaccaggtctgtaaggagtaccggtgctctgacccgcagatggacgcttacgtgcgccaggtacggcgtaaggagcgctattttgacgggatagagcttcggcacgtgcccagacgggataacatggttgccgacgaactctcacggctcgcttcctcgcgagcccagaccccaccgggcgcctttgaagaaaggcttgcccagccgtcggcgcgacctgaccccttaggggagacggacgcgcctgaccggcccccgaggcccgtcggagtccaggcctcgggacccgaggggagcgttcccagctcccttagattgattgcttggatcactgagatccaagcatacctcacagataagactctacccgaggatcgcgaagggagtgaacgcgtccagcgcattttcaaacgctacgtgctggtagaagggaccctctatcggcgcgcggctaatggaatcctnctgaagtgcattcctcgggaacaaggcgttgagcttctcaacgatatccatgaaggcgaatgcggagcccactccgncttgcgcaccttggttggtaaaggctttcgtcaaagtttctattggccgaccgctctcaatgatgcagtggatcttgtccggcggtgtagagcgtgtcaattccacgccaagcgaatcaatcagccggcccaggccctgcagaacatacctctttcatggccatttgctgtctgggggctcgatatcctgggaccgtttaggcgggccctgggtgggtttgagtacctgtatgtcgcaatcgacaaattcactaagtggcccgaggcttatccggtcatcaagattgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacctgcccaccccagaagcaatggccaagtggagcgcgccaatgcagaaatcctcagagcccttaaaaccaagaccttcaacatcctcaagaagcacggcaattcgtggatcgaggagttgccagcggtgctctgggcaaaccaaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgattacttagaggagcgaaggcggcgcgcggccctccgagccgcgcgctaccaacagagcctgcggcgctaccatcagcgccacgtctgggcccgatcactctgcgtcgacgacctcgtcctacgccgcgtccaaacgcgtgctggattgagcaagctctcaccaatgtgggagggtccgtatcgagtgatcggcgtcccccggccaggctccgttcggctggccacgggctacggcacagagctgcctaacccatggaacatcgaacaccttcgtcgcttctacccctaaggaggatcaggtgtcaggtttcgggctcgggccaaccccgcacccccctcgggcgtgcagggttggccgggggctaccacatatgcatactcttatttctcttatatctgtatttcaataaaagcattttcaatctcctaaaggctgtatctgtactgttgtttccttttgaagaatcttaacttgaaataggtcactcgtgctcaatcctgccctcggaggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctagacacgtggatctccccaggcactagccccgacccgtgccttttgaggactgggacctgggcacgagcccttaatcaagctaagacacaaaaggaccacgtcacatatcatcctcatctcatacacatagcaaaatgaaattgacacaaaaaatttcttcatttttgattgcagattaagttaatttatacaaaaaagaggaccgaaggccttagaaaaaagaaaagaagaaaactgaagattggcaggggcctaggggctcaatccgacgcgcccgggtcgccagcctcgtcgccattgccgcccactccgccgtcatcgtcctcctcgtcggagttgagggcaaacgcaagccgaggggccgaaccctcgaagctctggacgatgtggtcggcagcgtcccggacctgtgcgcgcgcgccgtcctcggtccagggagggaactcgtccagcgctgtccatggagagaagtcgggattcctgacctggtagctcgccagtacaagctccaccgctccttgggcgaggtccctcgaggataacttgatcgtcctctcgagctcctcggggagacgttgaagagttccggccatctccgagaggcgctgggcgaggcccccctggttggcggcgtacttcacagtccgcccgccccagaggcccacctgccggccggcgcgatctagatgggagacggcgtcccgaagcatgccgggccctacctcgcctgccaagcggagggcctcgacctccccggcggacgtg

SEQ ID NO: 4222 - DNA, 3025 bp, Oryza sativa
ccagcaccttcttacgggcttcaagctccgagacgtgccggcggtgagccttacggcccacctccaccatggcctccaccgagcgtcgcccctcttcgacacgcgcccacgcggcgtcgagctccgcccgctctgcttgcagggcctccacctgggcacttaacccgtccaacaccgtggtgttggcggcggccaaggcctgcagaaggggctccgcgctcagtggggcaacagaaggtatggggaaaagccgcctcggagaggatgccgcgcggctcggcccaccgatgaacgtgccggactcggggatgtcctccggacctggttggtcctgagcgtcgcccgagggggtgggcccaagcgatacgcccgcggcctcgtcgccagctgccccggaagtcgtcgcctgagcgtcgcccaagggagagggcccaagcgacgcgcccgcggcctcgtcgcgagctgcctcggaagtcgccatcgcctcgtcctggcgagcccgggcggcctcctcccgagcggcttcctcggcctggcgagctcgggcggcctcctcccaagcggtttcttcagcctggcgagcccgggcggcctcccgagcggcctcctcggcttcccgtaggcgatctgcggcttctcgccggtcagattcccgcctccgggcctctgcggccgccggatcctcgacttcgggctggccggccttggaatggtgggaggaacgcgacggggtctcactaaaacagaagaaagatcagaagacaaacaaaatgggtgactgaaaactcgcgttgagaggatgaatacagccatgatgggcgtgggacaaacctgcgagggggtcggttaaacgaccaccttggaggggaaatgaggtttccccgagatggttctgtctcccccatcttgcggagccacttcttctttcgctccccctcgggctgcgacgtcggcgtggctccctccgggcgcctgctgctggcacgcgccgccccgccccctcggggaggagatgggggaggggatcctccctgcttcctcttcccccgggcgtcggcagggcggctgctccccgggcccccgtcgcggggcccagaagcacgaccccctctcggggtagattgttcccccctgcggctcccgcccgcgccctcgtggcctcgaggagcccgctcctccgacgccccgatcgcctgcataatggtcaggatggaggcgcggtctggatcgctacagagggggaggactccttggggaatgagggatgcctccacggagctgagattcagcacccgttggactactatcttgaagtcctcaggagcccagtcccatctgactccctgatgggtcctcatgtagtcttcggacccggtgtactcccaagcgccccgggcgcgtcgctggagcggcgcgatccgacgacgaaggtagtcgccgtacaccatggcccctgtgagcccctgggatcgcaggcccgccaggcggtcgaggacggcgtcatagccatctcccagatcaaccggagcccgccagctggaggcctgcgccgggggctggctcggaagtcggaggcgcgcttcgtctgcgaggggggtgtagaaccagtcgctcttccagtcatcccacttcttgcggaggacgcaggggatgtagcggttcagcaccggcccccgcggctggaagtagcagccaccaaccaccgacggcggcgacaccgactggacggtgaagaaccaccggaacagccgaagggatgggcgcactccgatgaacatctcgcacaagtgcgcgaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagtctggcgccgggtgtccctcgcccagcatgactatctcccggccggtggcaggttccggcatgaagcggcgcggcagcccggcctgcctcttgctcacaatgcgggaaggcggcagcacgctaccgtcaagcagagcagagccccgtgccatgacgccggaggaggaaatgattgagagcgagcgcgtgtggcgaaggtggggcacaggaaagaaggagttagggcgcaagtaggcgaagacaaggggaataatggcgaaaggaaggaagcaaatcttttcctcgatgtctttatacccttgccaacgctgtgcccggctcctcgcttctcgcgcccactatttcgctccctcgtttctcgcgcccacgcttccactaatcccattcgcccgcttgcggcgcatgaggtggatatgcggttgtggcagtcgagatagatcatatcgtgcgcgcgttaattacgctcgccgaccaaagcgccatcgccatatctccaggcaaaacgaaccggctcgtcccgattcgtgcaatacttgagtaatgtggcagtcttgaagaggccgctcattattcacagtcaagtcaccgttgccggagtgcgtgatttgagaccgctggatttctgcccaactgtggagatcggtcccacctgtcaccagacttttggaagtggcgtcacacctgaccgcttccctcgaagagagcgatcgccctggcataacgccgggggctactgtcggtgacatgggaccaggagtatcactactaaaggcttggacaggagcaatcacccacgaggcctgacccccttgggggggtcgggtccgagggtgacgtggccgccccccctctttgtctccccgaggggtcagaccgcttccgtttcggccctgagggctgaggcgccccgaccccttgcaggtttggcgccgcatgagtgggttaagtgagcgcaacgggacttacctaaccgcatttattgggattaggacaagcgcgttacgccgcatgtaacgcagtgcagcgcgctcgtttatccggtctgtgatcagtcgcagaccaaatcgtgggttaagtggcgaca

SEQ ID NO: 4223 - DNA, 36242 bp, Oryza sativa
ccgtcccatcagaagatgattcggagggccaaccatccaattctccgtcgattcataaaagaaggaaagtcaaattggtaaaaagagaggcaagtccccacacaaaaaaaaaaggtggtgcatgtggtatccccttgagatataaaagaagaaccttgcccactgatgaggggtattcggatggggagagctagattaagaaaaagggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcacagtggaccatcaaaatgatttccttctaggatcaatgtttcaatgtttggtagagtgtatccaatgttggttggaattctcccaaaaaggttgtttacccctaggccaagataagtcaaagtcgagattgtgtaaagagatggtggaactgtgccggtcaaattgttataagccaagtctaattcttgtaaatatggaattttggttatgctatctgggatatttccttgtaggttgttttgagcaactaacaaggaagatagggaactcagatttcccaatgcagctggaatacctccaaagattgtgttgtttgtaaggatgacatgcagaatcggtgcggatatcagtggggcagaggggattgaccatctaatgaagttattacttgagagatctaaggaaagaagagatgagctgttgaagagggcagaagggattaccccaccaagtttattttgtgacaggtcaaggtatctgagtgatgagcaattcgctaagataggtggaatactaccagttaggctgttatatgcaaggacaaccatggacaatgatgttctacttcccaaagatctaggaatactacccacaagcttgttattagcaagcaaaagatatttaagattaggcagtgaaccgatcccaggagggattgttccattgaggttgttatggctgagagcaatttcttgaagaagtgaacaattagcaaggtttgatgggatctcaccttcgatgttgttgctccacatgtcaatgacctcaaggtgggtacacgatgatatggtatccggaatcatccctgtgatggaattcatgcctaggtttaggttcctgagctgggttaagcggccaatctcaggaggtatgtggccactgatttggttatccggcatgtaaattgttgtaaggaagctcaggtcggcaatgcaagggggtatttggccagtgaggctcagtgatttaaggcgaagagcgacgacgcgagctgcaccctggttgctgcatgtcaccccatgccaatcacagaatgcaagtgactcttttctccatgagtccagggctcccaaaggatcagagaactgtgatctgagacaaaggagggcttgccggtcggcttctgatgtgttatgggttctggatggtgctaatgaacttacacaaggacatgagctgacgatgaggatgataagtatcagaacaggttgtgccaataatgctttctgggctgctgctgctacaggcatcttgctctcccttttgctagctatagcagattccttacagattttggtttgatgaaactggaacatgctggcatttatatagagcacaagcctagtgaccactatgagcgtgtgagagggggcagacaagaatttgagtgggtgatgcagaagagaatcaatccctggttatattggtcaccagtgacgacacaactttgtttgtttggactaaaatttctctgtaaactgtgggtgtgttcagctcatatactttgactgtttccataaagcaacttttagaggcattttgaagtggcaggttgatgtcattgtcagcgtagagtcataatccaccacaatgcaacgcgctcttgattcagtacacaggtcagtcaaaaattcactatgtggtatatatatcacttagatggatagttattaggccacccgtcatatgtttagttgtctactccccgtatgtgatcattggcatccttcgtacgtttggttgtttactacttctatgtttatagaagaaatcccttatatttatagtgctcattagtacaaaataattgatatagatttttctgcccgatatgtcctaaagtttcataaaagatgtgtgaaagataggggttttcgtacagaaaaatttttatgtagtagtgagatgtataaaaatttttagtataaatttgatagtacctgttaataccggagttaccaaatattacgggggaaactcttgataccttattaagtacggtataatcactctaaatatttgggttgaagggagtagtagtacagttagtcgccgactattacatgcccttttttagaatgacgacgaagaaaatagttaagctgccaagtcgccgtaactgtttaattagtgcacggaaaacgaacgccacaaattaaagccaaagaatccaccagttgaccctgagtttggccggctgaaaaatacatccatcatataaacaagtgactcgaaacatccctggtattggcacaatggcactgaactgcagcatgttgtggttttgcccatctctgtcgatgccctggacttcaaaaatttacagtccacacttatgctagctaagtgtatgtgcgtgtgtatatatatatataaatatatatatatatatcctctaatcgactttgtcctgcacttgtgcttcgttattctgaaagctgaatcacaacaaatttcctagacaaattaaattagctagctataattaattgagatgaacacgacaagtttcttgctccagattctgctgctgctagcgatggtgattcttatggcaatggcaatggagcctgctgctccagagacaatggcgcgacgatctcccggtaagttttatttgattttctcatgctgcacaggccacggaatctgaaattatttgtacgaggtttgctccagttcaacaaaaagtatctcgaggtatcggtatctcacgataccaaatcgtttccgatcgttggatctagctaagaaaaatggtcattattagatctaacgattgaaaacaggaaacgatttggcaccgtaaggtatcggtattttgaggtacttttggttgttatgaagcaaatctctattcgtatgcatgttttttggctgtgttcttcccttaagattcatgacctcatctatctcgttttttgtgcctacgctttctaaactactaaacggtacgttttttttaagtttctatatgaaagttgctgtaaaaatcatattaatctatttctcaatttttttttaaactaacacttaattaattatatgttaattcgtcacttcgttttgtgtgcaaagcagagcatcttgctgccatgtgttcattcatgtagagcaattttggaactttttcatttgtcaaaaattttggccccacttcttttgcattgcttcatgtctgcgtcattaattttagcagcatgcatgtagatctatgtatttatcataatttaagaattgaagtgattgattattggtctctgaaactattttgattttgggatttctgtgcaggaaacgtgaatgctaatcacgacccgtccaaacaatctggttctgcagtgcaccccctcaatacaccatgcaactacccaggacaagctggttgccctcattgatagttcgtgctactcagaaaaagatgaaattaaataacagattacaacaataagcgccaatacatgagcgtctggttatcgacctcgatgtgtccaattaaaccttgtactcgacctgattttcacctaatgaacgagtgctttccgctacatattttccctattttttatggttgctacaaatgcatggatgcatattacacacatgtcgatcagatcgcgcgaatgatgagaaataatttcgtgcaaaaattaaatacgggaatgcggcaattctcgtcaaaccatgcaagacctatcaaattttgtttgaagaaatcatttgggtgtggaaaatctctctcaaggtgatcctccattctgtgcaaccatacaggtgaaattcgtagtcgatggagagaagaaagacaacaagatcaggccgcgcagacgtacgatcagtgaggaatgatggcagtgcgacggcagccaccattcgttgctctcctcagcagggttagcatgcaatgcattcccgatgcctcacatgtccatctacgaattttttttttaataatggaatgaaacatttcggcctttgctcatcagagctacagctaatgttgatctacgaataaataccgaaaaagatttatcactgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttgaggtgcttaattaacacgcagccgtcgaccctagcgtgaagggcgacgttcctatccatcgtgttttcccacatggtatcaaagcgctgaagttagatcccatctgccatggctagctcctcctcttgcacctcctccacaacaaatcccttgttcggcttccatgtctctgagaagttgaacaagcagaattatcagctatggtgtgcgcaagtgctgactatgattcgcggagcacgccttgaggggcacctgaacggcaagaccgtcgctcctatcagctatggtgtgcgcaagtgctgactgcgatttgcggagcacgccttgaggggcacctaaacggcaagaccgtcgctcctaccacccagatcgaagctgaatagaagaaagaagatgacaaggcgaaggccaagatcaagatcgacaacccagcgtatgaagagtggtttgctgcggaccaacaggttctcggcttcctcttttcatcgctgtcaagagagatactatcccaggttgccacggcaaccacggcggcagaagcatggacgatgatccaatgagatgttcaactccaggacacgcgcacgttctctcaatgtgctgttgtccctcaccagcactaggaaaggaactcagacaatctttgagtacttcgccaagatgaactcacggcgtcaggaaaacaatgcgatgctgaagaactaactgcttttattttgaatggattagatgatgattatgattctgttgtatcggctctagcagccaaaactgaacctattactctgtcagagacatatgcacaacttctgaattttgagaacaggctgaacctacggtgagaaggcaatctgacggccaacgcagcaggacgtggtcgcggcaacactccaagtaaccgcggcggcagtggcgtcggccgcggcaacggtgctcgtggtggcttcaatggtgctggtgccaactccggccgtggaggccgggtcatggacaacagcagcactccggcaacgacactcggcctgtgtgccaggtgtgctacaagcgcgggcacgttgctgcagattgttggcacaggtacgacgatacctatgtgccagacgagcgtcatctcgctgcagccgcctcctacgcctatggtgtcgactccaactggtacatggactcgggggcaacagatcacatcaccaacgagctggacaagctcaccgtctgcgacaaatacaagggaaatgatcaagtgcacacggccaatggagcaggtatgaaaatcgagcacatcggtcactctttagtgcacacccccatgcgcaatcttattctcaaaaatgttttacatgttccacaagctacaaaaaatcttgtttctgcatctaaacttgcctatgataattctgtattcgttgaacttcatggaaaacattttttggttaaggatcaggctacgagggaaacaaagcttgagggaaggcgacacaagggtctctatccacttccatctccatctcctccaaaggcagtctatggtgtggcaccatcttttgcaacatggcacagtcggctagggcatccatcgagtccaatagtgtctaaagttattagtacaaataatctaccttgtcatgacaaggctagcaaagagtctgtgtgtgatgcatgtcagatggccaagagtcatcaacttccttataataaatctactagtgtctcgcaatttcctttggagcttatttcatctgatgtttggggacctgcccccatttctgttggtagaaataaatattatgtgagttttgtggatgattatagcaagtttacctgggtgtatctccttaaagcaaaatcagatgtttttcgggtctttcatgaatttcaagcccttgttgatagaatgtttagtcaaaaaattattaccatgcaaactgattggggtggcgaatatgagaaactccattccttttttcgacaaataggcatctctcatcacatttcatgtccacatactcaccaacaaaacggggcagtagaacgaaaacatcgtcatatagtagaagtgggtttatctcttcttgcacatgcatctatgccactaaaatactgggatgaagccttcctagccgccacatacattattaatcgagtcccaagcaaagtcatttcttttgaaacacctctagaacgcttgttccataaaaagcctgattatcctgctcttagaacctttgggtgcgcctgctggcctcatttgcgtccctataataatcataaactccaatttcggtccaagcaatgtgtgttcctcagctatagccagctccataaaggctttaagtgccttgatatctcctctgggagagtatatgtttcacgagatgtgatttttgatgaaacagtgtttcccttttcacaattaaaatcaaatgcaggcgcccaactaagagcagaaatagccttgcttccatctgatcttgtagcgcatgatcaagggggagagcaacagagtgatcatgtacttgattttcctaatgccactaatggtttggatgattcttccagcagtacagatttttgtggtacagatgaacgcgtggacctaacacattcggcaacggcatcggatggagtgaatggagcgggaaactccactccgggatcggtgcctgacgtgaccagggagacagcgcaggcgccggaacagcagcaacatggcgaggatgctcaaccccactcagccagcgagacgtttccaagcagctgcacttcatcggctagacctgtaccacaccagaccgtgcctgcactgggtcatgatctgaccggtactagtgctgacacttccactgatggcgttgctgtgcaggacatcgagcaaggagctgaaggcgagctcgacttaaacagacccagaacaaggctacaaggaggcatcagaaaacctaaggtgtataccgatgacactgtaaggtactcctgcttcacctctacaggtgagccctggaggataaacactggaaggatgcaatggatgcagagtatacagccttaatgaaaaataaaacatggcatctcgttcctcgataggaaggtaaaaatattattgattgcaaatgggtatataaggttaagagaaaagctgatggaagtctagacaggtataaggctagattggtagcaaaaggttttaaacaacggtatggtatagataacgaagatacttttaaccctgttattaaagctgctactatcagaactgtcttgtctatagctgtgtccaggggttggagtctacaacaactggatgttcagaatgccttcctacatggagttctagaggaggaggtgtacatgaggcagccacctgggtatgaaaattcctctaaaccagattttatttgtaagttggataaagccttgtatggtctaaaacaagcaccaagggcttggtatgcaaggctaagtggaaaattgcaacaattaggctttaagccatctaaagcagacacatctctgttctacttcaacaaaggcaatgtaaccatgtttatcctgatatatgtggatgatattatagtagccagttccaccaaggatgcagtgccagctcttctacatgatctaaaggaggattttgctttgaaagacctaggagagcttcactattttcttggcattgaggtcaataaggtaaacaatggtttaatattgacacaaggtaaatatatatctgatttgttgaaaagaacaaatatggcagattgtaaaccagtaaatacacctctatcaactacagaaaagttgtctctacatgaaggtgatttactaggacccaatgatgctactcagtatagaagcatagtaggggctttgcagtatttaactctgactaggccagatatatcattctctgttaataaggtctgttagtttcttcatgctcctacaacagttcactgaacagcagttaaaagaatcttgaggtacctaaaatatacgtcaagtttgggtattaaatttaatagatcagtgtttactcttgttagtgcctttacagatgcagattgggctggttgtcttgatgatcgacgatctacaggaggatttgctgtatatcttggctccaaccttgtgtcatggagtgcaaggaaacaagctacagtttcaaggtccagtacagaagcagaatacaaggcattagcaaatgctacagctgaggtaatgtggattcagaggctgctaaatcaacttggcattcaagcaccaaggtcagcgaaaatttggtgtgataatattggagccaagtgtttgtcagctaatccagtttttcatgctcgcactaaacatatagaggtggattatcactttgtcagagaacatgttctgaacaagctgcttgaggttgaatatatttcttccggtgatcaggtagctgatggattcactaaaccacttgcggtgaaacaattagaaatgtttagaaacaatctcaacttgagaagtttagattgagggggagtgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttcaggtgcttaattaacacgcagctgtcgaccctagcgtgaagggtgacgttcctatccatcgtgttttcccacaatcaccataatatctaaggatttatcgagtacgcagctaggaaatcgagcagggcttctggatgatgtggctagcacgcgagggcccttttatagtcacaccttttgccattttcaatatgcttcagccttcagcaattactgatgggagaattggcactggtgggaactctggtaaggagaattgccattgtccatttgtttatatacagcccgttatgtactttgtattttcaatgttatggcatgttaaaaatgttattatccacaatgtggacacatctttaataccttttttcaccagcaaattaaatcagagtaaacatattacacatgacaccgtagaaaaattactgcttgctggaatgcagctagaaaagttcagcaagtaatgaattgacacaagtttttttactgttgctatgataatttgttaatcaagacctaacagtagcaacatgatccaggaggatagtaatttgacttgaaatgggaggttatataggatagtgaacttttgtttgaattggaaatgggaggggaagggaatgggaggacgcggagtgagaactggaaaaaaaacaaaaagaaaaggacagatccgagttatgaatattccctctgcttcaaattatagcaacatggtactggattggtatatattgagacaaaaggtaatagcatgcaatgccttatttgttagagtaaaattcaatttagcccggttcttattgccaatgtggcttatttatgaggcaaaattgctacatgacactcaaaatttgtgtaatttgctgatagacattgaaaaaacgtgtcacggctgaaagacatagtaaaaaactagtaatttactagaggacacttttggctgaattggattgataaattcttaataaagacgataatgtccctataagaccacatacttcaaacatgatgttagcgtaaaaaacttaaaaattatgcaactctaaatttgccatcacccaagtacatcacaagcatacattgtattccatcttcgttgcagtctcggctcaaaaagatttggactctagtggtattcttgtctttttaaagaatttctctctccaattgagctgaaagtgtcctgtcggcaacttaccggcttttcagagtgtctttcagccgtgacacgtttttacgatatctaccagcaaattacacaaaattacacaaaatttgagtgtcctgtaacaatttttgcctatttattagagtagatttacaaaacttgagccactgcgctaattcatttgcataggttggtactggttgctaggtgccaatccacagcaccaagagtccaagattcccatgttcggtttggtggaggccttggccatgagcagcggcgacctgacgttatcaggatcattgtcgcattgctgcaatatatataatcctcgttttgaagggaacctctccttttgctttcttgcagctagcagtgccgctcgagctgcagcaccaggtgacctgcgattttgcctcgattatttgctgccaatttttcactccgcatcgtcacgcggtctgaccggattcatcatcttctgtccgtcggtgttttcgtgcaatagggagtaaaggccgtgttttagttcgtgtgccaagtttttttaaagtatacggacacatatttaaagtattaaacgtagactaataataaaaaaaattacagattctgcttgtaaaccgcgagacaaatttattaagcctaattaatctatcattagcaaatatttactgtaacatcatatatcaaattatgatgtaattaggctcaaaagattcgtctcgtaatttatacgtaaactatgcaattggttttttttcgtctatatttatagctctacatatgtgtccaaatatttaatgtgtgtccaaatattttatgtgatggaatttttgaaagtttgaagggatctagacgctgccaaaatctggctgtgtgatgggcgtatggatgccagaggccgtcttggaggatgcgagcgctaagtctggtcaccggtgctacctgatgtgtgagcaaggagaggacgacgtactggagcgagatagctgcgaagatgcatggttgcaatacatggttagaaatcctggtccaaactgaaaacacaacacttgctatatatgcatcggtccaatatgaaaatctgatgacaaataagcatggcccaagatgaaatttactctatttattatatatgtttaattgtactatttgtcgcaagtatattttaaaaaatattgatggatggagctttcaaagtttaataaaatattgttaaaaatgttactaagtttcccaaaaaaaaaacgttactaagtttgagaggaatgactgatatatagaattagaggaagtactaacaaaattttgatctaaacattaagtatttaaatatttatatatgttcggagggagtagtacagttagagtctgtttagttgttgcctaacattgccataactcaatttgctatagatgtggcatggcaaacaatttgtggccacaagtgtggcaatgtttggctagaaaatgagtatacgacatgtaagcccatgaaacaaaaaagtgtggcttgccacaactgaaacaaacaaccaaacgctaagctaacaatctgtggcatgcttaacatgtggtgtggatgtgtggcaccaaaccaaacagccccttttcaccagcaactaaacaaaacaaaggaaaattttgttcccttttttattcctttgacaaaacaaagaaaattacgctgccaagtcgtggtaactgattaattagtacacgggaaacgaacgtcacaaaggaaaagaatcttccagtaggccctgcgggtggccagctgaataatagagccatgcatgcatgtaaacaagtgactcgaccttccctagtatatgacactgatcagaatgtaattactttgcatgatgcttttgcctaactctgtggatgccttgcacagtccacacttatgctagctaaagtgtatatatatcctctaatcgactagcatggtagatatataacccgcatgtatgcatctttgttgtaaacttgtgcacttgtgcttcctgctcctctgaaaattaattattcaatcagcacaagttttcctaggcaaattaattagctatctaactgattaagatgcatactactactactactacaagtttcttgctccaaactctacttctgctagtgctggtgattctttcgtccacaatggcggacattgcggattctactgctccaatcggttgccagagctgcttctgcgatgaagccgcaacaccgtcagcaaacgaagggcagatgcagttgtcgattcaggctgcaacaggcagacgagggcgtcctcctttcatcccccattgcgatggaaatcctcgtaagttcgttgcttcatgaatccatatgtatatatgtatctgttttctcatgccatgcatccgtgtacagcagtttcgaaactgtttttgttcgttaataattcttcttgttttatgtttaattagcgcgtggcacgtagaccaaggtatattcatttggcctgtttagtagggtttcaactcttaaatttaactcgaatagttaagtttggagtgaagttgtcgagcagcataaaccatctctacctgtttagttcattattttgtgaaagtactgtagcccatttcacaccattttggatagagcggaaactatttggttggactctagttctagaaaagattgggctggagctcaaactctaccaaacaaatcttgaagtataattctcagtgcatggacctttgcttgattttggagttcctgtgcagaaagggtgggtgatagctctgatccgtcccctctacctggttctgcagtgcaccctcccagtacaccttgcaactacccaggccaacttggttgccctcattgatatatagttcgtgctactcagaagatgctgaaagtaaatatcagacttattacaataaagcgctcatacatgtatgtttggtcatcgatctcgatgtgtgaaaccttgtacatccctgatttttcaccgaacaaacgagtgctttccgctacatattttgcctatttttgtgatactatgtgtacatgaatgaatgttaccatggaaattgtgagttgtgacacgacggatcacccaaataccgataaatcacgccaatcgaactatatttgtattatttagtatgaaaatctctagcttgtgttgtttctgttagattgatctctggccaccgagtcagagaattgcgcaatcacaccaacgtgctcctaacgttttgagtaccgattccctcggtctcgagcgcatgttgctctctctcgcgcgatgatcggacacgctatctacgtaacggacccgcccccgatcccctcaacgcacacacatataaagggaatgatatcccgttggtgacgatcgacttacggcatacccaaaaccaaactgtcagactatcgatcttaaggtgcgttggaggggaacgaagggcgaattccattgccactaccgcacagtgatggagatcttaaggtgcattgaaagggaatgaagggcgaattccatcaccattgctgcacattgatctccatcactggcggtctactaccagtacaccgacacatctaatggcttgatcaagatccgatcaataaaccaccaaattccgcataagaaattaggtgatcatgcatagcctaagtgcatgattttaatatttaattcattggtttgacaatccttttgtccttattgccatagttacaattttgcatcaagaccatttgatcactagtccgatctactatatagtatagggtagtatggtctaccgtaaagcaacttaaaaaacaaatatggtgtcaacatcatcttgtccttcatgatctatcattgcatggttcgacaattcttatctccttattgccatagctacgatgttccatcaagacctttgatcgcttttggttttcctccacttatacaatgtattataatgcaatgccgaaccttgtttgacaccttaaatttcgttggacgaacgcattagggtgtaagtgaaaaagctctcctatctcggtgatcgatctttcatggaaaaaaaagggagactctcgattatgtgctatcatacatgtgaaatatttagtcgatcaagggaaagaaatcaagagcaagcccgggacacatgattagtagcaagcgatggcaccaatatcactgctgtaatccagcaagatagatagccacgtgattggatgcaatacagtcctgatgcctcgcatgtctatataaaattaaactctggaaacatttatcaccacaatatcaaggatataccgagtgtatcatcacatgatacaactttgagtaggaaatcagacatgactccgggttgatgtggctatatagcacgagggcccacttacagtcacaccctttcgttttttattgtttcagcaattggatacgcatttggcactgttcaagttaagctacgatatgacgaagtgaccaggtgagtgagaacgcataaatgcaactaggcgtgtgtgatgagaatgtgagacgcatatcaagcgtgcatgatgttattatctcctagttaatctcttggtaccaagtattgttactagatggtaccaagaatatgttagctcatcaactcacctttggagcggattagattctggtagtgacacttgcctgttttggcacagcttcagctccagcttcatcacctctagagtcggaacccaaccaaacagttttagctccatatctgaaatgggagcagagctgggtttaggaatctctataactctactccagactcaactcctaaagctaaatttaggagttaaagctctaccaaatagtcccgaaatcatacgtaaaaggcgtatgatggagtgatggatggaaatggaatcgatcgccagctagttcagtacaatcacacaagatccatcgcaattcccccgcaaaaaaaaaaaagatccatcgcaattcaggatcgtgccgcgccaccaaatttgttctccaagcccagtcgtccggcccactctttctgtatagtctatctggcccatactctatccagtccagttctatctggcccatattcgctttagacagccacacttgccttggatattcagagctcccctgtagcatcatgtgtctgctcggttctccaagtcaatccctcaaagttggctacttcacaattaatgacagtacagtgtgctgctctaatcacaaaataattctataaatatcaagaaccaatatgttcttgataccatgaaggtgcgcgagaatatctgacgaagaccagagctcaactttttggaggataaaatatgcctaatgcctcacatacctaatcaatatattatatacgtactctactaacatacaaaacatgaaatgaccgaccaacaaacacgtctcaatcgatcagatcctaggtaagcatgcatgtagttcttttgtgaggcagtcctaaatgtaagggctataacgtctgtgtgttatttctcttctgttatgtatggacctttttctatggggaagggtatcttttccacataacatcaagctaccaattaatgcagtaactacatatctatattaaagtaaataattactcctgtacccactggcaattagatgtcctggtgttctctcacgcatgatctagtattaccccttcgttattatagtgtagtaatcccttcgttattatagtgaaggtaatttctttgttacaaagggacagttgcttcataaagtcaaagccatatcaataattggctgtaccagtcacaacaggcagtaatgagatgtagcttaataattggttgtaccgtgcttgatagcaacgatgagcgcggtggtgcttgaacacaaggatgaagagtataatgcacggtttgcggtgctctataagcattttacattggtgttgtgtgggagatcaatcttatcttttgagataagaaagctcgcagtagaagtctcaatgataccatgaagtttccagcccttgctgaatttacacatacaacctctctctattggcttgcaccaaaaggccaatttgtgttgtaggcatgcaaacttggtgggccaaaagatcctgatacctcacaatcctagccgcctctggtataaaccaatgaaaaacattattctccttcaaagtgtttttatcatggaaaatcaaatttgctttactcgaggagtatgtaggtcacccacctagttatgtgcttggagagatagctgtctgttactctgtttcatggtttacctatatcagtcttgaaatgttgcaagtgaataggactgatcagcatccgccgtctgatcaatgatttgtggtgtagattatgcaggagtccttgcctcgtgaattaggggcctggaaatcctcacggcccaataggcttctacttatgcacctcttgtagtcatatggttggagtccggagaaaggagatggtatcattggcaatagatgcagaggcggaggaagaggttaactccagacgatttcacgaggctctgtggctgggatatgcctctgccgatggacacgaaggcaacgtcggatcccagttggtggatgccgtgttggtgccaccgatgcacctgcagataccgtcaaatcctagtatttttcttgcttccattgctacttttctgtggaggacactcggactttatattattgttgctaattgaaatgaacatatcaagttaagtggttcacttactctccccttggccgaatgcaaaagtcatgtggtctcttaggaggcccacctaaaaaaataaacttatttttgtaggcggatctattaaggggccacatgagaaaatgtatttttcttacgacccgtgaaacttccttcgaatataatttttgcaggcacgacctgttacaacctgcctataaccttcgtatagaaaaatcgtttctgtagtagtgtatactgcgtgcttcaggaaaagaaaaacccaccataattgaggcagatcctcggcggggaccctgccctaacgaagaagttggttatactcgatttttctatagatattgaggccacttaattttcgttaccaaagcttgagctgctatagaaacatgagttgacagtagaaaatcaattctactgtatgaacactgtcttaattttcatgcaacaaccaactataatttactcggctaaacttagtttagttagtggaaagcttgattgagcataaacgtattttactcatcaagccatacacaatcactggtggagaaaccatctttgatcggtcggcccaattccacaatagtctcggttccaataaaaaccgggactaaaaagcatctttagtcccggtttaaaagctgagggttaccaaccgggactaaagatcatttttacttccggttgaagaggttgtcaggtcgtgtcaggccctaattatttttagtcccggttggtataaacaaccgggactaaaaattaccccaagccgcgtgcaatgtttatctcttcgcgtgtccattgtctgaccctcctcctcagtcttatccttaacttttcttcccctccacttgttctcctcctcactcctcctcttcctcctccccttcctctctcccctgtcttcctggcggcagcaggcggtggccggcgcggagggccggcggcggataaggatgggttttgaaccggtgttaaggatgggttccccagcagtgataaaaactgccttagaaaaaaatattttaaagcttatctttcttcagctagtagtttttttttaacaggacttgtactaactgcctggtaaattgcttcaggataggttttctctcgtcgaaagatatatattcaaatactccctccatcccaaaataaatgcagttttccattgttcatattcaacatttgaccgttcattttatttaaaaattttatagaattagtatttttatttttattagatgataaaatatgaatagtattttatgtgtgactaatggtttttattttttttataaatttttttaaataagacagatagttaaacgttagacacagttatccacgactacacttatttttaggacggagatatatcgagctttgtcatggagttgtgcaaagcgaacatgcctctgttatgtcattgatgattgggaatcatgtccagcaacgccagctgatctgaccacttgtcagcctcatctcatccagtgctttgaaggcctttccagtactaaagcatttattacagtgcaggatactaccaagtagggctgtcaacgagccgagctcgtctacccaagctcgagccgagcctattgcaccttcgagcttttaggcaagctcggttcgagctcgttcgagctcgagctcggtgccgagctcaaccataagtagtataatatatattttaataataatatcttaataagtataattattttctagttaatcacactaataaaaagagtagaaaatgattaaaataaatatattgtgctaatacatgctaatttattgtgtaaatagatacaaatatatatatttatctattagtttattatattaataaggtgaacatgcaatataaactatacacagccaagctcggttaggctcggtagaagctcgagctcggctcggtaaagctcacgagcttttgctcagactcgagttcggctcatttggagctcgagccgagctcgaatcgagcctaggacgagccaagctcgagctgctcgcgagccacgagcttgcttttttgacagccttactaccaagaagaacctagtctgccatataggttgaggttccgataaagatcccaccctcacggtgcaggtcatgctcaacacgatgcttccccgccagtctttttcagttagattccacaccccttctctcacttcactagctgctttttcagctttttggaggaagcaccccatgtccatgcatagcaccgagcgtccatgcaaagcaccgagggtccacactttttctcctccacgacatcacgcggtgacgaagccacgcgccagcatggagcaaggcctaatccttctcgtttggcaagatggcttgccgcgagaatccaacaaaatgctggcccttattgaatttaatctttaacgtcttcttttgttggcgatgcacccaaatatttatgtgagagacccattgtgtttttcggtgcattgatacctcctgatatctcacaagcctatatgttatacgcgcagtaacaaatgaaacatcaaacatttatttacaagattgtgagcatggtacaatggtagaaactagattattatctctcatgcagttgtgggtaggtgcaagcagaacttgtagtgcacaatatatggccggagcctagagagatctcttctctgcggtttacttatatgcaacttgtttttcatttagttgatgtatattgtcctggcttatatgtacgatgcacttaatcaaatggtgcaagtctatttaatgttttagattttcttctgacaatgtaaattggttgtaccacccacaacaagcagtaatgagatgttgcttaatatccgaagaagtggcagaggtgcttgacagcaatgatgagcacggcgttgcttgaccacaaggacgatgggaaacaaatcccctgattttgtgcagcctgcagttgtaccactgatatgtgggcccaggcacaactgcaaagtgcacaaggcctgaggagtctaacccaggatgatgaatagtaggatgcatgctttgcagtgctctagagtctagtggtgtaggtgtggtgtgggtgatcaatcttatatctcttttgagataagagggttcatagtacaagtggaatgcccttgccgaatttacacatgaacatcctctctcgagcatattgcaccgaaatccctatttctgatgtaggcatgtaaacttggtggacggaacgatcctgatgcctcacaatcctacccgcctccggtataaacaaatgaaaaacattatcccccttcaaagtgttttatcaaggaaaagcaaatttgctttactcgaggagtatgtaggttgcccacccagctgtgcatgctcttgtgaaccatcggagcgagcttagaagacctgtgtttgtaggtgccaccgttgcacatgcagataccctcaaatcctagtaattttcttgcttctgttgatgcttttccgattgcacatgcacccgatttgtgtggttttcgtgtgaaacgtttgcatatgctgattcgcttggtacgcttggtaatgccaatacgccgtgaagttgctactgctgaatttatacacatgaacagaatctcttgagcagcttgcacccaaatgcccatttctaacgttggcgtgtaaatatggtgggtggaacgctcccgatgcctcacaatcctacttgtttatgggatcaacaaattagaaaaaaacaccaccccttcaaaatatttttctcaatggaatgtgaatttgctttactcgaggagctagtacgatagaacacccaccaaattgtgcatgctcttttatccagtcttgaaatgctgcaagtgattgggagagatcaccgtacgccaatccgatcaacgatgtgcggcgcagattgcgcaggagttgtccttgccttattgcaaattagtagccgtcacctcctagtaaatctgggccgcagcttctggacctaaaagtcctcatggcccaatgggcgtctgctcatacacacaggcctgcatgtctcctcctcggtaacaaatgaaaacacactgttaattcatactaaatgggattttgcttggaaacctagctgaaacatttatttaactgatggtaagtatggtactatggtagaatctcgcatacaaatttgtaacttgtcagctctcccaaattctgagaaagcaggctggtcggactatactagaaagccatgcatctgtactagaaaggtagaggagtgctcactgatctctgtagatgatggacactctgagtcgctggactgaacatcgagcggatctaatttggaaggaaatcttcttgaatcgaacattccatggatattaatttctgtatggttcgaactactgtaggaggaacacaactcgatcaaatttcgtatgattggcttcgtctgctaattctggttcaacaagcatgcagtcctgctgttatgacacaacaaggtcttgctgttcgtgttgcacgaactatctacactctcctgatgtttgcgcttccataggatggtgctataatggtggcaaggtttagacgtgataaaaaaacatggaggtatatatgtttgggatattggagcctttcatggcaatgtaactagctaccatatccttctcctaagcacattaagaaaaatgactccctaaataataaaattctatattttttaaaaaaatattataattccatatcgttttttttccatcagatgtcaaaaaactatagaaagtagaatattttcacctggtacacctaagcattctagatcaattgttgtacaacgtcaatctgctcgcacattctttccggaaagtcggcgtgcttaaacactgctttcacatgatgcttcaaccatatatctgatcatgaaaaatgttgaggaagcctttgtaccaattactcctgatacctcacagtccaatacgcattagacatgtataaacgatatactaacaaacatatctatgcaggaacaagggacaactgctctgtttatggtaaagtgagatagatcactacctcacgtgagtttgagccttgagcctattcacctttgcggctcttatataagcatagacacacattgtatattgatggtaattaccttcgctatttttccttttaattaacaaacttggtaatacatcaaaagtgcatccgattgaatgatgtggtgtgggcaggtactacattttccatcattatttggtatatatgaatactagagatttcgtactaggacagcatcacaatttaagcatgtgtggtattgtagtactatcaaccacatgtgcatcttaaaaacctaaaggaaggactacatgtgcatcagtgtgtgggcaggattacaaaaggttttgagagttggtatctcagttaatgtgcactaccgtagaagtgatttttgccgggtggggcaaaaaccacaattgtcccggttcagcaattaaccgggactaaaaccatttttagtcccggttttttaggtgcaacggaaagatatgatgtttagtcccggttggtaacaccaaccgggactaaagatcatatttaagtcccggttgtgaatgtgtcagaagttgttactaatcgggacaaaagattaatattaatccatcagttctcattttttcacttgcagttgcatgatccgtaaatggcttattgacattggaactatcaaacatgacggaaatagctaatggcagataagaacgtctatgaatccagacatccagtagaacaaacttgtggcatgcatttggtttctatcagtgtatcatgcttctctagaaagctataggagcacggtgatctgtagttgatcgacatttcgggccactggtctgaacatcgagctataggctctgatttgctaggaaattaagactaataatatctgaattcaatattccctggatattaatctctagctgaatattgtttgaaccattttgaaggagcacaactcagtcaaatttcatacgaatgacttcgtataccagttccagttcaacaaacatgcacttatgcaacagagtcttgctgttcatgttccacgttctccctacgctcttccgctgttcctcgctgtgacaagaaagaggatggccattcgattggagggctgatcagaggaccatccatcaccggatgcaagcaacgcgaagttcactgtcactgcgatgcaaagcagaagacgaggccacaatcgctaggctgtagaggaaatctattcagtttgcataataggtgagtatacttccacactcagcccatcctcaaaacatggtgaacctcgcaagcttcagctgtgtgctgatcgcatgctgcacatctcgggtgcagtatctcttattgatgtatcctgataatgtctcctgatgctccatatgcctatgctcatgcagctgatatttgagagattgaatggcatatgcactgtttaggtttttatgggagtttttggtttgtgcaagtggagggggtcacttgataaaactttgtgacctatgagactgaggttctctcttacatatatgggcagttcttcttgattgaacgaatgtatagttggtacaaacgagctagattatttgcttcatattaacagggccggtcctgatatttccaaggcccagagcaaaataaaaatagagaccctcaatgggtataatatgtagattttttttttcttaatgattgtagatctaaccaacctaaaatacgatgatactacactagactacgtcagcttatacttattaaattattgtaactattgtggagaaaacattgcaaacacaatccaattgcctattaataattccatgactttgagaaaattgtgacagcatcaagtaattcatgctagcatttttataagaaaattcagtgataattgtaattgtacgtatcaacatgaatcaggatcaatctgtatttagtggtggttatatatattaaataccattaataataatctcaataaagaagagagagagagaggagaaaatgagtgggacggtgaataaataatctagtcttgggattaatcaagacgtggagcttggagatcaatctacgattctctgcttctattggtaatcaatacgtaaatgtagcctatgtaggtgcatggccggtcggggcccttgtcacggtgggcccagggccaccgcaccgctcgccctgccccagggccggcgctgcatattaaaatacagagcagcaagagaatggacttgtggcttcgcattattgttgataacacattaccgttattatttacatcctgattaaatggactgttcttggcaagggttgatatttaataaatttatggagaaagttaattctgtaccattaagaagaagcacacactcaaaataaacaccatcaattatatacttaaaatttttattaaacttcttcaaaacgctcttaagccgtcagttgatgctctaataaattaaataaaaacctagaaaatctgagaaaaaaacatatatccctcgattttcacttaaatcgacagttccaatactataaatagttagattagatttcttaaaacaaaccgaccaaattcttatatagtctttccttcccttcagtaggaaaacgtacaaatattgaaacattgaccttccttttcttatttttccacgtatatagttgagacaataataattattattattagcgataatattttttataaaatagttactttacaaacatttaatatattatcatatcactctttacaaactaatgcaaataaattggctctacaataatatttaaaaacaaagttgacacccattattttatattgtgtacacattatttcagactaattttaataaaaatatttgtccatcgatttttacttaaatcagtattaaaccatcataactatctttaaataaacaaagcctcgaaatcacaaagattttgagaaaaaacacacattccctcgatttttcagttgaattgatatatgaccattgtattagacttgaaaaatcttgctaatcaaccctcctgatcattccggctaatcactcctcctatctcgaatacgtatgtacttacttgttacaagtaaaaagaatacatacaaccgccaaaccctctcattggatatatatgattaaaaaggactaatcccaccttacctcattgggttccatttatcatatagcatggcattatgagttgctccgcatattgcatataaaccatgctaaggtagttggttgaaaagctatatttgttaccattaaatttaaattgtaggactgcatgttgatatgtgttttcttttcaaaaaatattatatagatcacacatataacaggaaagcgagatctatgatatgtctttgttaatttgtatgtgagtatgtgataaattacatcattgagactttccctgcatatataaatctggactcttagttgtaccaagtgctctctctacttgttaaattgtatctaagtatgtgataaattgcatcattgaggctttcccttacatatataaatttggagtcttggttgtactaaggccctgtttgtttcagcttaagattatagtaatctagattattaaatcagattactctaagctggattataataagctgacatagaataagttgcagttgtttgtttctttggattattggaagcatctaagggtagcgagtctttagccacttaataatttggaaaaagctcctccagaggagattattagattatactaatttggcttatagataataataatctagcataataatctacttgtttgtttgaggttactcctaataatctagattataataatcctaagctgaatcaagcagggcctaagtgctctctctactaattaatgtgtatctaagtatgtaataaattgcatcattgagactttcccgaatttagcccacaaacaacctaatctgaaattcactcatatggagatttgaactcaggaccttggagtgctactcaggtcactataaccactagactatatgctctttcgcgatctactgaacctacaacgtgcaaactataagcagctaatgtaattatgttaattatgacaataatcagtatgagacacccatagggctgagaggcatctggagaatgtgacaaccatttgcataggttcctagaacgagtgagctaagttgaagtcctagttatcattctgatcctcttaggtggtgcatgtgcatatcaaagaaagtataggctgtgttcgctggagccggttctcaaccggaatagtgcacacggaaaacggaacggtccattagcgcatgattaattaagtattagctaatttttttaaaatgtatcaatattaattttttaagcaactttcatacagaaacttttttaaaaaaaacgcaccgtttagcaatttgaaaagcgtgtgcgtgaaaaacgagggagataagttgtaaaacttggagtaagaacacagccgtagtcgctgtaggctcatctaatgtgggtatcgaggcaagcgctgaagagacttgttagtacttgtttctgctacttgaaactcgatcatatctgctaaattaaaattcgaatttaaatgggaacaatgcatatatatcaatttttctccctgtgttaattgatcgctacgattgtatatgtatagttttatccctagaaatgcaaataatagatttgtaaatacattatttgtacatcaaaatgttgttgagttcacatagctcaacctttttcccacttgcctgagacctcaatgtcaagatgctcctatcatatcaatggaatacctattatagcaactccgtttttagagtccgtcctcatgacaagtttaacctcacaaagtttagcaatgtattactcgtacatcccttcaagaatgcaatacctccgaccaatgtgtcgtgacagtggctcctgatgcttcacatgcctatgttcatgccctcgacatttgagagatcgaatggcatattacattgttttggttttcatgtgagttttcgcaattgttttgtgtacgtggtgaggatcacatgataggcctttcctatcaggcagtggcgctcttataggcaacttggttggtaggagcaagtcagcttaattggttctcaacaagatgcagggtacagatacatcaatctacatagcagcaagtgaatggacttgcggcttcacattattattgaaaacatgaatgattaattgaatactgtgcaggctaagagttgatattggtttaatttatcgaaaagtaattcagcatcgtcatgaagagacacatacattaaaacaaggagttacatcaatcaaaatgacggcggcatcttagcattgtggttacaagcaagtaagaaaatgatccattgaactctctgaagtcatggcttcatgggtatattctaactggataactgtatagagtatagacacagaaaaaatgatcatgaattacgtattacagacctaaaaattcatagaaaaagttatctaagtaacactgatatatatagaaagattttagaaaaatcgtactagtgatgtgtagagtttttagcaaaaaatttacttttggataatcaaacctccatcatgtgttgttgttaagctatattaattgctgaatttagagatgtggatacaatgaatgggaaacgacagtcatgtgggggcgattcttaggttggattcttttcccttctttccgaactcaccttcctctttttccttgtgaacgcttctcaaactactaaacggtgtgttttttaaaagttttctatatgaaaattgctttaaaaaaatcttaggctaatacttaattaatcacatggtaatgcgcaacaccattttctgtgcgggaaggtggagttacctcccgaactcagcctcaatgttgctatggttgagttctttcccttaacagagccaactctatttttctaacaaaaaaattagccgaatttcgcacgcagttaagcaaggctatttttggcccaatcctgccggtctgaccgcgaccgtcaaagcaacacaatcttgttcatcatctgaaaatcaatcatctccacaaccacttcaccaataatctccaaatatcaaaaccaataacatcaaatgccaattcttcatcacaaataacaatcaatcacactttgattttacatggttttgccatgccaaccttttactttgtttgtcctacctatcctttccacctcacttgccatcttctccttgtcatccataacaatgaggcgacacttggccactacccgttggattgaagcttgattgaagcaagtagttgtcgtcaagtttgctgaagcaggtcaaggacagcgaaatggttcaacatcaattaccagtcattttgaaggtggacaagtagcctcgcaattcagacgtagtttaggtctcggattgctagtttcaggttaccctctcttgctttctacacccacagatctagcacgagcatcaacactttgggtatcgatgtctagcactccagatgcttcgcatgcctatgttttcttccaacatggatgattggaatcatccgcacacccttcccactggtattgtttttgcataggtagatatgaatggattactggagttttgtgcacttcattaccacaggtcttatttatgtcagaatagagactgttgtaacaccccaggaaaccacgtacctagagtgccagaccaaaaacactcgaaaccactaactctcaaaattactagaaatttcggcagagtctcccctgtaaatacggacatccacgacaggcaattataagttaaactaataacaatatcattcccacaatacgatccatccttataatacatggggaagaaactattagaaatctaaaagattattacaagaccgaaccataatatagtttaagtatcattatggacctaggcaatatagtttgatagtgtgcagataaatgtgtatataagggtgctacttcccgcccatgcatgttggtctcaatatgtacctaaaaccaaataaaacacaagagtgagtataaaaatactcagcaattacaatatggaactagaaaacacatatagacatcattggcaataaagcatgaacagaaggctttctttctttgataggaaacacattttcaaacaccaagtcaaagaagatagtagtttccatccggggcaggcatgaattgaaatagtagtttctatcccggacaatagtgaatatatcctagcatttgccggcaaagccgagtaaacgtgatcagcaattacccacaggaacttgaataaagaaccaaatttcactcccatgactatgcatggtacttgaataattgaaaccagaatcaaagaaccaaattgaaaccatattgcacattcatggcaagcagggaacttgaattatttacccagaaccagaatccggaatattgaaacaagaataacgtcgtaaacataggataaacatgaaaacctaaatggcgtgaacaacgatatgaatataagcagtcacatgtcacatagaaatatatcggaaataaatagatagagccaactatccatcaatcacacacttagttcgtcatgcacttgcctccaatgaagggttggtatcatgcacgatctgaaggaccaccacctaatcacaaacaaaacctcagcaaacacattcaaacatgcatataaaacaatgaaaaaaggtgaacctactgccccatcccatcaaaacgcgataacaaggaacgccgcttgcactataaacaatattgttgcttcaaacctttatatcttgaaatatgaaaaggctatgaccataaataaatctacagaacaaggcctacaactcttatgtggaaattatatttttattatgccattaaaatggtctaatttgcgcttgaaagcaggcttcagaatctgtccagaatttcagactatccgcactaaaacaatcataactggagttttacttgcccaatcagggtgtactttactaatatgaaaagctaagaaaaacctctacaactttgtctataggcgtcttggctgattccactgtttagcccatccaaaaatagttcaatctactactatccagattatgacataaaacaacagttatactcaaaaattcgtatcatctaaaccacttgagataaaatcacgcccttggtcagaagatagatataaatattatctacaactttctagttatacactttcgcaaaaaatatcatttagatctccgaaacttcgaaaaaccgaaaaactgtaaatctgccaacgtgtagaacagccaaattcgaaccacaacaaacaaaactccttctctaaccttccttatccacgaattaaaccactaaaaccaccctagaacaactgatatgacaaggggaaagcctcacctagggtttctttagagaacttgtgaggagacaataggggagactgtgatccaagcttattgatccaagctatgaaagtggagatctagggagagcaatttgctgtagaggggagaaatgcgaacataggagaaggggaggaaggaggcgccgccagggagaggggtggtggcactatgatgggaggtgggagttggttcccctctttctaggttttaggggagaactaatgggctgggtttataggccttctcatgttggcccacttctaaagatatatttttttatttatttctgttaacatctttattttaacaagtcaacccaaactaaaaaaataaatatcttttaatatacggggtattacaactgtattaaatccgcaaccaatgctggtaaataggaataggacacattgtttttagatttggcaatggctctccgtgatatatttctttgaaacaaaataatttctgagaatgcgactagtgtgtatttgacggctgtgacgacgcgtgcatggttcatatatacagttgtcttataggcagcattcttcactagctgactataaataatccttagaggatatcaaaattaatggcgtgtgtgcaccaagaccaaaagtttgttgcaattttgttgacatttttctactcaatgatattggttattccactgtagacagctagcccaattaagaatgcctgcctcttgagggccgggagtaagtaacttacatatgaatagaaaattttggaaccctcattgcactcttaaaaagcactaaaagaagaactacaatgccaaatagtactgtttggaatagtttcaaaacgttgtgcgagacggttactcagttattgtgttagtggtgaatgggacgttaattcatcggttctcatgcttgcactagcacgatccactggactgagcatccaacggctcagatttgcatcgaaggtctacatgaattcaaacattccttggatatatattagtctctcgaatatggtccaaacaacaacaggagaaacacaattccatcaaatttcgcatgaatggatttgtctgaagattctagtcagacaagcatggagtcacagtgctctcaaatacagcacgatctttctgtttatgttgcatgttctctctatagtctcccgttgttaagtaattaacggaagcgagaaaagtaattaagggaagccatagtcaactacaggtctgagggcagatgtacagtatatctaccggtgtcaggtgacaccgatggtatcttacaaatacaatatgatcctctgtgtttttagccaatgacaccatcgattaaagctcactgaccccagcagactaactaatttactctagcccacgcactaacagctagtaaacaatatactccgtattttgttttagggaaagccagaacaattttgctgttgttagtattacacgtgcaacagttgcttaattcacttctcgtatagtatagttctgtttataaatggtggaattaacctagcccgttgatttacttagttttgacatgttaaacaattaataaactagctagatgaaatgttacattactttgtttttatttagtttatactttaacaatgtagaataattaggagtagaacaaataagagctttatggagaaacacccaagggtcttcctagcttcacaaggtggtgggctatacgaccggggttcgaagcctcaccccttctaatttctaattatttgatattaagtcattctctaatggttgtgtctttttaataagagctttatgtatatattaaagtttgcaaaaaaaatgtttctttatactcgagaagataccataagttacactctctttttttccattaatcaattacatcattggtatatcttaatttttgtgagaagaaaccacaaataattagctagaaagtatggtgtcgtctagtcttataaatgctagtaccgtaaagtatgtattacattatgaccccggtggctccaaatccttgatccgccccgtctgaccagaggaaccactgccagtgacggagccaggatttcaaagttaggtattcccatctaagcgctgagccgctggccgcccctgcccctcgcggctaccggccacccaaccggcttgaccgcctgagcttggcggagtgtcgggtgccggccgtcgtggcaatggcctccccctccgcggtagcacgggccagctcccgccgccggttgccgccttgcctcgtcgcgccgccgcctagggtttgcaaatagggagcggcgcgagggagccgagctatggagggatgggtcacgaagggagagcgagagggcgccgtctggtagagtggtggctaagtgggtcaactgatgtctgatgggtcacgacaaagtgggtcgggttggtaggaggcattgcaagaggtcggttgggtcatgtttggatcgaagagttgaggatttaggtgcactaatatgtgtacatgtatatatattagaagtatgcttattttttcataaaaaaagttgggtattcccgggaatacccaggaaccaaggtagctccgcccctgaccactgccgcctgccgctgtgatgcgaagcaaccaagatgccagcatcgctaggctgtcagtagttgttcctcagttcggataacaggcgaccggaaatatttttagagtccatcctcatgaccaggttcacatcacaagtttcaacgatgtattactcgtccaaccttccaagagtgtaatacctctaaccaatgtgtcatgagaatggctcctgatgcttcacatgcttatgttcatgccctcgatatttgggaggtcgaatggcatattacattgttttggttttcatgggagtttttgcaattgctttgtgcaagcggtgaggatcaaatgatagaaccattgctatgaggcagtggtgctcttatatataggcaacttggttggtaggagctagtcagcttaattggttctcatcaagatgcaggtacttgggtacattgatccacgcagcaacaagtgaatacaccagtggcttcaccactcgggtatattgattgatgatattaaaaacaattaataccatcaatcaatatcacggcggcatcttagcattgtgatcacaagcatgtaagaaaatgatccgttagaactctatgaagtcatgagcatattctaactggataaatgtacagagagtatagacacagaaaattgcacatgaattaagtatatatatagacctaaaaattcttagaaatggttatctaagtagcactaatatagaaagtttttagaaaaaatcatattagtgatgtataaagtttgtagaaaaaacatacttttggataattgataacaccattagcgatttaaaacacaagtgttgttgttaagttatattaattattaaatttagagatgtggatacattgaatggggacagtcatgtgggcattggcgattctgtggttcagtccttttccataatagagccattggtgaaagtatgagagtgattaacagtagaatataacaaattttaataagaagtgattgatgggataattaatactctgtagagataattattttgggacaatttctaagtatctagaaatacaattattttagaaaagaaaaagtatctagataaattattttagacctggataaattattacttttttttctcacacgctatcctgctgcattttataccatcgatatatgatagcactatattgatgttgcggtcccaggcaagtgggaaaatgattgagctacgtgaactcaacaacaatttgatgtacaaataatgtatttacaaatctctttttttcatttataggcataaaactatatcatatacaatcatagcgattacaacattatataatccagatccatcacacagggaggaaaattgaaatgcattgttcctatttaaattcgaattttaatttagcagatatgatcatgtttcaagtagcagaaaggcagaaacatgtactaacaagtctcttcagtaggggtgtaagtgggcttgtccgtaaacccgtttatagacaaaattagtatctaacctgcggattggaccagcgggttacctattaatttgacttatttatgaattatcattaatttaacctaaaagtcaactcgcgggttggcccgcttgcatccatagtcttccatagtcttcagtacttgactcgatacccgcgttggatgagcctgcatcgacttcctccttcgccatgcaccgcagaggatcacacgatgcccatgtatgttctggaatgataactagggcttttactttgctaactcgtactaagaacctatgcaaatggttgtcacattctcctgattctctcagccctatgcgtgtctcatactgaatgatgccataattaacataagctgcttatgatttgcacgttgtaggttcagtagagagagcactacaaatgtttggatctcaaaaatttttggccaaacgttgcgtgtcttatactgaatgatgtcactcacgctgtaggtccaagactccaaatttatgggtgtgtttagatatctcaaatttttttttgcctaaaatatcacatcaaatgtttggacacatccatggaacattaaatgtgaaaaaaaaccaattgcacagtttgtatgtaaattgcgagaaaaatcttttgagcttaattgcgccatgatttgaaaatgtcatgctacaataaacatttgctaatgacagattaaataggcttaataaattcatctcgcagtttacagtctaaatatataatttgttttattaaattcatccatggagcgccgccgccgctgccgccttcgtcggaccgcgggagaccgccgtgtccccttccggccgatttggcggaggggagggcacggcagctgccgccttcgccgggccgtcgccaacctcgggagcccgccgccaccgccgggcagccgcgggagaccttcacctcccctcccgccggatctggcggaggggagggcgcagcaaccgccaccttcgccaggcatccgcccgcctcgatcgggagcttgccgccagcgatggaggtagcctcgtcactagagagaggggagggagagagacatgagagggagagagacgcgggagggagtgcacaaggacgacgcgacgtgggtcagtgggtgggagtagataaggacaacatacggcgctcggctcatcggctcggctcgttttgtataggtgtaggtgtctgttttttaataaaccggcatctatagtattggtaccggtttttattaatgagccgacacctatagtgccttaaagatgttggttcttatttttttccgcgtgcggaggcggaaaaggcctgtaggtgtcggttttaaaggaaccggcacgtatacggcccatccctttgagggttc

SEQ ID NO: 4224 - DNA, 14878 bp, Oryza sativa
tttcgagcttctgattagtcctaaactcaagaataagtgctttgaattcatttcctgatggatcaaaggttcagcataggctgattactcttataaaattccggtggtgaatgttttatttcattgcttcacattcagcaaaaaagtttgttggtgctccttttttttactcagtccctagcaaaaaaataagaacaaaaatttcaacaaagaagacaggctctcaatatgctgcatttggatgcaactaagacagagccactgcatcgcccattccaatccaaaactacttgtgactgtgagtaatgaagactctgccccctaggtagggatgtaagagggccaacccatgaatctacttatatactacctccatattttaatttatgacgccgttgatttttgtccaacgtttgaccattcgtcttaataaaaatttttatgtaattatcatttattttattgtgacttgattcattatcaaatgttctttaagcatgacataaatatttttatatttgcacaaaatttttgaatgaaacgaatggttaaacgttggtcaaaaagtcaacagcgtcatacattaaaatatggagggagtatcaaataaatggtaacccactggtttttatgtcatgactcaacttgccgcgccttaagatgcaagtgggttgatctataaacccatttacagatcccatttaggaacccgtggattaccaactaatcttgtctataaatgggttcgtgggttgacccgcttacacccctaccccctaaggagcctggcccttgcctctcgtatccgacggggacactaccgcggatcaactgcttcctctgatggatgcgcagggcagctatgcagcacgcagcagatgtcatgcgaaaatgagcaatagtcaccgacgcactaacattatgtgtacctttgcgtcgcaggtaactgcagcttcacaccacactctttggcctttgctagttgcctttgtgagtatgtgactactcgagcttaaacatcagggtagcagatcattgaagagatctagcaagatgcctatccatttccagcattcctgatgcttcacatgcatatgtttttctttttttccaacatggacaaatgggatcacgacatgcattattttctttctggtcacatacaagtttgatagggagggatatatatatcttgtaggcaattttctcaactaaatgactgaaaataatgagcttggtagtttttacagatgcatggaactgattctatgcatttattgctccagattgttccaacaaccacttaataaaattttgacaggagaatacataagtgattaattagtcgttaactttatccttgtttttggacaaaggggcatgatcactagctagcataaccacgtgctaatctttgtgaaatggccaattttgcttactgacacagccacatgtacaaaggccttcagctttcctttacagatttggttgataaaagagtagtacaatgactaattatgtttcaatttcaaaggtctcctgattcgaccacccttgccctctactatactacaatagagttcactggctgattaatgagcagcctcaacatccaaaaatgcatcttaagctggagtcgtcggtcgctgcaagatttctgatgctggcaagatgaatgaggatcaaaggtgaggatagtaaaactactcaacagatagtatccgaccaagttgatgatggaagagcacgcttacaattctatggttagagtcaagtctcacatctctagtttcagcttcatccctttcgtttgctacaccgaacgatcttgcgaaaacggcaccagtgtgtccatccatgtacaatactcccaatgcttcatatgcctatgttttatgtcagcttggaaagatggaatggtttgcacctttcttttctctggtcttgtttttttggataggtagatatatgtccgatccttttcggagtggaaatagccagaaagggattcaactaaaatccaaactaaatccaaggtgatccttgaattataaatacagcttggttacccttgaagatgaagggcacgattatgtccgatatccagtcaacgacattatgaattgcttcatgctacctctcaggacattgtaattgttcaaacatgagttaattaatgatttattaatttacagaaaataaactcagtcacaacgtgaaaccttgagaactgaaaaaaaaaacacaaatttaatagcatgtgtgtaacaggacactcgaagtcagttggaaattaaatgacttttctctactcaatgatattggcaatcctactgaagacatgttgatcaattcagatggctgagagaccaccaataatattgctgtcgatgtagctggttaactgatttcgtcggtcttgttcacaaaagggcatgatcagttgcaaaggcacacgctccatcgttgtcatacggtccattttgctgacaacaatagtagacatgattttcactgattcgatcgaacagaaagtagtacaattaattattgccattaagaagaacttctctcacttttctaagtctgatatgggcgtcctctagaacagactacccgagaacagagcaggagccgacgtgagaattgccgtaatccagaaagaccaatagaaaaaaaaaattcagcaaaacaaaccacacaaactttccagtcatattgccaatttattcattttttttaactgaacatgttgccaattattcaccaagcattttctttttcaccgatccttaagaggcatcgcgagatggtcaattatagctattcgtattttcgtagtgttaaattacacacaaaagtagaacatggttggttctcccatggtccaatggacgagctataggataagctgcacagatcgagctgctgaactcatatggacaaataaacgcactgaactccggattttttcaggggaaaaaggaatcatatatattaggctgcaggcagacggtcctctttgctgagctgggacagctcgtgcgcagcaacacgccatcatgccgatctcccctgcaccccgaaaagtatcggagtactgtcagtcgaccacatcgtttctccatacagcaagttgtttcatcgaagtttgttcctcagcattgatattcaagtcgttaaaacgcatatataaaaattatacctataaattattattattattttgcttatacgttgaataacgtattatccgtatttggtcaaatgatgggggcaagtgtgccggcaaacaaccgcagctgcatgggcttgtcgatgccgacgacaagcattattccgaagacaaaaaaaatcttgatgatcttccccacatagcaccaccgcatgtccttcttccgacgactgcttcggtcctcctcccgcgtgtgttgtgttgttctggattctggagtgcgcgagtatgtgaggatgtgagtgcttgagctcaaacatctgggcaacaaaattggttctctagtgggaaattcagattggtacagttaatatttggaggaaattgggtttatatatcaaagattacagattggtatagttaattctgatgcattgtgttgacaacataggcgtgcttcgtcatgatttaactaatattgcagtttggctcacaccaatttaattacaaattcatcatgatttatttcaaatcaaagagagataatctttactactataaactgaaagatgagtaccaaaactatcttacaagcttcagcaggcgaacttcagtagtatccatccatttcctcagtgattgatcagtgcatgatatttttctttgatggaaatgatctgataataaacatcattaattgtcggtcgatcttttggtgatgtctctgtgcacattaacccaagcttagccagctgtatggcacatgttagaatttcaggcacaacatgatttgagtcttcgccatcgtgatgttcggtgatagtaggttctaaaatatcattgatcttatgtggaaatgctgattccactaagctacgaaggttcatgccatccttaaacatctcatcggttgggcactttcctgtgatcatctctagaacaataattccataactgtatacatcaccctcagttgagaccttgcaccccaagccatactctgcaataaagattgagcaagttagtaaagcatttgttggtcgaaaaatggtactcgattccatggaatggtatacttgccatcacctccgtgatagataatgtggaggtagtagaaacgaacaaataagaatgaagtaagtccgtacctggagcaatatatccaattgatcctctcagtccagcagtgcttgatgaattgtttaggcttataatgttgttatgaagaaactttgtaagtccaaagtcactaagacatgcaaccatttcatcatctaaaaggacattgcttggtttcagatcgcaatgaaccataggaggagagcatcgattgtgaagatagtctaaagccacggcaatgtctacggcgattcttattcttaaacccaaactcaaatgttttgtaggatttcgaccgagcacttttggatggatccagctttcaaggtttccattaatcctatattccaaaataagtgctttgtattcatttcctgatggatcaaatgtcgagcataggttgatcactcttataagattccggtggcgaatgtttttcaaggcctcacattccgcaaaaaagtttttcggtgctccattttggtcaagtctaaatactttgattgcaacattgcaagctccaaacttcaattgaccttttatgagaatttttacagtccaacaattggtacctccaggtactggtactgctaggtaccaaactaaatccaaccattaaatcagcaggggcatgatgggaaaaaaagaaaggaagcttcgactctgatgcgttagtgttcgtgaacttcttgtcaccaccgtcctagaatcttcgccactgcattagtgctcttccacggcaccggctccggtggcacctcctggccgccagcgccgccgcagcattgggcgttcttccaccctattccttgatccgtcgtcgccgtcgattaactgctaattactctgagcggtgccgaccaacatggagggatgaagccgtaaatctatgtatcgtcagataaactttatttgacttgatttgctaaccagtttaaatctagccttcaaatgtaattaatccctacgccaaagactgaaagtgatctgaatacaatgaatccattgtggagctgtgccgtgcaagttggagattagtgctctgaatccatgtacagagcgcttcatccatctatgagaggacaccatgattgaaaaaggacgagaggggaaaatcaagggagatggtaccgccatggacggccagggaaaaataaagaggaaaaaataatcaaggaagatggttccgaatcaagcagatggatctgtatcgctggcaagagagaagcgctgtgcggcgaggatgctggcagctgctcctcgagctcctgcatgccgtcgagtcgaggaggggtggggatggtgacgctgtgtcgtcgcgaggctggaaccagcgtcctcgggggcggcacgactggatctggaacctcccaggcttggggcagccggatctagtccccagttcctgctctgattccttctcgccttcggtggtgagtggttatgcccttgcctccggcaaaaaataccagagagatcccgactatgctaaacacgaaattccacttttaccctttggactagtagtaccaggcggggtgagcggtggtaccgcgaggtactcgtctctcgacagtcgtccgatcgtgttagatcgacggtctaaatttggtaccgccttagtcttgttggacggtaaaaaatctcttatacaccactccaaatgttcccgaaccaacaagattccttgaagagaaaccatttgttgcgttgtacaaatcgttgtatgagagtttattaaaatgcctgatcgaatcattgatgatgattttcttccgcccagttctgttcttctgaaggatgatggcaacacaagccaatgtgactataacgatggaagtgattggaattcctacactaagattataggatgtcttgttccttttagatgaaagttccttgcaaagtggtaattgtagcattggagaaattgcacacaactttttgtttccttggacgaacacattgcttgaattagcaaacacgcctcctctagggacaggtccctcaagattattgaaagatagattgagagtgtgtaaagatccaaaatactcaaaaaagtctgggatttcaccagacaagttgtttcgggaaagatccatctcattgatcccttttaagttggcaaaagatcctgggatgctcccttgtaggaaatttccctccaagtggactgattctaattcaaggcactcaccaagactagttggaatctcaccagataattgattattggagatattaagtgaattaagattagttaatccaccaatctctagtggtatgtgtccagtgatttgattctaggacatgtctaagccttccgaaagtgtagaaatggaaaagagttctggtggaattctcccatacaatttatttcttgatatatttagtttagttaaagttgtgcatcttgccaaactagaaggtatttgccccgtcaaatcattttcttgaagataaagtttagtaagttgccttagttttccaattgattgagggattactccggaaaacttgttgtaagataagcttaggatcgacaagttttggagatttacaattgtatcaggaatttggccagaaagcaagttattatccattagaaagatcgtgagactagttagtttttctatctccgaaggtatgctaccagtcaattggttttgatttagaatcaatacctttaggccttctgaaaggttggtgatggaacttggtattattccttgcagcttgttcctatccaaccacaaatttgttagttgagtgcagtttgtcagcgaagacatgaaagaccaatctccagcctcaagcttattgccacctaaatctaggtaagtcaagtcagacaaggatcctagagaagggataacaccggtgaaagagtttctgcgaaaatatattacttggagattcaaagcattggctaacgaagaaggaattggtccttcaaaccttcaaatattatacttgtgagtcctggaagggtgtagccaatgttcgtcggaagtatcccaacaagacgattggcgccaaagtttagataggtaagactcgagattgtgtaaagtcctggtggaacgatgcccgataagttgttatgacttagatctagtatttgcaacttagaaagattacttaggctctttggaatggtcccatctaatttgtttccggaaagcatcagtgtagacagtgaaggaatgttaccaagtgtgataggaattttaccggagaggaggttttcagttaaactaaggtatcggagtgacgaaagagcttgggagaatggaggaatggatccagaaagaccatttgatgacagatctatgtaagacgtggtagtgctattgaacaaagaaggtggtatctccccacttaggctattattttggagattcacccatataagtggtttgttactccctaaaagttgtgggatggtgccagtgagctgattgtgtggaatgaacagtgcagaaaggttggaaagcaaaccgatatctggggggatgtttccacgaatattgttggtgccaagaataatttgctgaagaaatgaacattgaccaatacttggagggatctcactttcaatggagttgctaaacaggtcgacaatctcaaggagggaacatgatgatatagtctccggtagctcaccagtgagggaattcatgcttagattgaggtatctaagatgtgttaattaaccggccaatctcaggggagatgtggccattgagttggttgccaggcatgtgaattctggagatgaaactgaggttagcaagacaaggaaatattgggccggtgatgttctgtgactcaagatccaacgcaacgactcgagatggattcttgacactacatgtaaccccattccaaatgcatattgcagaagattcatttctccaagaggctaatgctcctgaggggtcatggagctgggacttgaggcagaggagggcctcccggtcagcattggaatcgttgtggagttgagctgacacagaagaaggaaggcagcataggctctggaaatggaagcagactactagaataagaagtagcggtggcatcactaatggcttgtgaagtagtgatggaagagacaccatcttttcttgctctagcttgattaatttgtaagccacaacgtgcgatggggcaactatatatagcacacacagtttgagtcagtcagagatcgttcagccgtctgtgtctgacgtccaaactgggaaactagtagtaatccaactatgtaagcagacgatgtttctagcagtcttcaggtctatcatatacccattacttaggtggtgtttgaatttcctgaagacaaaaataaagatgaagattaagtatttcacacaaaacgaggtggtaataatgtgtaattaattgagttttaattattacaaacataaaaatagattaatctgatattttagaacaactttcatatagaaagttttcgcacaaaacacattattagtagtttgaaaagattgccataaatatccaaaactttatcctctctttacaggggattcgatcgcggccgggcagcgttcggaactatgagtttccatcctctcctctctcatttttgcaaaaaaacaataaaaagaatatagattaaagttgttttgaaaaaccatgttaatctatttttttgttttttaaattaatacagtattaatcatgtactactaagttacctcattttatgtgaagggcaaattaataagttacaatccatgaggtgattcgaatgtagcctaaatgtatatatatgcaaggcaaatttggttacagtaaatcgtgacttcgcggttttagctgtagaacaccgcgtgaagtgatttttggaagaagacactctcaaaagttggatatttgctggtggacatcccactcattaaaataataatttccggttgaagagtaaaaagaaataatgtgaaatatcaaacttgcccttgacccagatgctctcttatactctcttctgtttctatcatttgctctgtccctagctggaaggaggggatagagagagaagagagagagggagagatgacatgtgggtccattggtacttttgatgtttcacgtgatttctctttcctctttaaccggaaattgttattttaaagggtgcggtgtctaccagcaaatattcaacttttaagagtgtctttctccaaaagttactttgtgcggtgtcctataactaaaaccacgaagtcacgatgttctatagtaaaatttaccatatatgtagtatctcgctatgcggatgatgtagtatttttttctccgaaacgattaagttaaactcttttgttaaaaaaatccaatctaactagggctcaattcacagctgttatgttatgatgtgcttatttcaaaaaatgttgagaaaattataacatatagcaatctagaaccagatttaatcaatacagtgttacgaatttaaacaggagtgtgtccgaaggtctgcaccaccatatccatcacctcgtgttggtgtggtggaaggtatgcagtactgctaattgacatgtaggccccacatatcctcgggcccacataacaatgagcattctatatatgtagtactgcagaggatttggattggtgaaaggtttctttctctaaccaaactctagaggaagtgaacgacaactttttactccctatgttttaaaattcattgatatatagataatgaaatgtgatttatttggaacagaaatggtagcatagattttataaattgatgatttgttgatatgtagatagtgaacacggtgcatctgggccccaggaccagaaagttagttgcaaattcactgtcatttcattaaattatcttggccattccaccgaagacttggtatactgaagagcggccacttgagggagcaccaacgctattgcgcttcagggtcaggtgagtcgctggctaactaattttctcagtcttgttggagcacctgcagggatcacctagtggacgcacatgctcgatcttgttactccctccgtttcaaattgtttgacaccattgactttttaagtacgtgtttgaccattcgtcatattcaaaaaatttaaataattatttattcttttcatatcatttgattcattgttaaatatactttcatgtacacatatagttttacatatttcacaattttttttaataagacgaacggttaaacatgtgctaaaaagtcaatggtgtcaaatattttgaaatggagggagtaataattagtagccaaaattttctcagcccaagaatatatacctaatgagctgtttgatagaacggaataatattactcggttttgatggtacgaaaggagagtttaagttgactattcactactggagaactgatctttgttgggtcggcttaaaaccacattagtctcatttccaataaaaaccgggattaaaaatcatatttttccggttaaaaagcccaacgcacttttataatctttagtccagattggtgttattaaccgggaataaaaatcatttttacttccggttcaaaaaagcgtccagctccttactatctttagaactaaaattcaacacgtagtatataatccctcgtacttatcctttagatcgcaaactcttcctcctcattttttaactacatcctcctccctttcctcctctcttctctctctccctctctcctctcctctccttttctttttctcgctgctctctcttatcatctccttctctttttttcttgcagcgaacgacggcggtggcctgcgcggcgggcggcggcgcgaggcgactgcgacggcgcgacggtggattttgttgatttattatttgtgaacgtgaatttgttgatttgtgatgtctttggatttgtatatttgtcatgtgaattgtgaatgtggatgtggatgattttgtgatgtttatgtggatgttgatgattttattgttgagtttggttaaaaatcaatatggaaaaaaaacaatgaaaaaaaagaaaaaaaattagtcatggttagtgttatcaaccgggactgaagatgattgtgcctcgtgggagtagctaccatctttagcctcgggtatttcaaccgggactaaagataggcatctttagtcccggattcgcggtctcggttgcataccaaggaataaaggaggttgcgaaccgagagtgtagatgcattctctagtagtgaatctaacgcaaactcgacatttataagggtcgtaggacttttctcatcctatacagtaacttttctaactttaatctccaaacacgtgtttttcttccactgccaagaaacccttggtgctcctatcttgattgggctcctctcagagcaagtgttatggtagatgtgactaatatatccaaatttattcatatcatttactcataaattaagaggcaacacatacaatacgtcacctctaatacacacaaataccaatgtatctagtactctcacatcatttttgaaatttgtgtgaaggttagctcttgattaaggggtggttcatcatctctcctccacctcatcacctaatataatgtaacatttttaggggtagcatatgaagtattatagtgcgtgccctcaagcgggcatttgtagggttttcatgatgagtctatgttagttgggtgtgttggtttctaaactaggtgttcggtttttttctaaggagcgttatgagttaatttcatactgatccacatgtcctagtgcgctttggagtttggttaatttctgcgacaacaaatcttaactagaggggtagcgcgccgttggcgcgccgccgtcaagtaagcagtttaggaaaataacgaacatttgtatagtagttggagcaagtttgtacattaaagatttaaaatagagcggacatgtgtatggtagcatgtgaaggtttgtattttaaagatgtaggaagcgaaggaaaacacactgaaagaaggccatcagaaaagaagggagcgtaaagcggcaggtgtcggttaggacatcacacataagcatattagtaagcagtgataatttgcactgcatatatacaatagattttagtgctgataataagtggccagggtgcataggtaattagggtagcatagtggtgggaagggatgcatgcagttttgctgcatgaaaacatatgggataattcagtgctgacaaaagggcaactctactatagcacagctgataaaggtggcatttaaaggacatctattgttatcttgacgttgggtgccttgtagaagtgaaagatgcaaactgaatggagatgaatggcattggttgctgcaaaagttgcccatcctctctttaggttgcaacgatcgtccgatgatttatgcaggagcatggtgactgaatcactgcctgctgcttcaacctgaacgaagatagtttttttgcgtcccatgagtggctgaatgtaggtcactgaatattccttggtaaagtactgcaattggaactgcatgttatttttttagggaatgcatgaatagaccaatgtttgtctagtgtaagtatacttaccagtctatcttgcttcatgaatgtattgttcatagtcacaatatagaacttgctggaacgctggaggaactgcccgatgatgctgatgtagtttttaatgtcaggtgtgactgctgtattccttgcacaaaaaaacagagatcgtcgaagctatgtgtggtttcgcctgtgagcacacattgtttataagattgctatgtttaattggaaagaagtcatgaaataggtaaatatggctataaattctgttagtagacaattaattatatcatgattgttgatatgctaatagtgactcggatttgttctctgtactggtaggcttgtgtgataaaatctctgtggccagaatgcggatactgatgtggtgattttagaaggaaaagaactgagttatatgtgaacagatgaaaggcttacctgaattgtcggagctggaaggaatgtcagtcatcgactctgtccttgaatctgacgaagtctctgaaagatggtgttgaaatatgtcattagtgtgattggctatagatttgtacatataggtatatatcatggagcacaggattgtagacaaatatttgtgcacctttgtttgatgtgtgtgaaatgagcatggaagcatgcttgctggtaggcatgtcattgatagtgattcctgtcgatctctttggtgctgtcttgatttgtttcttggatgaagggatcatgggcagcttgctatcttttttcttgtcaaagagaaggacatttatctttgatggagtaagaacttgaaagcgaatgtattgaccagacagtaagccagtacggtgaacaaaggttttccacccttttgagatgaagaatgatcctgcaattttttctagttcgacggtcattggtggtgcgtgcggtgaaagcaatgttacagtctgtccatggtgtgcatggcagcctcgagcaatattgttcggcagccgctgttgtgaggcacaatgttagttaagaacatgaaagaaggtcaataggaaaagaaagcgttgctgttcttacaaaacgagtgcgttgtagcgaagtgaacttcaatataggtgatgtatgggtaggcatgattgaaaaacctgaaatgtatggtaggtggatgtcagaagataaaacagagcaatagaaggattaataggataacatctacattgtaaggtcaagaactgtagatctaatgaaaagggctctgtaattttggaaaggaaggaaacatattagtatcgattacacacagtataaatagagagaaaattaaacatgttagcttatgacagggcagcattaatgttaatgtggcgagttctacacaaggctgccattgttgctagtttttgttgagcaaaggacattggtagggtggaagagcagcatggctatattagggctgaaggagtttggatctggcatgggagatctattttgtagtaagaaaaaaaaaccagtggtgttgtctagatgttgtttgttggtggggaagcagaaatgctgtgtatttggaaggtgcagagagagtgaaagagggatgatagtggtaggaggaagaactaacctccaaagtggcgctcagctggcggtgggagtagaatcgaccttggttgatggcgattttttttgctctttggccggtcgctttgtcttctctgtgctagggctagggtggttgaagaaggcaagaagaagggataaggtttgtctgacaaaaaggaagcgtcgagagcatcgcatgggctttgtgggccttcgtacggagaggaagtaaatacatgggctttttggacctctgttttgtctgcacatacttatattagtggctttggagcattggctgagctgctctttgttgtagtgccgtagggaaagttcggttgagagcggcggcggcggctttttcctctgatgcatttgcgcagatctgaagggattgtgctgaccgcgcttgctttg

SEQ ID NO: 4225 - DNA, 2438 bp, Oryza sativa
catagcaatctatatggaagaggtgcatttgttagttcctacgaagaaagtcactgtctttctggcagtagaacaaattaggtgtgtagggagtaatacttggtgtattgtttgcaatgatagcatgtttattttaggaagaggcaagatgtagtttgctataatcaatactttatgctttgtctagctcataagaaatgaagaaaaacttaaaggacaatgtcttccattctgtaagattggaatgcaatatttttggttgtttgggcttgttatgagactgatcatctgtagatgtgtttgtgtgtgttttctgcaataactcttctagttggatatgtcatgtagggaggcatcagttatctgcctggcaatggacaatattagcaggatggagagtgctcctgctgttagcgctgacatggagtggtgtgatgaatttggtctaggcagtgaagaatggacaacaaaggttgaaattaagatcagaaatgtcgctgagcatgtgtgtcacccggaaaaaatggaaagattagtatcgtctttctgtgatgtacaaacatatagttttgatgcaatgaaaaaggagtattatatttgtggatttgctcgtagcattgaatcaatcccaaagtataaatacttgaagataaagtatgggacagagaatggagtctggattaagtttttcatgcttaatctagaggctataccgtacgttgatccagaaaaagatgttggggctaatggtaaattcattgtatgattgtaaatttatatattggacaattgactttttttctatctatgatgttagtactaatctgtcatacatacagaaaaggatcttgaactgtatgaagatccagatgttgtgagagaagcctttgaaagtcaagttaggctgcaacgcattgcaggtatgaatttggtctgcggcgtttaaatgcatgtcggaactacatatggaaactaaaagtaacacctgttttgttgtatgctgtataagatggtgaggaaagcagtatttcggccgatggctctttgtgcatgagcattgactctgactggagcctgaagtatggtgggcgttaaatagaacaacaaggacatcagaaagatcagttgtctatgaaagatgccaagaagccaactatttagtttattgtatatgatgtgctatataatatacaatgtagcctcgtagcttttgtgttgagtattagtatgctgtgccgtaacatgttagcatgtattacagcgtgctgtatgtaacatatgggttgtttgattggttagactgccgtgtgggactgttgtgttggatatatgcatacgtcattgtaagatactaaagtttgtagcttttgtgcacgatattagtatgggttgtttgtagctggagttatttcatggcctacgctctcttgtgtggctggaatctatctgtgtatcataatgttgcaaggctaaccgttgtgctatgttaatatcacttaggtatgtctgtgtgaactgcattgtcactctgcattagcacacgaatatgaaatctgttcgtatcttgcatgagaaactatatactggtcagggaagagaatgatgattgttctagattatatttcctggtctgtctgattttattcattagctagttgctaaccaatagagggtgctggcagcaaggccaagagggttcgatgtgccgtgtaggatccagaagacatggtcgttaatcagaatggaaaccatgccattctgctggtaggcaggagaaaaggagtgttttttgatggtagctatatagacaaggtaaataagagagaacgcttaggtagattatagggataaccatgtctttgtagcagcagtctagaacacacaacagtagcagaagcaaacataggcagcatttccctacgataacgaccatggacgaaagccatgaacaaaagaacttgattcttagcctaaataaaggaaggaggctccttctgcgctgtatccaggttgatggcctatgtacacataagcaaaagccttgctacgcaactgcatgtggagctgttatttgctgcatacaagatggaaaagtttgggggtcaggactgtgtttccatattgtatttgcaggtaaataatgtgtgttgtgagtggtaacctacacctgtgtgtctactaaggagcatccttgaagagcttcttagcacttggatgtaggagcgcaggtttttccctgttgaggtataaggacatgttagtaataatggaaaaagggagtgaaatatagatgcaagcaacttttatgtaagaaccttttcttggctgtggctgtagtagctgatgttgcggctgtttgcggaatgtcctctgcatgtttacctgtttgttttgccttgtagaacaaagaatgtttaggtggttaggtctaagcttaa

SEQ ID NO: 4226 - DNA, 9151 bp, Oryza sativa
  unsure (1)..(9151): unsure at all n locations
gctttgctggggccctgtttggacagaactgctggagcttgcggatgcaatttctgatggttcctgggaagaacccgggggcataagcagcagtggctcatttgaagggccagaggaaacaatgctgttaacctggagagattcttggcttcttttgacagtatcacgtgtaaagctgacattccatgtaaatgtgctatcaacaagcgctgcgatctcagctggaatgtaatcactatctggtggattgtcctcaatgagagattccactgatttttttatgaggcggtgtgcaactcttccaaaaaggataaatgtagcattggagctggcatcaccggcgatgagcactactttatatctacatgggtaatatacatgtgtatattaatgtgtgcagcacaattagtaagcatggaaaaatctggaatgaggtgtggtatgaaccttggatctggtattcctatgttagaacagcttgagcatttgtagctagaaccgtatggcttagaagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgtttttgtgaggattgagggcaagtatttcttgaatagttttttcctctgcagtgtcctggttgtaacctgttgctgggttatcaacccagctgattggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcagcgtactaagaatctatgcatgcatcaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgacccaatcattaggttattgtcgactggcctgtatttcctattcgcatacttcccagtaaagaagtcaaatatagtaaaacttttttttcccttaaccaaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtaaaaaatttcaagcatcaagcggcggagcctgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtgaagacaggcttcctaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtactatacactgtaaaattctgtctcctaaaactgtgactaatagccttgttccattgcataacccaattgattgattaagatttcgtagcagcattacaacaacaccttctttaagaacaagtttatgcgttggaaagttagtagcatttattgaattcagaaactctagggggtataacagatcgaaatctggaatttgctcagagctttttgatatggtatcacaacttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaaatcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagttcgtgatagatgcattgattatagcctgacgggatcctttaggaataactgggagtatttgtttgaaatcaccacctaggacaataggctttcctccaaaaggtataatagaatttgaagggcatgtctctgataaaatatctcgtagcgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcgattggtattttaaaccgagaatgagctgtcctacctctaggcaataggagagatgctacccctgatgaagcgacagcaagaacaatcttgttttgtgatctaagttttgcaattattgtattccagagaaatgtcttgccagttccaccatgaccagacacaaaaaagaaaccaggttcattagcgatagcacgagaacaaatagtgttaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacatcaccaacagaacagtaaagaaggactgtcacaaaaagttgtctaagctgcgctgaagacgcagtcactatggcctcatcaaaaaggagatgccattcattatctccttcaagaagccctcgtgcctcacatgcctctctatacgtgccataaacaacaccatcgtatgtgcgaacatcagcatagctttgagcacctttgacaatcattaacaacatcctaagatagtaaagctcgcctgcagttggatgcacataataaattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcacaggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcaccgcaaggaccatgcatcataaactcgctaaccaattcatatcctagccggtcggtgtcatagtcaggtatttcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctatgaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatctgcaatttcttgccatttggaattacatgtgtatgtgacaaaaaggtcaggaggcccatagacacgacatattgccatcgcatcttgataattcatgaccatatatcttcttcctccagtgaagctagcaggaagtatgacacgcttgccaactgaatctccatcagtgacacctttatcaattgcatcaacaattccatctacagactcagagcgcagctctttttgatgatcgatgaagtactgtagcctatttgtttcaatagtagaaaatatatcaacatcgatttgatcgctcaagcgaccatagcatgtgaaaggatttgattcatttagtctgtaatgcatttcatatctataatattccggcatcgtgacatactttttgccaattccatcatagttactgtatttaatgcctaaatggaatccgcgttcaccatatggaaataacaaaggatattgcaatgccatataagatggatgcaagggagaaatctggcgcaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgccgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcatgcagttttggcaattgtatgcgtcctcctttgcaacatagattgtaaattatttttctttttgaaatagcagatgcactcttgaccctctcctggtaccagaacatggcacgacaatacgggcattcatacgtcggagggccatagtatgatctgtctgggtatgatgctgccacaaaagcgctggacaatgtcaaaaatagtctcgtgtaaaaaaacaatacattacgtgcacgtattcagaacagcggccgaaccctttagcaatcggatatactccttgtctgtccgggaggaactaccgttggctcgtgcagtgcgatttgctgcgaacaaagacagtaaaacggcctatgaacctaaactgcacgaaaaaaaacaagcctaccatcacagacaacaaaaagagcataccatccacattggccaaaggaacggacggatccatatttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaacaatataaaacgaccgaaagctctggagcaaccacatgcagatttagacagcgatgaatgcaggcaatagaaacaaaatactaaaccaatcaaccataaataaaggacagaaagattaatagcgcgggaatacctttagcaaggaatatgctcgtcgacaggcagaatccactaaaacgcaccacgaagcgaacacacaagctgtgaacagaggcaaggaagaagacggaacagagctgcagagaacggagcatgatcagtgaataagaatgtaggaagcaaagcataacacaaggccaatgaaaccagcaacaaccaaaagtacctgctaggtcttagaagcagcccgcacacgtgcaatggaagatgatcaggaacctttaaaggtccattgcagcccatgcagatcgcctcccctaaatggaacaaaaggtgcagggtcaatgctagcaagaacagccgcgcagtcataagcaaacaaacaagagagaacaaacataaaacccaaatgacagaacggacaggagaaccacacgcattgatccaggccttaccacgccataacgaaaagttgaacaggagcaaaacgagtgggagtttctcgagcaaggaacagaacagtggagcgaagaaaccgacgagaggaggagaaaccgaagggaagaaagaaagagaaacgcaagtagtaatatatacagacaaagatagaaggggttctccgccgagctgcagcaaggaagcaaacaatcatgtacacctgcacaccaaacacccacaaataggaaccaaacaaatggctagctgagatgacactgccccacctatcagcgatataagtgcagcgcacctagctacaacccaagaaaacctgaccagagattagctgtgttcggctgagggagctgggaacgcgcacagtacttttcctccgtgcacgcttttcaaactactacatggtgcaattttttataaaaagtttctatacaaaagttgcttaaaaaaattaaattaatccatttttgaaaaaaaatttagctaatacttaattaatcacgcgctaatggatcactccgttttccgtgttcactgtgcgcgctgggaatggatggagccgaacacagcctaacagcataggctgcagaagaagaagactgcatggaccaagccgaatgaaccaagcatccaagcggattggacatggcccaggacgcagaggaacggggcgcatacaccaggaccacagcgatgcctgatattgacaacccacgcaaacgcaccaatagcggagaagccatcacagagtaatcccactacaggcgcggtctccaacagcatatggtcttagaccgtaacacacaggttcagaataaagcagacccaccggccagagagaaactgtgccatggacacagcgcacacgcgcaccaagcgaccaaagcaatctgacacagcagctaaggcaaacagcatagacctgttccacgttaggtacgaacaggcagaggccatgcggcccacacggcagccacaggcaatctgtggaccatggctacctcaaaaaacaaagaaatgcaccacgcaacgcataacaccggagaaaacaatggcaaggacacccaccttaccttgcgcgcggcgcaatgcaccgcacacaaaccaaccaaatgaggccaccacacagggaacaacacgtggcggacgcaacgcagagaaccagcggacgagaaaaaggaaaatgtgnnnnnnnnnnnnnnnnnnnnnnnnnnnnnnnnnnnnnnnnnnnnnnnnnnnnn

SEQ ID NO: 4227 - DNA, 315 bp, Oryza sativa
accatgaaggtgcgcgagaatatctgacgaagaccagagctcaactttttggaggataaaatatgcctaatgcctcacatacctaatcaatatattatatacgtactctactaacatacaaaacatgaaatgaccgaccaacaaacacgtctcaatcgatcagatcctaggtaagcatgcatgtagttcttttgtgaggcagtcctaaatgtaagggctataacgtctgtgtgttatttctcttctgctatgtatggacctttttctatggggaagggtatctttttcacataacatcaagctaccaattaatgc

SEQ ID NO: 4228 - DNA, 697 bp, Oryza sativa
gtgttggtagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacgtagacaaagctcaacaagatgc

SEQ ID NO: 4229 - DNA, 507 bp, Oryza sativa
tcgtcgtccccatggatcaactgccgacaagccctatggcccctcccttctctcgagacacacagtgtcgaccgatacattgacaccctcgcgccaaagagaccggatccacaccatctggtctttctcagcgccacgatcactggtagaaaaagcattttttttacgtggaggtcttattttcgctggcggacatgacgcttagagccaaataaccacctacaaaaatataaatcggcgcctgcgaaaattagtgtggtatatatatgtggcacatgcagctgaaatttttctaagtcttcttctcttccctcactctccccgccggcggaaggggcaaacggtgtggggcggccagcgggctccccctcccttcccttcagatctggccggagggggcaggggggaggccggcagccggcatcgaaacgcggaccggcagccaagcgcgggacggtgaccgcgtgtgctcccggcggcggcggcgggcggtggcggctgaaggcg

SEQ ID NO: 4230 - DNA, 7523 bp, Oryza sativa
tatttttataaataaaacgaatggtcaaacgttgtaagtaaaaagtcaaagcgacaattaatatttgacggaggtagtatattccaagttgtttgattttttttcaaaatttttagtttaattaaatttataaaaataagtaatataatagtatttttcaatattaaacatattatcaaaatatattataaaactaatttaatattgtaaatattctattaaaaaatatgaaaacaaaaaaaacctaatactaatactagctcgagctccgttgcatcaggtgttcagaaccacccgtgggccatgggcccgaggcccatcctgctagccggaataagtccactttaactcccttaactaatgatcaaatctgattcggatctttcaactgcaatactggatatttctaccactcaactgttccacgcacaaaataggagagcccatcacagtcacgcaaaattggtgggcaagaaagaaaagaaacaacttctgcttcactctcgtgaaacaaaaataggagtagtgtagaatgtgtgcatgggaatagagtgaaaactatatgatccgctagcgcacatattggcaattagcatgactggttcggttactgcctcctatgaatacgtaataggttaacatttcagatgtataatatggtttatagttactagtttacacgttctttcaatatctcaactccttttctattttatgtgacttgtttatatgagatagtggagtaaaccagagagccattattagaaggagcgatacagcaacactgaatttaatgctcacatctaaacggcacgagcaagattataaatagtaataagaaaagaattggttttaaaaaatactcggcacgatcaggtggtttatgaactggagcagcagcagctcctcttccctaccagcggcagcttgttagcagcagctcatcttccctaccagcggcagcttgttctgcatcacgggcgctttcttcagaaggaggagctgcctcaacctcaacaacgtgatttcaggcgccatcatgctcccgaagatgtggctcaagaacctcatcatgctcgcctacgtctcggcgatcaggctcgtctcttcggtcgcactgacggcgccgctagtctgggccggcatggccgatatgtgcttccacatggcgggcagcagcctgttgaacatgaaccgggttgcccatcgccctcatcctctacttcctctgcttcgccggccatggcttcttcctgacagtgtactcctcgatgaagtccaagaaggattttcccaaaatacacttattaaaatttatttatgtgttgttgatggtaagtttactaaaatttgtgataacaattaacaatgtaaatttagaattatggttaatgaaaaatgaaaagtcaatggtgaaattaaattacaaccggtttggtaagaatacaaacagattgtttttttattatatgcgtgcatggaagacgcacacactcataattattttttacaactcgtatatcactaatcatgcacaacatactcgcacacctcctaatcatcatcgctactacgttctcattatactcaccactgcatggccctcatatgttttgttggcgctcccatcatataccaggtctatatacatcgtgcagataaaatttaagctaataaggttattttgatcgtccaattaaaagtaaaaattaggatcagacgaaatcaacattaaaataacttattttattaaaataagttgtaccatcccttaaaaaaagttgtactacttataaattttgtaaagttattttacactgatagagaatggcgagtgcaatacgaaattaatgccaagtgcaacatacacaatttagcattaatatttttttgcattatgacgaaatgcgcatccgcaaaattcgcccccaaattgcacaccacccccgaaaccctagaatccatcgggaggtaaaagggaaagatgggtacgagaatggggaaactcaccatcaacgccacaagtctccacccaacggcgcaagggactccgcggggggagccctcgccggggccggagtagtcacaactgacgatccaggggggtgagtatagacctcgcacccggctcgggagagggccgctcctggggaagttgaaggatatggcttgcgctggggtcgggagaggagggaaggaggggaaggggaggatcaccggaatcttcgccagcggggggaggaggggaaagtgggtgtgggagggggggattgctggcggcgtcgccctcgcacgaatcgcggggaaagggaggagaggagggggtggggaatgatgggacggatccgtgaaatgttcgacgtggtgtggtgcggtagcgtaactgtgggcgatgggaaggcggggtaatttcgggcaaaagggtcgcgcccgcgcagggccgtacgtacacgagtgcgtgtaggtgtagggccgttagaggttgaccaccacgacatgcataaatatgctccggctgtgttcgggaggtgaggttggcaactcacacaaccttacctctcacgcacgcaaaacggtgcgacgtgttttcttatgcttaattaaggatttacttattttttttaaaaaaaatattaatatggttttttaaagcaacttttcaatataacttttttgaaaaaaaacacaccgtttagcagtttaaaaaatatgcacgcgaaaaacgaggaaggtgagttgggaaagtttgcggaaattaaccgtgtgctacccgccactcgctccgttttatattacaaatcgtttgatttttatccaatgagtaatatgtaatactgtagtatttttaatataaaataaacatattatcaaaatatattaataaaactaatttgatatggtaaatatcttattaaaaatatgaaaaaaaatcctagtactgataatagctcgagctcctttgcataaggagtcaggaccccgcgggctgtggacccgaggcccatcctgatagccaaagcacgaaataggagagtccatcacagacacgcaaagttggtgggcagcttcactctcgtgaaagaaaattaggttattgacagtgtggaatgtgtgcgtaggaaaatggtgaaaactatatgatccgctagcgcactattggccattggtatggctggttaggttactgcctcctataagagcaggtataataggaggttataagtcagttataaacatattttaaagagataaaataggagagagaagagcagcgggctacagatctgtagacagctccagcacggacttcaagacataatgtgtgtatataatgtgtgtatgacaggtgggatcaggtattaatagtatagtaagcactattgtatgaatcgactattaaggacctgtttggcatagctccaactcctaaatattgctccaggagttgagtctggagtggagttgtgaagctgcctaaacccagctccacaactctagtacattttgtgagagagctctacccaactccactcctagttttggtgaagctaaaactgtttggctgagctccagctctaggaggggtggagctggagctggagctatgccaaacaggccctaaattggctatagataaattggagcttgttgttggctatactattaaacttgctctaaatacgttacatgttaacatgtaagatgtataatatggtttatagttattagtagtagtttacaatttctttcaatatctctcaacttcttttccattttatgtgatttatttttatgagatagtggagtaaaccaaataaccatgattaaaaggagcgatacaatatcactaaatttgaagctcacatctaaaaggtgcaagcaaggttataaataataataagaaaatgattggtattaaattatactagtaagaagatatatggcacgatgaggtggtttacgatatggagcagcagccactcctctttactagcgacggctcgttctgcatcattggcacttccttcaggaggagctgcctcaacctcaacaacgtcatctcaggcatctgctctccgtgtcatatgcggtaagtggctcagccttgcactcttcaccatggtcggcgctatctgcttctacaccggcaaactcatcgatcgctgcatgtgcgctgaccactgcgtcagaagctatccggacatcagccacccagtgcgaattgtaaattgagatggggctgtgtaaaagctgtatgactgaaacaaactagaaatatatcgacaaaagtattttttaatgaaatccaaatacgcatatgaacgggagagaacacaattatttctccatttcaacttttgttgctataaaaaatatccttaacgatctataaataaataggtatggtctgcagagaatgatctacgaataaaatttatcttgcttaagaccattggtatggtctactttagctagtgaggtagcttgccttgccgccaactagtttttcactaatcaatggttaattatatgtgttaatcgctaattaggtgcatgaattagaggttaattatatgtgttaatcgctaattaggtggggttggtgtcccaaccagccccaagagtggatccgacactgtgtccatcttgcctacgatggccgtacctagccttcgccggctacggctagatggccatcggcctcgtcttataagtcgagctctaccttgtcgccatcagcttcctcatcctcgagggtgacaacatcgagaagctccttcctggcacggtggtgaagatcctgggggtaccaggtgtatgggaagcagctattcatgctcgcggtggggcgccatcatcctcctgacgacgtggctcaagaacctcagcatgcccgcctatgactcggcggtcgggctcatctcgttggtggtgctgattttgatttgtacccgattattgtattcgtgatttacaaaagaaaatgcaaaatttgaaataagggaatagaaccgtgagagactaccaccgggagttttaaatttgtatgttgtacggtggcataggcgagtctagagaagatacaattaaaaggtttttacatgggcttgatttaaagtttcagcttaggcttaaaaataaaacacatagccatctttttagttacttttgatacatgagaatattcttgcgccttctattgtatataacatcatgtaggaaggtaaaagaaattttgaagaaaagaataataaagcacctaaattaactcaagagagcatttcaggtaacttaattgatgttcaactagaccaaggtaggaataattgtgttatgctacaattgtccactagttatgctatgttagagcaacctctagtggaacgaatttctaatgtgcctttatcacaagctaaaaattcagattgtgttgatattgataatgcttgtaatgaggaagagttgtgcaatgcttaacttatatacatggcacaattagtgaaagaacatgctacttctatttctgaatatttgggttccactcaaaataaacgtgtctttgctattgctaatgactgagaagagctgcaattattgtcttctttatgtactttaggttatatcgaatttgacgttccttgtgatctaaataccttagagatgaaattttatgattttctatgtttttcttggaatagttatcatgtcattggtaaatataataatagaggagattatatggtgcatcgtgtttatatatgttcatatttgaatactcctttaaatatggaaaaaatgtgagaaactaaatggatcgtacagcgttgatgctattgggataaatttacttaaccttgttttgaagatcgatgacaatattcaagaaggggagtgctatgcaccattagattctatggtcaagtctcactatctttttaagacatgtccattaaggtgagttcgtttttcgtgatgtaaattggatttatatagaacaaatgatgctacacaatgattgcttgtttgctatttttttcatgtgatctctcctatgacgacaattgcaacaagaaatcgagaacggtttccagacaagaaggaggatgatgtgatcatcaagtatattcatacaaccaagcatgagaaatataaaacattgcaaaagaatacatcggatgaatggaggatctaaagatattaaagtccaatgagttttggaatccagttcagcctccggagacagcactgacttcaaacggacctagcgccttcatatggtcatgccaactccgatttggatgatgttggacttgatggaaagcttatctaatcaactttcaaatgcatccagtctcatatccaaattcattttgagttaacgggaatcgtcaaaacaagacagtgttgttgctaaaaccgaacttgggccttgggctttctaatagactaggcccatctcgaaagtgtctccctctacctccacgaatcagcactaaaccctatatctattttcctctataaatatttatgtacaccctctagaacaattgggttttgtttagttgaattttgctaagtgtcattcaccttgtttctagtccttgctcgattagttggcgactatagattcagagcccccaatgattaatacataaggtagtcatggttatctcgcttggttgctttctatctcgttcttgtttgtgttcttcgattggcaaatagggattagccttctcggcgaggtcatccgcgtttcgacacgggtgataaccagaggagacgtgatactgcgattgcagggctcaagagcgtgcgcgttcaagaagccagatcgatttgtgtcgcgactccgcccaaatcgtcgtttatcagaaccttttggaagatcgggaaccctagtgtacatcaagaaatgttccgcacaggatgctgtgatagacaaagataaatacaatatgctccatgacaaggtgaaaccgaggacggtttccaatcaagaaggggaggatgatgaggacataactagctcggatataaccatgactaccttatgtattaatcaaataaaggtgcatatattctacattagatttacttgttatatatttgaacaaacgttactacacaatgaattttgtgtgttttcgattgcagaggtacttgcttgggcgaaggaaaagagaccgagcttaactaatacatggatgattaaagaagttgattggggaccaaacccaagaccttctccaagtctacttctacctcaccacatcacttttggcacatagaagacaagagatcaagttgtacacgttttggattcggattcgggcctcctgacagcatcaacttcaaacagacctagccactgatctagaaggtatttcggggcccatgagtacttattagaaagcttattgagtctactttcagatggttttagttccggtcaaaattcctaccgagctgccgggaatctgcaaaacaattcacgtatctcatctagatccgaatctgat

SEQ ID NO: 4231 - DNA, 1601 bp, Oryza sativa
caactagctggaattcagtggacttgtaagcacattcattatttttaactgccaattcaatagaatgcccaccaaactttaggctgcagattcaagacaaatgattactcattacttttttatcacctacttggacgcctggagcatgacagcaagtagcaacaacaacctgaagtcgatcatattgcaatttcagtttgtcctactcagtttgcacaaagattttctggtaggagtccattccccctcaatcagcaaaagtagatttttcccacatgttaaaacggcatcaagcagtgcattcacttgacagctacactgagagtgcatcagtctatccattgaaaacatgcaatgcatcattcaacaagaaaatgctaacgagagagaccaagcgacgttcaggggatcgtcgtttacctgcaacacgggatccggtgaccgccaacgaaggggatgcagcaccataagatggagcgggcgaggcagcctggaaggaggtaaggccgtgcggtggcgcccttgagggtcctggatggaggtcaagctgtgtggtggtgccctcgatggccctgatcggaggggggcgtcggtgacataggttgtgacttccctttaaactttcaaaaaatgtcacattaaatgtttggaaacatacatggagcattaaatatggacagaaacaaaaccaattacacagtttgcatataaattgcgagacaaatcttttaagtttaattgcgccatgatttaacaatatagtgctatagtaaacatttgctaataacggattaattagacttaatagatttgtctcgcagtttacaagcgaaatctataatttgttttgttattaacctatgtttaatactttaaatgtgtgttcatatacgtcaaaaaaatttttataaggaactaaacacagccatggaaggaatggaggcgagcatggagttcaacaaaaaatgttgtgattcctcggattgggggcctctgcaccttggatgaaggactggcgctgccataggtgaggagacaattaatcagacaagtcaacgaaggcaagaacgcggcttcatccggagctatgaaggatatgacccaggaagcctacggcacgagaggaagagaaaaatggtgcgtacggaaaaaattggcgctggcggcccaaatctactgtggttgggaatgcgcagagcatcccaaaatctggttaggattggcaccgattttggatgtgggtgaatataagggccatataggtacgtaaaatctaaaccgagaggcttctcgctttagtcgtatcacgcgacacggctcacagccgttcgatcgtgcctgtcatcccgacgtacatctgcgtggctgcgctctaatggctcaataagaggatcaacgtagtgcctggttgccttttttaatagatacgtatgtcttttttctcctcaaataaaagatttcttttaaattacctattcaaactataatccgattacaccattatgttcattacaaataaatcttcacaacaagaacttacatgattatattacgatgaaaaaatatttatatttataaattacctttaatatatacgtaag

SEQ ID NO: 4232 - DNA, 403 bp, Oryza sativa
gctctactataaatcgctccctgaataacctcattttctttgtactcccatctcacactatcctcttcagagacgatcagcccagaaaaatcctcactagcccattctgctggattaatatccgtctcatcatctgacgaatcaccttcgtctacacgctcgttgtcagaatcctccctctccatttcatccacaatggcaccgacagtctccccctcgtcggccactccacctggttgaatgccaactggagctactagcccccgtcctctcgtgcgttgaccttctccacataagtctcgtttacttcagcacttggtccctcgccatcatccatgttcatctacacacctggatccttcgggtgaacaaacggaaccaaagctagaggccacccgcgttg

SEQ ID NO: 4233 - DNA, 1121 bp, Oryza sativa
tcctttaattaattaggtccttgtatataagtagcccatagaaaataatatactcccttttatcgttgtagaatggagattcaaagggcccatcgccggagggttttcgatactgaattcatcgaccctcggaaaataaacgtcgcaatgctcgaccaatatccccaagaaacagaggacaatctcgtccatcttctgaaggcgcatcattacaagacgttcatactgttgccatacaacacagagttagtttaattaaactgtcttcatacataccaaatttcattcccgtacgaacttgctaagtgtttcatatgtaatgcatcccacgcacattgcagattccactgggtgcttttactcatcgaccctggaggcctgcaccgtcaacgtatatgactcaatggataaaaaagagtctacgtttgacaaggttttcgaacttatagacaggtaccgccataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcaaggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctatcagcgagtactactacgtcgaaatcgtagctagctaggacatataatggattgtaattaatacatgactacatatgtttcta

SEQ ID NO: 4234 - DNA, 916 bp, Oryza sativa
gtcattaagcctacatgacatacaacaggctattcggctagacactcaaatgcaagaagaaacattcaatgttgcagttcaagtattagcagcggatgagatacagagatttggaggaactgattttgtaggctggagacatttcttaaatcaagattttgcagtaagtgcttccaattactctagactattttaattcttaaatatggtgtgttttaacacaatatggcgctatagatgtttgcaacagctggtgatgaccagtggaacccagaggatcatctcccctcattcaaagatgactccctgataccatatgacgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaattatgcattcttgacccactgagagacgcctcgaaaagatcagaggatacagcagaaagacacttaaaaacaaaatttcacatttcatctgctctgaaggagtgcatgaagcttgcatttccagattgggacgaggatataccaaactgggtttctgagttcccttcggccatcccagctataaacaataggttccagttcatgctcccaatttgatccaaattaatttttccattctactcatttatggtcattacaataataacaattttggtaggctggaatgtgcctttcacgtgctctactacatgcgaaactgggatggaactcgccttgtgaaccccccaaaatctgtgagttttatgtacacactagagttcaacttaagtttcattgaagtagcttccttttataataaata

SEQ ID NO: 4235 - DNA, 6930 bp, Oryza sativa
cttcttcctctcataattagatttccgaccacatgtactcttatagtggccatgaccaccacattgcttgcagtacctaatctgcttcgttgactctttttttcctttggcgtgattcttcgactcgtccttggaggtactctcactagccttcttcttctttgctttgctagatgtctctcccttcgacatcagtctggtactcctcggtcgtccacgacttcttctaacctcaggagggagtatgtcttcttcgttgacatcagtcatgtccacatcaactgaatcctcaccagcagaaacatcctgtccaatgccgtcctcatcggctacacaaaattcatcagacattccatgctccgagtcagaactgtctacactatcatccaattgcacaccagtaggtttcttcccaattgttctatctccgcagtgaatttccttgttgtttacaacttgcgaagtacacatgacctgaagttctccaatcagctttgtcaacacttccactgtcttctcatatgtttctgaactagtaccaccaagtctaaccatatcaagtgcagacttgtgcaggagggtgttccgataagttctcgataatgccgcctccttatccttcaagtaagactcctccaagtgctttgggattgaatctctagcatcttttgtccacctcttcaggatatacttcttcggtatttccgtgtaaccatactgtaccatagcctgcagcaactgtatgcattaacacacagaaactcaacagcgttatgagaactgtttaatattcaaacttactctgattaatatgggagcatataattcccaagtgttcaaaaagcttgcatccacatgacagatcttgttcagtcccccccacgtgaaccttaaattctttgctgccccaactttgcaatgtgtcatcacctatatggactagctgcagaacatgctgatcagaagtatgataaaccataaatgaaaagcttagcttgaactgttccttgaacctggaaaatgcacccctagtgtacacccgagaagcatgtttctcaatgggcgagctagttaatgtggaaaccttctcctacagttcacgagaaatgacaagcatattataacatgttcagcagaaagtaccatacaccgatatatcatatggaaataattaaaaaaaaacatacattgtatgtatcatgctcctcagcgtcttccgcttcaatcctatcattgtagaaattctcatacctctttgcaaatccatgtagcgaagaggatggttttacatacttcttcagaacatgattcatgctctcacttctttgtgtggttgacatcctagcaaaaaagaattccctgaagtaagctggagcccattttttcttcatgtcccacatcctgcgcaaatacacgctagactcgagattgtactgctccattaaatctgaccatgccttctcaaactctgcctctgtttggggttcatttaacacccggtggaactcctgtttgaaactgcttcttttactgtaaatgttccccaagttctccttagcattcttcagaacatgccatttgcaaactctatgaatagtttcaggccaaaccgctttgatcgccacctccatttgatgacagttatctaaaaaagaagttcacaaccattcgagattaaaaacagaagacatatcattaaacacaccactgatccatccaaataaacatatacctgttaaaattgctacaggcctcttcccatgcattgcatcagtaaatgtttggaaaagccacttgaatgcttcgattgtctcctccctcaacaaagcgcaaccaaaaattgctgtttgaaaatggttatttacaccgacaaaaatcccaaatggcatgttgtacctattagtctgatatgtagtatcaaaagtgattgcatccccaaaatggtcaaaacttaatctggaaagagaatgacaccaaaatatatttttaatccttgaagcaccatcaatctgtatggtgtaaaagaaattcttactacggcattgcatttccctaaaaaaattcagtgtcttctgcacatcattgctacactcatcccttctgatggcatacgccattcttgtcacagccctccttgtaaagggggttaaggatggcccgccgtgcatacctgaaagtaatccatacatagctgtaggtgtcatcccattatctaccatttcctttatgttcctctttgtcccttcatcaatgaaattatgagaccggaagtgtttagtatgctgcaggtcccgtttcatttcatggttgtgctcactaacgaatgcagaaactctccacttttgactttcagaagaacgatttaacctgaccatagccttgcagcctatcctggtcggcggaccagtgacggaattatctctaccctgcataaattacaggaacaccttactacgtaaaacctatgaaatgatgatcctacgcatcacactatagaaccttgccaatcttacgagaatacgaaaccatggttttcaaaaaaaaaagaatacactaaagatttttacctcgcgaatgcagcagaactcttgcatggacttcacgcctccatctttgtatctgttcttggatctccttataccaaaaccagtgaacctagagtacagattgtagaacgcatagccatcagagtcctcattgaaggtctgcccaattttcggcaacagaatggctgggtcagagagtgaaataggcagcagatcactctcttcctccccctcaaccacgatcctaggatcaaaaaaatgagaattcagctaacaatgcagaaagggaaattgtacactacaatcacactgacataaaaaatacctttccaacggaactacgtccatgggttgtccactatgatcctcgccacctttctccggccagccttcttcctccatagctatcttcgcgaatattgtttctgtccagcacggattctggtagctaccccttttggcaaacagaatttgctatagggcgtcattttttccagctggttggatatatactgacaaataattccggtttattttccattagctgttcaacaacctccccgaaaatcaaggctcctacgtgcgaagcatgttattggactccggaaagtcagccactagcaacattaacgaattctgatgaaaccataccgccacaaaaatagcatctataacaaacattccgagtacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaacagcagaagatacagatttctaaacttagatactactcgctttttcctcatagaaaataccatacaaaattagagacagttcgtacgactaatctacgaccgtgcagaaagcaagcccttattacaattttcctgatcatcacactattgtctacatattttcattggacacatgttcgcaaccattactgttgacccgggttgtttcgttgcttctgaaattcatgtcgcaagccgcgcgaatatcacggagtgagcaccaagcgcatctcttcctaggatttctcatgggaagaggatgacatccatcgaaatgaatgacatatttttggagagagtggttcatcacttcactccgggcagcagtatccatgcaacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaactgtaatggttccatcttctgccttcgccatatgatggtgcttgctactactcaccggcgacgacgcgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgcagaacaaaatcttcttcctcacaaatccgaaagataattgtggtcctcattttctgtcctccatcaccgtcaacttaaatagagtatcaatacaacaacctccacactaactactctcttggtcgctcggtcgtgcatgcgtgcgggtaacaaaccatgcatgcagaacattcaaaatgactcaccatgcagaacacagcgcagtgatccgaattttcaaaaaaaaaaagaatattcaagtttctgcatcgctggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatacacacacacacactctctctctctctctctctctctctcaatgcaatgcaagctagatagaccattgaacatattttgctgcatgatagctcatattcttacattgttctttcttccgaactatatgtttgctaaaactctctatagcatgagatacaagatattgaagtgaaccactatacaataaaacgtcgtgacaaaatgtagggattgaaaatatgggttattatgccgttttttaatattctaataagtttctttgttgcataaacttattactaaactacgaaatttataatttaattcatattttttgttgttaaatataatattttgcaagatgtctagttcaaccatcagacactgacatggttatgctgtttgttacctctataatgcttattaacacggactaacaatatatcataaataatgtttttttatcaaggtgggattaattgtaacccataatcattatttatttttctgatgggattattttgtacagaccaatctatttactcatattgtttatgtttgctctatcaaacaaaataaatgatttatcatttagatatatacattaaaatgaaacatgcatgtatattatgtttctaagatttttttactttgtttttttatggttcaaagtctccattaaaaagccgcactatacatagggtccaactttgtacacagatcttgctttatcttttaatttatcatggaagatattgttcatacgaaacaaaattctgttgttaacagatatacactagtacacaccacccacatccatgagtgcttttgctcaaccaagcttaaaactagaaaaaataaacttaacaattgtgagagaacttagctactagctaggagaacttagctactagttaggagacagtattctgttttcctccatggttttcgggaaaaaaatgctaagctttcttttgaaacgaacagaaaaaactaattcaaaatctcagtacaatttttacaaagtctatcgttctagttatacataggcgtggaatcaattaagaagaaagaagggagaaaaaaactgatagtgagttagcgacaccatataacacattgatttttgaaacaaaaaatagtcagccaaattaatctccaaatatttttatgtgtctatggtgaaaaggtgaagaataatataaagaatgaatatgtatccatcatcccactttttacaacaaaaaaaaatgaagcactaacttggcattgccgcacacatcttctgctctgctttctctcctctggactggtcaccctcacacaacttctatgctttcttttctctgcactagtcaagaatggctaagctgtacatcatcaatgtcttacaacacatttgccttcagcagcagtgtgtgcgcctgttgcccctcgatttcacggcggcgagcatctgcgtcgcgatgccatcgacaccgttctcctccaacggcctcgccgcggctgcgaggacgccgacgatctgcaccagaaacaggagcaagaacaccaccctcgccgtcgccattggctttctttcaatcttcaaaagcttcttagatgatgttgagctatcttggacaatgttttgctggatcttgattttataggtgaaggtaaagttatggttaagttggtgcctaacgtcgaacatatgctagttgcacacataggagccgagtagagtttggttggtcgccgttgccgtgtctctgaccttacgacagttgacaattaaaacagtctacgtttctgactaatttggctggtcataaagctcaagctttatgcattctttctcatgtatgagtgcatgaaagatggaagtgcagccgtgcagcagccgtacgtttaccacatgataatatggacggcacacagtatgtataatatatgataatctttttgaaatcaatgtcacgtctgtatcatagtgtttcacattcatacgaacaagccctgtgagcaatatcaaatacggtctcacaccagactcaattaagaacaagtagtgtgtgtctttgctgattcgtacatttttttcaatacgatcataagggcaaaacccctgttccattagtcatagaaacaaaacaaaattcgattcatacaaaaatcatatgatgttccctacaaaaaaccatatgatgattcattctgaaatatttaatgtttcaaacactaaagctaattatgcaccatagattttgaacgagtgattggttcgtcttgacggcttgattaataggtcgattccatgggttcattcatactcggtccattggaattacagtgctgatgtgagaactccaccactattcactagacacat

SEQ ID NO: 4236 - DNA, 22436 bp, Oryza sativa
gtatttcacttccaccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaatggtctcttgacttctgatgcaacgtaagcgtcgagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatacagctcatatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtatgtgtggatgtcctccttgaaaccaatcttccaaggaatcacccctttccctcgagttcgtcctggatgctctggagtctgcagggcgagtgtcagctcgtccctatctctgtctggtcagaacgtgccctgagaggaggcttccactgcatctgttagtcgtcgcgcagcctctcgtatctgatagccgaagaccagtgagccatcagctgggttgagcgttccatcgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgtgtgcccttgttcttcgccagtacaccgtactgacaggcacgttatcccgcacaacccaaccgctgtgacgtacatagttcttggtggcttcggctggggcactaggacgtccatcttcttccacttccgttatgatgtgccgacccttaagcttcttcgctgcacctcgttgcccgcgtgccctcttctgtccaacggagggttgactaccactagcctcctcctcctggttcccctccacatccctttccacgtgcccctgctggttcccctccgcattcctctccacgttcccttcctcgttcaagtactgggttggatcctcgttcccctcatcttcattccagtactggctgcttccctccgcgattgtatcgtacaatatctgttcctcatcgcggtcagccatctgttgatacaagaaacatctgttaagtctcgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttacaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatacatatatatatatatatatatatatatatacatatatatatatatatatatatatatatatatatgtaaatttgtttggtgctccatggtgcccgggcaccattgttgaaattgagtatatacccaattcaaatgagtatgaaactttttcaattatttaggtattaacattaactactttactaactagtttaaagcaagtttgaactgaatttgaacttgtttttgttagattttgattctaggtatatagcatccatacatataattagttaggtatgtaattatggattgtgagataaagttaaatttgagttgttttgttgataggtgtaggtataaatcaaattattataacttggtatatactaataatttgaaaattttgaaaaagttgagtgattttatgcatttgataccatggtgcccatatatggtttcgcggacaagttgaggtaccttaggtgtactttttccttctgtctccaccctcatccagcgatccaaagcccaacacagcaatcgagggtttcggcctcgtcgtccccgccgccggcgacaagcgacggcgagcgagccagcgaccttctccctcgcgcgccgcgccgcttctccctcggcgcgccgtgccgccggtgacgtctccgtgatccaggtgaggacccgtccattgccccccctcgctcatcatcatccacggcctcgactccaccgttcgccaacggcgtgacgctaacccccctagatgtggcggtggccgggtgcggctaggtatgaagagggcggcgccgtgggaggagccgctggaagtctcctccgacgactccctgagctcggattccgacgatgaagccgggaaggggaaaggggacaacgccttcgggctgcccaattccaccaaagctgccgcaccagacggtgagagctatcccagtgatctgtctctgtctttttgttagctcacgaggagatttttcatatttttggtttgttagcatgctatatggcctcgctatgctctcacaagattgttttgaatgtctgtattgtgtgttgcctgtgagatatgagttcaacatggagtatggatttttagtctgtgtttcctagctagcttatgttgtttcggactgtaaatttagtctatttgtgaaattagggcttgtttctatatgcagggatcagaatctatccatttggatggccagggattttaactgcagttttctatatctatccaaagggattggatctagtccccttccactcaagcaaagccatagtggttatttacccgttacctttcacatcagagaatcagcattactgtagattcgttaacgttatcttaagattattttggccagccatctatggaaatttggggcttgttcttttcatattgattgggattgatataacagtaaattatatagcagtacactgggggaactcacgtgtttttctctagtggtagtattcatttttcttagactttgctaaagaacaaactaagcatgggttttcttttgaaactaagcaacattaccttagctagtgttctattcttacaaggttacgcgctatatgttattttagcattctatatagagtatagatttcatgtgaccaagtgaatgttcagtattttgaagtacatgaatttattgtgatattgttgatatttgagttatcgcaattgtcatggaggaattccctgttttccctgtatgttaatattgcccacatgttattttcacagttgaggtttgagtttgaaagttgtccacttgttgccattattaaaagatggacattttaagaaaagttgtctcccaaacaatggtatttactgctggctataccacttatattaacaggctcatagtgcctgcatccagacaatcttgcaggttatatctgtacctggttttacatgctgatttggccaaaaaattcttggagtttttaatatgattttgtgctaattatgaacaccactataataagtctatctaagtttcatttatctcttataactaagtatgtaattaatactctgtcattcaaagaattatcatgagttgcccgttaccttggagcttcaacagtcgagtcctatgctttctctatataccctatgggatgagccagagaccaacactacaaaataagttagcaaattagtactccctccttcttccacaaaaagttacacctattacttttgtcaccaagaccaaagagaaattaactcatcttgcatataacaaagatcaagaagtgtatgcacgcatgcaaccaatgagtattacgatggctccttgggttttaatcaaacatttaatttacctctccatttaagttttggatgcatagacactacaaataggaacaacttatttggaaaaaaaactcaaatatgaaataggtctaactcttgtggatggagtataattttagttctcaagcactaatagaggctttgagctggattttatacccttcagacatggacaatagcgttctgctttggattggctcatgtagttttaaggtttttttcctttctacgtagagatacaaatttccatgcttactataatgagatcatgcaggtgcactgatcaggaaggctgaaatgtatcaagagtatatgaagcatattccagttcctgctcaccgtggatctgtaatcccatgcacaacatggctgggactcggcaggtcggtgaagcagttatataagcagcctttacattaccttaccaatgtcctcttgaaacagtgggatcagcagagagttgggagtgatgatgagcaccggcctctggatgctatcatccatcctgtgaaagctgaggcccttatttggatcactgaagaagtccataggttgaccacctctagtcaacatttagccagtctttgggcatcagctccaatgtatcatgcctacatagatccagtgttccctcccataaagttgcagtagagcgtttttgagaaaaaaaaaattaaattgtagtagaagacgttggtttgggttgtctgttttgttgtctttttaattgctgtaatcagtaagcttgcacagtttggttttggtaaatcctaacaaagccttatggattccagatgatgcatgtttctgagtattacctctcattgttagtgttcattttaacattggttttagctctctgaacaacagctatgtcgaagaagaagaaacctggtggtgtggatttcaatgctttgagccggcatgggtatcgtggcggcccatctgtcttgacggtgccccctccaaaggttgagcctaactggtcttggtccaccgggaaagatcgcaacgacaaagaagatcaaactgaatcctatgaagaacgggagcgcacaagaactgcagtaactgagggagaaaagcttattggtgtgcgaaacccgcagccgaggcagatggagaaagagaataaagatgcttccttctcacagaaggaaaagcggaagagagatcgtggccaggctagcagggggaagaactacgttgaagaagagaagcgacttctgagggggagtggcgtctactctggctttgacacttgatgctctgttttctgtgcctttgtttgacatgcatagtaaattgttttgtgcttgtgctatttgatgtgtgttggtagttcgtgcttaatcctctgcttccatatctgtggcgttgtactgattgaattgaattcatcttggatcattggcataccgtgtcccatatttgttggtaatttactaactttagatgcaactttgtgcaatctttgttgcatgcacaaccgcgcttgttgtaaatatgtactccctccgtccctaaatatttaacgccgttgaattttttaaacatatttgaccgttcgtcttattaaaaaaattaagtaattattaattctttttctattatttgattcattgttaaatatactactactactcaatcttttgaataatattcacaaaagtttttgaataagacgaacggtcaaacatgtttaaaaaaattaacggaaaaattaacggcgtcaaacatttagggaagaagggagtaattgctttaagctatacaaaagggtgggagatgtcaaggtcacatgggaacagtttatctgcagtttatctgtgtaaggatgtacttggaatctgtttatctgtgtgaggatgtactaggaatctagaatgacatggtgaagttcttcaggatttcgtttacttcggctcattttaagtccgtaaaaaacaaaacaaaaaaaaaacactgccaattaggaccggttttgttttgatgccttattacccaaaaaaaaattcgctatctgaaaaggagtggtttgttttcgtttggcgttcaatttgtgtgaacgtgaattgaattcacgctatatttgtgtgaagaaaaagataaagcacattttgtagggtaaagttctgatggtgtttggtatgctacccacctactgtgtaactgggcctctttaaacaaccttaattatgttcattagtatggtcaagccaaattaaatcagctggtatcacggatcatcggcacctgcccaaacaatcacaattgtaaaagcatcaaactaaacacgtcagaaaaaggataaagcaaacagaccatcaagtcggaaaaaaaagtgatcgtaatttaactgatatgctcactcgagtttaagtcctatggtatgttatggacgcttaatattttaataagcagttggttgttagtcagcttgtgagaatctaaatattggttcttagcttctagcttttgattcattttttctggattccacaacttcaacttcttaaaatctagatgaaaaattagattgttcggaaatagccagcaaagtatagtactgctatctaagtagccacaaagtaagtagcagacctatagccatgatgtcaaatatttgtttccaaatacttaccccgagtcaacctaacaataaaaccaatgcaaatcagatacaaagagaaaaaaagcaagcatatttaaataacgacaccattttcccactcagatagttgtcttaatcaaacatagcaatttagtatcattcaacaccatggctttattctttatttcatatatgcaagtactaaagatcgacatttacacccatttgtgtgttcgccgcagtagtatgtgaatatccgcgaattataagttgatctagataatatggtcaatcacatatgtccttagtatatatcgacggcatataatgtaaaacaaaattgggatcggagcattaatcaattatatgtttgtctatttgatactcctctattatatgattattctcttttaggcaagattaaggataacaataaaagactagaatatggttatgagatgtgattacgattattctcttttgggcaatattaaggatagcaagaaaagactagaacatccttactcgatgtgattttggttgtaggtgagttggtagttggggttaaaataagtagaaatttgaattggagttgatggatatgtgacaaatactataccaaattcacttatactttgggtcaagtagaaatggacacatctttgtactatggaacggagtgagtaatagcattaccaatagattagcaataatctatccgtaaaattttttgaagttataagatgaagcctaaattcaattccaacaactaaaatgagccttgttaaacttccaactaaactaaaattttcgtttctttccttacacgacgcactccctgtcccgatgccagtggcccgggaagtatatgatgaaagaggagaaataaaggaggaatgtgctagcaatgaagtagaggatagaagcggcgaagaaaaggagggacatgccagaaatagagttggagcctcccctcaaattaaggaaatgaaaaaattaaaatgctaactcaacatcatgtacagggctatatgggatatgttagatctgattgtttgactaaaatatctcataatcagttttgggaaggatttgagaatatactgttggtgatgctctaattgctagagccatgtatttcgtgtcataaaaatatcttggttaattgtttttctctaatatctcatgctgacctttaatcactccataataactatgatttagaaggctttaatcactccataataactatgatttagaaggcaaaggttcaaaagctctaaatttatcacgcagataacaaatataacatgtatggtattgatattatatagagaagtgcggtagggcatgcaattatcatggtatcatatactatccttttgctatcattcctatataactattttcaacgactaagctgtggtggaatatcattcctatataaccattttcaacgactaagctgtggtggaatagaagttctcgttctcatgcttttctcctcactagtaattgtgcacatggaatgcacatttttataatatactttataaggacaatcacaatcaaaatttacaaactacctttattgaaacatatgtaatctgtttgactaaatttaaatttataagacatccttgcgaaacctataaaaagcaaaagtaatcatgttatcactacatagttattttaactttagaaacgcataaaaagggaccaaaacaattgatcaacctgctagtcccattgtacttcgtcaacattaatcttcatctactctgaggatattagctagtaccgtaatggcaacaaacagttctcaaattagataaatgtattcatcctattgtggaagtaaaacaaaaactacattatctggtatcataatacattagtacacttcgttacatggtttttacgcaccaatcaatcaataaagattatcacaagaacgataatctcatctaatatagaactctaaatattgggaagcaaacagtaataaaactatatatgtagttacatctaaccatattttatttaattgttaaagggaggcatcttgctgattcatcaccactgtaataattttgcccaaaataaaaggaaactaaatcacattttttcacaattttttttctcattttgtcgataattgaagatcggaagtagattttccatccacagacttttatttttgcaatagacaataattcgttgcacattatttgtaaaatgggacaagttctactatataagtacatttggatcactgctttgctgcttgtacatcctcattgagacacaatgcactacaccgagctttctttatggcctcttttcaaatgaccaggctacatcatgtatggagatcctgattgttgcaatatctgctgagaaaggcaaaagatagattagattatgcatcgcaatcaacatctaattccttcgagctaccaacgattaattcccagatttccaaatgattctcggaaagccttcaaactaaacaaataatttgcattaaatcacgtatcacatttgctggaaaaactagagaagtactttaatcatcttcctgtcatgagatgcatgtgcaatgctctaccgaaaatggaaatgaacaaaataagagcagatgtgctctgtaatttattctgaatttctggtggtagatgagttctttttaagctgcacaaatcttcagacagggtgggtggtttggccttgattgatcgtctcttcttaatctaaatgatgaactcttcggtgccagtgtcaaaatcttcatctccgccgtccttgaattcttcttgatcaggcaacaattttctgaaaaaaattgatagcaatttcattacttgttaccttctgcattgtgtaatctggtcctctttcaggtggtgaaactactatctttgtcagcaacatcagtgctgagctttgtgcctctactgtcccccgcaaacagattgtacttcttgacatcagaaggagtttattctcaaagaaaatacagattggttgtgctcaaatttaatcttgacatacttagcttctcctccacgtccttggcgttagaagagtgcacaacagagcccaggaagacggtgatgaggaagcgtgctacacatagaaaaataatttatgccctctttattcgcccatcaaggaagtagttcatggttgttcttgttcctgcaagagtttatggccatctacatcaggtcatcagaaaagtgaaataatatgatttccacagtgacaaaagattcaaaatttgtgcatgtttggacgaacatacaactacaggcagacttgaggagacgatgtttgtcacagacagactgataaatgctcatgcatactgtgatatcaaatcttggatgcagctatgtagctagcgacagtcccccgtgcttgttttcccaaaatgggttcagagattccatccaaactcacactgttaacttgaatcaattcttcacatccaaattattcttattgagtgtcaaatcacagcttctttggaaaataacactacattatattcctgatggctagatatgatgcatcaacttagagacaaccaactgaaccaagaaaccagaaaaacactgacctgaggtgagccgagtgaaaaagcttggtacgcactaagaagtcaattgatcgatgttgggacaatggggatcagatgatatgggattggaaacatgatttagggatgaactaacctgattttggcggtggaattcaggaccacctgtcggccgtcgtaacaaagctttgtcgtctccacgctccagggctacctggagcttggcggagctgcacgcagcgaggatcgaggggcggtgtcaaagggagtggtaaagcggacgcgtgggcatcgccatcaggtgtaatcacctgggcggaggagcggaatcggtgattacacttgatctgcgaatgaacggtagagatttaacatgttgaattgagatataggattggaaggggtgaacgcctcatttctatattaatacagatacgaattacgggcatagtacgaaaatttcccgaccattttaatatatcgttttccacaaaactaatacaacaataatatatttactgatgattggctgtaactctttgagcaaatgctggcattctattctattatcttaaaaaaatctttaccgatgatgaccatttctaaaaaattagcttttctaatttctgctagcatcgtattgaaattaccactaaatagctaaactcataatatatgaagatttttttgaatgtttctataaaattaataagaaaatgatatcatttttgaccgttttcatctctagctaacgggcaacattcccctcacctcataattatgccattacgtttacgcaccatacaaccatctacctaatagctagttgggctgaaccagcccattaatagctgaccacttgcctaatctaaacagaagtgaacaacccaattaagtagctaaacaatcacgacacaaaattttccgaactgttgagagaatcggaagtccagatcacctagcgcaactccgatgggaaacctgcagcgttttgctcctatctggacatcgtgtacgtgtggtcgatggtttggcccgctgtgtgtctccgatgactacatcatgaggtgggacgacaattcaccggaaaaaactggaactagaggactccacagttcggttgagcggattgaaccgactaagggtgtgtttggttaggcttttcaacctgcttttacttttgcaaaagccaaaagccaaccaaagggcctaaaagctgcagctgcttttgcccaaagctaacttttggtatagtataaatcaaaagcacctctaccccctactttcacctgcttttgggaaaaaaaattatccacctcaaccattacgaagaaaacggttcgataatctcgtctcatgtcatcccgcatccgcaccacgcgcagcaggtgggaggagaggcgcatctccggccggcgccgcccctgccctccggccggccggccacctcattccccgcccgacggcggcgccggccctgctccttcccgcccgacgccgccctttctcctccccgtccgacgccaaccccaccccttctcgccccttctcctcccggcgaggcgacctcccggcaacgcggcgaaacggcaaggcggcgacctcccggcgagacggcgagcttctcccccaccgcgccccctgactcccgtcgccggcctcctcccagcgcggcggaggtagaggagaggacaacgtccatctcgtcgtcctacgacctcgctgcttgctcgacgctggcaacacccgacgccgccctactcgtccccgctcggcgctgacgctgctcgtccccggccgatcgccgcctgtccttgttcggcgccgccctgctcgtccccgctcggcgccagcttgccttgggttgggacgcgcgaggagaggatggcgacgactccgccacctgttctctcatcccgtgctgcgatcaaccaaacggtcgtaagtgagagatgtttcccaaaaaccacaggtgatcaaccaaacgggttttttgactttctcgtagctgcttttccaaaagctgctgcgatcaaccaaacggtcgtaagtgagagatgtttccaaaagctaaagccgcaacacacactgtacctgaaatcagagaaatgcttgtggcgtgaggactcgaaccctggtctgcgcactgagaggatgagagcacttggctctagccatcctaccgctttttcacttgtgaagtagaggaaatatacattatatatatatatatatatatatatatatatatatatatatatatatatatatatatatatatatatatatatatatatatatattatagttattgaaccgcggttcaaccgacagttccctagtcagtccgtcgaaccggtgaaccgaggggttgtctgggtcactcaccggtccggttttctccaccaggcaatgcagcgagcgtattcctaatttacaactaggtagtagcatcaacccgcctgatggttcaaaccgagagagagaatgtaacctaccgttgggtatgcggttccatttcaatcaatttcagtaatcttttatattatatatataatcgctacaagaattgataaaaattgtgtcaggggtgggctggcaataatgttaattggctgagtcggatagcagacatggcactttgacacacaatatgattgagtgaaaaaattatattttagcattaattatcgacatgaataaaacaattttagcctactgaagagttttgggccactagggattcaacaaaacgattaataaagtataccatgaaaaccaacctaattataagaaatttgttgtgaacttgttgctaatttatccaaatgattatatgcctagctaattgatgagtatatttttagataatgaaatagaatcacgggatttgctcaattgacgagtataattatatattatttagataaattaagcttagtttatacatccttatattccttgcgtatagatcgtagtatccctgcatgtaggttattttgcaaaccagattcttgatttctaaccaatgtaagaaacaaagtagtttaatcgaaatttcatgtagtttggacggtttagctttttttttaatatgtcagacgtgaaaattccagctatttttagtgctcttaaaattatggagggatcttataggagagcctcagttatagttaataataattacagttcaaactacgaatatacgccacctcatacaaaatgtgcattttggataattttaatctattccagcattgttcttgttcctgaccttcatgaaatttttgatatgtagtacaactttaaggggaactacgacatcaaggtgatacagaatgctagcatgtacgctattcttcgcaccgggccatatatttgtggcgaatggaactatgggtacgactatatatgctcaatcttacacatttgtttgatagataagggattattgaatctaaatatgtttcctccactatctcataaaaacaaatcacttacaaaggaaaagaagttgaaacattgaaacaacttgtaactactacccataactataaaccatattatacatcttaaaatgttaacctattacgtatttataggaggcagtaacctaaccagtcatgccaatggcccatagctgcgctagcggatcatacagttttcaccctcttcctatgcacacattccacactgccagtaacctatttttctttcatgagagtgaagcagaagttgtttctgttctttcttgcccaccaactttgcgtgactgtgatgggctctcccatttcgtgcttcagctagtaggatgggcctcggacccacgggtggtcttgatgcaaaggcgcttagggatggcaatggggcggtgcggggccgggttggactagaacggccctcccccgaccctcgacttcacccaccgcccctggccccgactggagatgcggggccaaatcaggcaccgtctccaacacttccggggcccgcattgggtagcatctccatccaattagcaccaaaaatacaaggcaatcatcaattcggtaagagcaaatattgtacataccatcaaaaatagcatgaatgcttgaatagcatcacaaaaaaatcagcaaaaacacatattgatccatcattccatccatgaagcatgcatgaccacaactcccttgtggctcgccggccgcctcgccctcgctgtgcagtgcccgtgtgcctccccgcgcgccgcccgtgcgttgtcggcagaccggagtgagagggatactagagaggatgggagtcgggaggccggaggggaggggttaggaggcaaggagagagggcggaggccagaggggagaggaagtgaggggagagggcaactggcgacgacgagatcctgaggaatgcacggtgccggtgcgcggtgcgccctggcgccctgcgccacctccgcctgtgtggtgtgggcgccgcctccgcctatgtggtgtggagatggggagaaagaggataaggctagggttttgtttttatatctcagttgtttggagagaaaaaataactttttgtctctccgcccagggaagtagaataaagtaagatgtgcgggcatgccagttaaccacgtacacaaaaataaaatggacaaaggaaaatgtattttattataattctcaaggaattacgaaaatacaaaatccttagtcaaatgcgctccacagcccatcggtgaggtggatctgacttggcgattgtgttctcctagttcccggggtctcggaaaacacccggttaattactctcgcgggttaaacccgcgagacacctccgattaagctgcgctggtcgtcgtcgtcggtcttcgcttcacgttctcccatgcatgattgtgatggtagtgatgatgtagatttgtgtaggcgccggcagtagtccacggcctcatcggtccgtgcgtcggtgttggtgacgtcgccttcacatagactccgcccgccctgccgttcagcctcgtcggtggaggtaaagatggtgcttgtaatggagactagcatggcattggtcgtcggtagagatgccaagcttgtcgtcactggcgatagggtagcatcgcccttctagtctccacggcactggccgaccatcctcatggtacaagagttagccttctgatcgctgcagcacatagtattgagcggtttttaggggacgttaggggcgtagcctagcctgagaacgatgagacgcgttccaggaactaggtggctctcttgtatatgcgccgacaatcggagccaaaacccaaattatgttgggtcacctctgatcgtagtggcttgacttgggagtactgcgccgtcagtcttcgcttcatgttctcccatgcatgatagtgatggtggagtagatgtgtgtgggcgccgacagtggtccacggcttcgtcggtccgtgcgccggtgttggtgacgtagtcttcatatagactccgcctgccctgccgttcagcctcatcggtcttgaacaacgtgttggtgtatattgttgttgaagacatacatggaattgtgtagctaagatgactcgaccccatagcaattgcatcggaattagattataaaggtaggaatgatcaacacgaatgatagccgaattagtcatggctcgaaggtttagtacagagcagcatcaaatgagtatgaatttgctaactcaatttaacttctcaccatgtacggtagcatgcatgcacatcttgtttgcttgcttgtcatcatgtacagtagcatgcatatacatgcattcgtacagtgcgcatgcacaatacaagcatctgagtaatttcagcgcggcggctgcaaacgacgtgatggcctccggggaatgatgaccttgggatggcttggtcggcagctccacggcagcatagtgacgccggcagcgaagccgatgaagagcacgtgcggaaataggcagcgccggtgaggatgatattcaatagacgttggcggcgacccgcagaggctacaacgagcgtgggggacggagggcgtcaccggccgattagtagagtctcagtgggacatccctgcccaccaagggcgcatcatgacaggtgctggcaacaggggtccgacgatacccatcgcgacttgtggatgatatgttaacgacctccggatatcggcaactagcaccttggcgacctggcaatggccttctccggcgggcagcggatgatgacggggacaagctagcgttagctggcaacgcctcgccgtctatggatttgggcggctcagcggtgtccacggcaactccagcgagatggttcgggacgcagccagagctgatgacgccttgcgggcaccgagtagtggcgctccggccggcgttctcttcaagcagcaagacaatgtgtgtagaggatagcagctttgatgagggcgagcggaagtcgacgatgttgcggagaagaggccgcgaccggcaaggcgacgacgtccgatccagcatctcgacgacatcacatcgccaggtaaagacgtcgtgggatagaggttgcggccggcgaggcaaggacgtcgcggcagcaggtagatgtgtcaccggcgaccggcgtctccgacgagagggagcgacgcgatctccggctggcggtgcctccgacaagcggagaggacgctatatccagcgggccaggcagcaccggaaactctccatgtcgccatcttgtgcatgcatgctgatctgaacagaaagagaaggaaaacaaaagaaaactaagaagttaaactcgtggcgatggctgagtacgtgctccggcgatcgtctcctcctccgcgcgcctccttgccagacgccgaggcactgcggccaacgtcaccggccgccgagcgcacaagttcccgccggacgccgagatacggcagccgatgtcgccggccgcagagcacgcacgttcccgccggacgccgagatactccggcgaaaacgacgtgcgtgatggttcccgatgacgatgagcaacctgtgtccgctctccttgtccttgtgcttctctgtgtttctctcctgtgtctctatgtatgtctctctatggactactgccaaggctgggcacggcgcagcgcctgccggcggcggcggcgtgaactgcaggccctcggctcgtgcctctgtactctctccgctgtcccctttgcaaatgatatggcttagcattttatactagagaggagccggtgcatgcacagtcggcacagagcaatgcaaggaatgataggaacagctgccatgtttatttgcttcacttctatacatatccatcacgaagtttcctgttgattaatatagaaaaaggtgtgatacttttccatctcacaatgatactgtgatggtgtgtttccattaaacaacgatacgtttaaattctactatcaatgggatatatatttccattctgttatacgcatgctatttaccagcttgcagtggctagccaataattaacatgattctatgatttgcaccatcattcctccatatgtaacatttcttcttatcgatatccacatcctgctcactgtattttcctttcgaacctaccgcgtcggtgactcctttccgattaggcgtgatatggataaattgtttctttgtattcgtatacgcgttcgtgatgctcatggcgaggaatattcatccagatagctatcttgccttttaatttcctacgtttccatgcaaatcaactgccggcaaatcaccgtgattaacatcctctaatgacaatgctacagtggcatgtttccattcaaatgaaaacattcacacattttcctttcatctagccaaccacgaaattgtatcgatcaccctagctatatcaaaatgtcatgagtatataagtgcctctacaaggcactagagcagccgacggcacgtgtctcacaatattcatacgtatacgccaggttgtgccattagtgataattaatcaccgatttcattattatatcgctattcccgaaattaatactttcgcacacttcatttctttcatatctctactattataaaagttgatttgtatatgaaatagaatagtgtttaggtataatttggtatacatcctcttgtaaaataaaaatagttttttattatattgatttgtatatgaaatagaatagtgtttaggtataatttggtacacatcctcttgtaaaataaaaatattttctgaataataaatgaacaagcgatgaaacatgtagatagtaatctgtattccaccattacgttgattgaaaagtttgctattatataaacgagctcagtcattaactacccctcaaaagacatggatatggtgaacaattggatagacacggatatggttatgatctctaaaatatcatcatttataacaacggtcggttacctatcctaaaattgctcgtgtgcatccagaaaaaatttctcaatcggatatggttatgatcttcaaaatataatcatttataacaacggtcggttacccatcccgaaattgccttactcgtgtgcaccaaaatatcagcacgcttaacctcatagttctttggagatcggcttccggaaaagaagttgtacatttattcacatacacaaccatcaatatatttaacacaaccacgctcaaagaacatccattttgatcatatatttcacatccattcacatatttcaccagccaaactgagttaattggatcaaatatatatttagcaagtattaacatgatgaggaggaatcagactttaaggcaaaaatgagtttcaaattaaattttatgatactaaatgaactcatatgaaaaagctgtcaaaaacaaagttgtagaactcattgagatctaccaattttattttggtcatttctacatccggatttgattgaactatataaagtttgaattttaaaagataagaaattcaaataaatttttcaggtagaaaatgattcaaatggaaaagttgtcaacaacagagttgtataacttatcaaaatccataacttttattttgttcatttttctatataacattttttgaacagtttgaatttgaatttaaaaatatgacagcttcaaacaacattttcaaatactaaatgattccaaattgaaaagtcatcaacaacaaagttgtataacttatcaagatttacaactttattttgttcatttttctatatattattttttgaacagtttgaatttaaatttgaaaatatgaaaacttcaaacaacattttcaaatactaaatgatttcaattggaaaagtcatcaacaacaaatttgtataactcatcaagatctataacttttgttttggtcatttcttcatccgacaaagtgatagtaaaattattcacagaattcacatatctctcatctgaccttccctcccgccaccgcctacctctgctaccggccagatgtggcggagggcgccaccgcctctcataccgagcggatctggcggaggggaggcgccgccgccgactgcaccgccaggccaccgccgatgcgtacgagagatgaggaggagaagaggagataagagagcgtcggtgtgtgtgtgtgagagagagagagagcatcggttgatgcatggataagaacggcttaaaaaaaccatgcgagagagagcgtgtggtggctaggtcttatggggtgtcggacacctataatattttataggcggtgattttttttaaaaaaccggcacctattccttttaccacaaagatgtgggttgtaaggtgggccctgtgccaaccaaaagatgccggttttaaattaaaaccggcatctatctctgactggggtaaaatgtgtcggttttgtttaagaactggtgttcttgtggtttgggcaggcgcgtgggcagaaagggactataggtggcggttttacatcttccgccacctatagtgccgacttctattagcatttatgtggtagtgcttgattgtcaaaaaaaaattgagaattgcttagtaattccagcagcaaaacgtggggaattacctagtatataatgatactaagcacactatattagtattactttaagaaaagaattgtgaactgtgctatctatttataacttgtataacctatctctctaagtaaaaggtaaaacttaaaatgcaacatcattaaaccacatcatttgaaaatatggaccattggatgcaacagttgatacaatatctgacattagatcataaataagtatcagtaaaagtggtgaaaagtccaagattgttcaagaaacttccatgagctgtttgagcaatagtcaatgtcctaccactttggcatcttatccgaaacaattctcatacctattggttaagtctaaacttagtacaagaatatataca

SEQ ID NO: 4237 - DNA, 4620 bp, Oryza sativa
aactaaaataagaatatatttctagtccgtttccatcatactaaagcttttacacattcccacctaagggttacattctagattcatcactaggtggccgatgtccgggtagcttctgacgcagtggtcagcgcgcatgcagaggttgtttaggttgccggtgtagaagcagatggcgccaaatataggggagatcgaccgccaggctaagccacatgctctacgacagcacgtactgcacggagagcatccccatgccggctgccatcacgttgctcagattgaagcagctcttcctaaaggaagcgccagtgatccaccagtagggtggaggggcggcggctgctccacgtcgtaaaccacctcatcgagtcgtagatatatttgctaatattatttagtaccattttttttcttattactatttataatcttgctcgcaccgtttagatgttagtattaaattcagtgttattatttgctccttctaattatggctacctggtttactccactatctcatacaaacaaatcacgtaaaatggaacagaagttgagatatcgaaagaacttgtacactaataactatataaaccatattatacctcttaaatgttaacccattacgtatttatgggaggcagtaacctacccagtcatataacggcgctagcggatcatacagttttcaccctctttctatgcacacattccacacttgccagcaacatatttttctttcaagagagaagttgtttgagttcttgccccccaactttgcgtgaggttctctgatgggctctcctgtaactgtttctcggctagcaggatgggcctcggggccacggcccaccgtcggtcctgacgcaaaggcgctgagatggtattagtactaggattttcttttgttttcatatttctttaataaaatgtttacaaaatataatggctttaaaattagacgtgactacacagctagtggtagctggtttgtctaaaccagctaccactccatataagagagatactatccacttatactttaaatacaattttctcttaaactactaatccgatctacgatccgattgcaccgttatattcgtaacaattaaatgtttataacaagatcttacatgattatattttaatgaaaaattataaattacttttatcatatatctaaattacttttagatttcactaaattacttcttagacatataaaagtaaattcaataaagcctaaaagtaatttacatatattatagaagtaacttatgacaaaaagaaaataactttaatgaatgccttttttcattggacatgtagtcatatttttattcctataacgaatttacttttaacgtcgtgacaaagttacttccaagttgttttaagttacttttataatatatgtaaattacttttagattttattgaatttacttttatatgtctaagaagtaatttagttaaatctaaaagtaacttatatatatatatgataaaagtaacttacgtatataataaaagtaatttataaatataaatattttttcatcataatataatcattatatgtccaaaatggccaaccctgatgggcgatcatcaccatgcgtcaaagattgtatactacttcgtgtaaaacgctgtctgaaagaggatttttcccaatgtgtgttagggggtataaggccgcatttgttacacggtgttgagagcttatttctcatttctcacgcacgcaaaatgttacgacacattagcgtatgattaattaagctttcgctatttttttaaaaaaattgcttatatgattttttaaagcaatttttttacatataacttttgaaaaacacaccgtttagcagtaagagatgtttatgtgcagaaaacgaggaaggtgagttgggaaagttagaaaaaacaccgcctaaatctatagaagatgaaaacaaatttaaaaaacattttaaaaaaataataaaaagttgtagtactagctggtagcacacggagcatacacatatgcacggcgtggtggtcaacctctaacagcactacacctacactcactcgcgtacagaacatcgtcgcgcgagcgtgacccttttgcccgaaattacctcgcctttgccatcgcccaagtacgctagcacacgcaccgcaccacgtcaagttttaaaactcatggagtgggtgcatttaaaactcatacttcctccgtcccaaaatataaagagttttagttgaaaaatataattggttagaatggatatatcccagtactagaaatatggacagactgcatgtccaaatttgtggtactaagatatgtcctatccaaccaaaactcttcatgttcttataacaaactaaattaaaatataattattaatttgtaaaaagttgaattgaatgcttgacaaggaagtgttatctatgcttcctataaagttaaagtccactaagtctaaggctcaacatgcaatcatgtcacattatcacccactaacaataattacatatttaatctcatgcaagcatacaacatgatctataagtttggtgacctatgctatctatttataacatgtctaaattatccctctaagtaaaaggtaaaacttaaaacgcaacatcattaagccacatcatttgaaaatatggaccattggatgcgacagttgataaaatatctgatattagatcatagataagtatcagtaaaagatagtgaaaggtccaagattgttcaataaactttcataagctgtttgaccaatagtcaatatcctacactttggtatattatccctaacaattctcatacctactggcctattaagtcgtgcatttgcacgactctaacaatcacggtatatgtgatgcgtatgaaaatttattagatgagccaagtatacacagtcaaaatttataggctgtagcgttgggattgggccatcaaaattggcctattatctattttaaatatttcggcgcgacctgtcatttttgcgccagttgtattagattttgtcgaatttatttataaattatttgatcaaacagttacaggttgtcatttagtccataaatatgtgtcgatactccttcaacttgtaattggaaaggggaaaggtcatgacaaaacaaatgccacttccgagtgatctaagaaagaattttgtgtcctactttcaaggctgagtgccctgtttttgttaaaagtacaactccagggttttctaccaggttagcctgggaaagagagagaagcatcagagcatcgagatccctgatattctttttagtagtatcagtgacttttacctagtgaacagaaatctggcctctagctgtatcagtgattagttcatcacagaatcaaagatacatcaaaatccagagtactgaaagcccaggattatctgcaaattaaaagaagaaaaacaggatgataccttctccattaattaaaattcacgggaaatttgcttgctggctttatcagtaggtttgcaattgcaacaatacgtaccaatgtattagcctggaagatgcctgggtgagagggcgcaggatgtgcagctactatgatttcttcgacgccaacctctccgaggctccgagcctcatggttgctgttatggatcggcgaacgattgccacataccacggcagggcggaactagaacagaacgaaatagaggatggtgcttcttgcttaatttattctattttagatcaagttcaatttaatgcgtgtgtctaagtttgtattgagaaggttacacacatagtgaaaatcaccatatcgatgagttataacttaaaaaaaaattttgatcgggttgctggacacccctgcccatatgctacctccgcccctgcaccacgggacgtacagcaccacagccgtcacgtggatgtggatccggttccacatcgccaagccccatggcttctgcttgtcaccatttccatattctgttgcagttgccagtggatttgtatatgagggcaagtggccggcggcgagcagaacgcctccaccacgtaggcggcaacagagagaaagaagagggagaactcgggcggaacggaggagtggtggtgtaccatgttttgtagtagtgcttagagcattcccagcagctcattcatattcaatcctccatatgcctatttggatagtcctccaaaaggattctcactccatatttctttttactccaacaaatcattcatattacattatctatcctatattttactattatctttcaactgccatctattttatattaatttttctcttctattcattccattctttctcaactcttctcctctcatctactcttttctcaactcttctcctctctcgccgaatcccctttacctccaccacccaccaccggcgcatgggctccgacctacgcccgccagagcaccaagtggcggggaactacgcgtccaccgataagttgggcccgctcgtcccgcgcgtctacaagatcctccaggccggggagcgcggggagcacgaggccgccttcttcccgggagggggaggggaaggcggtggaggtggggaggcggggaggggga

SEQ ID NO: 4238 - DNA, 5268 bp, Oryza sativa
agatcgccatgcggaggagcggcgtcgcagccagatccgctgcctctacgcactctactccgtggcggcggacgaccggaggcaggtgggcgaggggcggcgacggacgactggaggcgggtggaggagccgcggaggaggcaggtgtcggcgagcggcgggcggtgtcgggcgaccagcggggacggcggcgcggccggccagatccagtaagtctcctcccctctgctccgttggccgacggcggtcggtcggcgaaggtagccaccagtgcgtcctctcttttcctcttccttcaccctttatgctcgatccggatgggggcgggagaaccggatgggagcgggcgtttggggatggcgtgaggagagagaaacgccaaatttgacacttctctcttcgtgtttggcgatccgccaattttggcgcatcggatggagcctctgctggagcgttgtttttcccctccatgcgccaaaaacgggatggaggaccggatagaggagctgctggggatgctcttatatctcactattatccttgctttaagactgtgttcgttccctctcttttccaacctcccctcacttgtttttcacgcatacgtttttcaaagtgctagatggtatgttttttttgctaaaaattttttttgtatgaaagttactttaaaaaaatcatattaatatattttttcaaattttttagttaataagtaattaattatgcgttaatgagttgcttcgtttttcacgccggaggattagttcccaaagttaaagaaccgaatacagcattaagaagttctgcgaacaacattcgagaagattccaaatgacgagagattgagattatccgatggcctgtaatgtttgaagtaaacatcggacggctaatgctcattttctaatccgacggtctttattattttgattgcgtggagcatgctggtagcttggtgggatttacctttcatgaaagtagattggttaagactaacttagtacaataatatatacaacacaatagttctctattttaactcggcatagaaaagtttatgatgcaacacatctttcaaatttagatacacaaccttttaatttcactaaaattgtattggactatgtataaaattacttaaaaaacaaatttcataaactttgttttcaaatggctaatataattctttcatttaagtgttagacgcatcttctaagttcaggtttaacatataaattaatccataataggcggctcatgattagctttatctttaagctacaatgcttttaaatgggtggattagaggtaaccatatagttgagaggtgaccttcatcgccttcagtcacctgttcatcctgctggggtgataggctatactgtggcacattacgcctccatgtcactacacatgttaaactagtcgaaaggccaaccaggcattacccttgccattaatttacgtcataatgcaaaaaaaaatattaatgctaaaatctgaatattgcacttgccattaattccatattgcactcgccattccgtatcattgtaaattaacattacaaaatttataaaatttataagtagtacaacatttttttaagggatggtacaacttattttaataaatgattttaatgttgatttcgtatgatcctaattcttacttttaattagacgatcaaaataaacttattagcttaaactttatctgcacaatctatatagatgggagcgccaacaaaacatatgatatgaggccatgcaatggtgagtataatgggaacatagcagcgatgatgattaagaggtgtgcgagtatagtgtgcatgattagtgatgtacgaaatctaaaaagtaattatgagtgtgcgcgtcttccatgcatccatataataaaaaaaatatgtttgtatccttactaaacctgttgctaacttaattccaccattgacttttcaattttcattaaccataattctaaatttacattgttaattgttatcacaaattttagcaaacttactatcaacaacacataaatacattttaaaaggtgtaccttggcaaaattcttattagacatcatcgaggagtacatggtcgggaagacgccatggccggcgaagcagacgaagtagaggctgagggaccctctcaggttaagaggcagttgccctctatgtcgaagcccttatcggacatgccgacccaaaccagcgatgtcgtaacgccaccgacgagatgagcctgaccgccaagacataggcgagcatgctgaggtaattgagccacgtcgtcgggaggatgacggcacccgcagcgagcatgaacaactgcttcccgtacacatctggtaccgtaggatctccaccacgtgctagggagtagcttgtcgaggatgtcgccctccaggatgaggaagctgatggcaaggaggtagagcttgatgtacatgacaaggccgatggttatctggctgtagccgccaaaggcgaggtggtcacagtgggagatccacggttggggctggttggggcaccagccccacctccaattcatgcacctaattagccattaacatatacgaggccgatggctattttgctgtagccgtcgaaggcgaggtggccacagtgggagatctgttgggctggttagggcgccagccccacctccgattcatgcacctaattagccattaattagtgaaaaactggtttggggcaaggcaagctacctcactgtctaaagcagaccataccagtagtactgtgcaagacaaggcaatatagattttattcgtagatcactcacgatcatacctatttattcatggatcttttaggatattttatatagcaacaaaagtttttcccactgcgtcgctggatctaggcgggaggaggcaagccgtcatcgtgggaaaaggccctcccaccaccgctgcttccgccgccgtccggtcctgctatcggagctgggtgggaggaggcccgccgccactggatctaggcaggaggaggtgagctgccgtccactcccaccgccgtcgccagatatgcaagggaggaggtgagccgccgtcctctcccaccaccgctgctcccgtcgccgagccgtcgaccactcctgccgccgtcgccagatgtgggcgggaggaggtgagccgtcgttcgctcccaccgccactgctcccatcgccgagccaccgaccgctcccgccgccatcaccagatatgggcaggaggaggcccgccgcatggcatcaaccgctgctgccgcctcgtcggtggcggcggcgtcgggggggatggaaccgatcgcctcctcctcgtcgtcgtcggtggcggtgaggaaggggatgacggtggcactgctgaccgcccatcgccgcccactcggagggagagagatagagagattgaggagaggattttgagaggagaggaagagaggagtggaggagaggattgaaaatatgttgagaggagatgggtgaaaaaaattgaagtggtgaggagggaaagagagaggatgggagaaaaaaaaggagatatttttgtatgcggatcacttaaggcatcgtatacgaaaatgtatttttgcatgtggttaagggaccgcatgccaaaataggagcttttaactatttgccacttttagatttggcatttaactatttgccacctctatcttaatgacatttgggtccagtggcaaatagttatttgccacatctaaaagtagtaaacagttaaatatctcgtaaaaataggtttattttcacttgcgtctaggttcgtttgtgaaaatcgattttcgaatgcgggcatcttactaaaccgtatatgaatttgaaggctgatttttatagacgtggacaattatgatccgtctgcagcctaaccagggtcctcaaaaaatttcttatgtagtagcacctgccttaggccggcgcatacggcacggagagcatgcaataactgagatcacgttgctgaggctgaggcacatgtcaggttgctgaggttaaggcagcttatacatgcagaacgacctgctgccggtagggaggacgagagctgctcctgctccaacatcgttgtaaaccacctcatcgtgccattcttgctagtattaatatcaatcattttcctgttactatttactcccttgctcgcactgtttagagcatataaaaaaaaggtccaatcagattcccaaaagagataaaaaaagttccaatcagattcggaatttagcgaaaacccatacatccaacatatacaacaagctaataaatagcgttggtagcacccactatagcgcggacctctaccgctaccgctacgaggtagcagactgaagatagcatgttgtaacttagcgcccgctatagcatttcgctactgctataacagcctgttatagcgtttcgtgtccgctataacagcccgctattgactttgttggaccattgtaacgcttaaatgttgttcttcatatatggattgtagaactttacattgtttatcttatttatcttataaatctatatgtgatttcatatttttttttatgttatgaaatataggagtaattaaaaatgtattattaattctaatttttacgtgaaatttatgttaatattgatatatttatggctattttcttatatttgctatcggaacttagcgcccgctatccgcaacactctacacagacgctaatccactaacaacccgctatacgctactatttattaggacatggatacacagaaaccagctaccactccatctattaaagatactatctacctatacttcaaataaacttttctcttaaactactcatctgatatacgatccgattacaccgttgtgttcgtaacaattaaatctttatgacaagttctcacatgattatattttgatgaaaaattataaattacttttataatatatctaaattacttttaaatttcactaaattacttcttggactaaaaaagtaattcaataaagcctaaaagttattccatcaatgttatttacaatccatgaaaggttttatcttctttttattaaacggatttacagagagttacttctcaaccatgcaaaagttacttctaattaacattgaagttacttttaaaaaatgttaaacttacttgtgttaatctgtactgattaaatttaatttcgagataaaatcatatttttatccctacaatgaatttacttctaatatc

SEQ ID NO: 4239 - DNA, 2125 bp, Oryza sativa
ttctggtttatccactccacatattatatctcatatttttgaaaattgtattgtaagggttgataaaaaaaaccaaaaaacacatcctcgtaggatcatatgctttatgttggaccgtatggttgagcaaaaatgatatgatttttgataaaacatcatctaaatcttattttagatgcatttcagggcaacatattggtttcgatcacgtgctcatgtataaaagtgtgatgaagacactaaggctgtgttcccctcctccccgacacgcaaaacgaagctcgtattattgcatgattaattaattattaactatttttttgaaaaatagattaatatggttttttaaaacaactttcgtataaaaagtttttgcataaatcacaccgtttagcagtttgaaaagcgtgtgtgcggaaaacgagagaagtgggttgggaaaatgggggaagaacacggcctaagagcaggtacaatagcagactatttactagctgcaataaaagatgagagagaaaagcagcggactatagatctgtagccagctatagcacggactataagacacaatgtgtgtatgacaggtgggaccatatactaatagtatagtaagcaattattgtatgaattagctatttgattggctatagatgaattggatctagtagtgggctatactattaaacttgctctaaggctttgttcgttgcccctagttcccaattcacccatctagttttccgcgcgcacgcttttcaagctgctaaacggtgtgtatttttgcaaaaagtttctatacgaaagttgcttaaaaaaatcatattgatctatttttttaaaaaaattagctaatatttaatgaattacgcacaaatggaccgctccgtttttcatgcggggacatgggttgggggttcccaagccagactgccgaacaaagcctaagttaataaaagttgcatgtcataaaatggagtcaatggctatgcaactattcacaaataggattcaataagtttgtgttttatttttctattggtgttagtaccagtgtgcacctctatcggcttggatgcgttctttatgtctttttgtgaggtgtgattgtgtgtagaatttttttaataattggttatagctctgtgagcaaaatcaagaattctattctattattaaaaaaactagcatggtggcccgtgcagattgcgcggctagcatcattatatcttctcgcatatatgttttctcattatattattcaaacatattaaagtcacaacatatttttaaattttgcaaaaactttacaaaactactaatgtgtaatattcatattatattttatgtacgcgttatttattaattatttttaatatcaaattttagttatttgtaaattatatatattccaatatggactctagactcgtattataatatttctttttttaattccgaattttttctgtaaattgtatttctatatagactctgtgctctttttccagtattacttatttttatttctgaatttttattatttctaattgtatttctttgtggactctaaactcatcttttaatattctttaatttttaatttcgaatttcagttctttctaaattgtattcctatattgaccataaactcttcgtcccatgtttttcttaatttcgaattttagttatttttcaattgtatttttatacgtactctaaactctacttttaattttactatgtttatttcaaattttagttagtttgaaattcctatatggactctatactctacttctaatattctttattttttttaattctgaatttctattttttttcttaattgtatttttatatggactctatactctacttctaatatttcttatttttaatttcgaatttcagttatttcctaattgtatttctatatggactgggtactctacttctaatattccttatttttagatccaaatttcagttatttcctaattgtatttctatatggactctagtctcctcttctaatattccttattctttaattccgaatttcatctatttctaaattatatttctatatggactctgccttttctttttctacgattaatgtgag

SEQ ID NO: 4240 - DNA, 10485 bp, Oryza sativa
aagctttggctatccgctgtgcgttgcgcacggcgatggatgaaggtcaccagaaaattgttttggtttcagattgcctagctatcatccaaaagattcagtctggagcacgtgaccgttcaatggttggcgctcttgtctctgacataaacttcctggcggctggttttttggattgctctttcattcatgttaatcgtgtaactaatgctgcggctcaccttttagctcaatgttctgagcaaacagtttgtaatacctaccgttctgtaatcccagagactcttcgggaggtactgctgtctgatcttaattaatctatgagaagctgcattatctcaaaaaaaaaaccttttgattttggcccaacgcaacacgttttccaaaagtgacaaccatgatcactacaacgcttcagattcattcacagatagtatgccaacacatggatggagactgccgctagaaagcatcgctatattggcggaaggaactacggatcggttcctgatccatgacaataaaaacagggcggtcaactatttcagttgactgcccacgaaacatcaaagttgaaaagaaaaaacatcaggtaacggaaacatcaacttagtacaacggaacaaagctagatatttttacaacgggaagaaaaaaatgatttcctttacaacggagtatacaaacaataacaacgaaaagaacagaacaagtaaaagatattactacgaacacagccatcgaaatccttatttctgcaacactgaaacattgttactgcggttattgcaacatcaaaatcgaattagtgcaacatgaaaaataatcgattacaacattgtgaagcaaattgcttctgtaggttaggactgtcattataaacaatccaatcatcccaggaagaaacacaaatccaagaaaaagcaatggccacgctgggcaccaccaacaactccacttctcaccgttggtcatagactcatagggcgcttagagctcgccgcgctgcacgagcagtatcaccacccggatgtgatgcagtcacggccggcagaaacaactggtacaaaggatgcggatatggcactgtggccggcgatgcccaccaccaccaactcctgcagacgctatgcaacaccactgcagctacgcgttcgccgccgctgcagccacgcatcgcctccgccgccgcatctcaacatttattttgcatgtctgtatggcaacagctaataaaatgcagaaatcatctctctcgtttaactagcaaaatgaagcactagcgacgaattgcccccacacgcatcttctcctccgttttctattccgtgctgagaatcaaggcatggatgcatgataggatggcggaaaatggatgggtgcaactactcgactgtgtttctcccttataaataatagagtaatagagtattatccatgacaaacatttcatattatctatgatagagtaatagagtattatccatgataaccatgcatattatctatgatagagtaatagagtaagaagttgccttcgtgcagagccatgttgctctttttttagattagttaatattttttctcaattgtagccaatattttattacgaataattccgctagaaattttggttctttcttatttttcttattacctattacaatatacccatgaaaagtgccttctccaacatttattgcccaagcggagagcggacggctttcgtggaaccatggagggagtctcaatcgatcttttctaagattccaactcacatcacgcgtgaagattaacattgatatgatttatatccttagttttgtgttccgtatgttctgtgttcgctgaggtcaagtgtgctgtgaaatttagcgagaggttcgtgccgtgatgggccctagctggtttgccacttttgcaatgctcctcggagaagagaccagatggtgataggccagttaggcctgaccagcacaactgggtataaaaacatggaataaggtcactttcgatctctcaatttgtcatttagtctgaaattcatccatgaaccaaaatactagatatagctaattgcccaactcacaataccatgttaaatttggtccctcggtagtatagtcatcggtttttgctgacgtggcgagtgggaccactactatgaaatatcaaataggtatcagcactataggtgccggaagtgctaaaaccgatatctataaaccttttcccactaccgcgggttgaaatcgcaaaaaacatgcacctttaaacaattataggtgccggttctaaataagaaccaacacatattctataggtgccgaaaaaccgacacccatagaaatcgagccgagccggcaggccccaccacaacgagtagataaggtgggtctcgcatctctctctcgtctcctcccttctctctcgctctcttctcctcctctccaactcccagtctcccacctctctctctctgaggaagcggcgggctagccgcggggaggcatctaccggcagcgggctcgcggaggggatgcgacggaggactcgctggcgggaggcggtgttctagccatggggaggagccctcctctccgccatatctggtgggaggggaggcggcggcaggggcagcgggctcactgggggtaggtggcgtcaggcgcgcgggctcgatgaggggaggcagcggagggctcaccggcgagagacggtgatcttccgcggggaggagccctcccctccgccagatctggcgggaggggaggcagcggcaggggcggcgggctcgccgggggtaggtggcggcaggcagtgggcttgcggaggagacgcggcgatgggctcgccggaaggaggcggcgggcccgcggaggagacacggcggtgggctcgccggtgggaggtggcaggctcaccggtgggagtcagcgggctcgtcgacgggaggtggcgcgacggctcgaagacgaccgaccgtgcgacggcaacgatggcggatcttaagaggtgtgattcttttttttattgcataaatttgagtgccaaaatttgtgttgtggatgaatgttggatgaatgttgtgtctctagatggacgaccgtacatttccatgaattcatcttctagctatcatttgccatgcttgtattagtgcatctttaagggtacgtacgtattaatctttatcaagtacgtcccctgtcttcttcttctggatattttattttctttgcacgttgggtaatctcgtcatttggaataaaatatcacctcttttgatccggaaattataaaatattgtcttcggtgtcctacagttaattacataatttttagagtgtccatcagccgtgtcatgtttttgcgttgtctctcagccaattacacattttttttagtgtcttgtagtaaattttgcatttcggtttagggatgaatttcaaactcagcgataaatagaaggatctaaagtgaacttttccttaaaacggaccttgtagaaccggaagttttgtatcctgcttgctcggcccatctacagatggaatacggccgtagcccgttagaggtaagaatttttttcgtttttagatttttttttaatatttatagaaataatctatcgaccaaaaaaattgcagaaatagcccctgccgccctaatggtgggcggcaagctgacgtggcagacggtgggtcgaccgcgccatctgccgccgtcggccaaaattgcgattaggcccttgccgcccatacagagggcggcaaggggctaattgcaattttggccgcccataaagagcttgcggccgtactttttcatctgggtctcttgccgccccaatagagggcggcaagggacccagatgaaaaaagtacggctaaaagatttttctatgttatgttaataataaataaagaagtatttattggtaaaacttgttaatattgttataaaaacgtattgaagttggttgttgctcaatttcatatgttaagtgaggtattattttgtaccttattcgacgtattagtactcggataatttatataggcctatcgcagtctgggtcgtagaaacattatatagacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaacatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacggaatgaataagcatatgcagataataaaatacctcacggtcatagttagggcacctaaaacagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagcccgtcggatttgtaatgaagcaagtggggaagagagtactgaatgtgactgagttctgaaagattgtgaggcctcactcgttaaggcgacttatataggtgcaaaaaatcaagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacaatactggaaagtgaagcaagtaaacaaagagaagactgctctactggccctgccccgcgccgcgaccacgcttggtcctccgggcctgtgctcgcacgtggtcctgggagtaggtgaaacgatccggtagcacagcacgggtagcacgagtgtcccgcggaggagtggcctgcgcctggtcctgtgtctgcaccggcggtgcgcctcccagctgtgaggggccaatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcttgtgacgaagtcccggtgtactgccagaactgcgctgagtgcgaggttgacacagctgcctgagacgctgaccctgcagcctaggagaagtgggcggcctgcgtcatagcgaaccgtcctacacatcgacaacaggacccttgtaagctaagacataaaatgtatgtaaattgattgtcgaagtaatgttgtttttttaagtacctgtggggggcacaacagaaggcctagctgagaaaggcggggtgctgaacggtgcacgaaaccctgaagcaatcggcaagtgaaacggctcacttatatgtgcgaggcatgtacagaaatagtaataaaaatacttacctccgtgcggagggggagtcagcctaggaacgtgcgcagctggacggggaccagtcggtacgggtggccgctgtacagctgcatgtgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgatgacccggttgatgtcgtcgacctacatagttaatttgttcgtaaatattcgtaaaatttgacgaagagaaagacatgaaaacataaaggaatggtgcgatgcagggtactcacagcacgagcgaagtcctggtcgtggtgcctggcatagaggtctctagtgctcgcaacgtggggctgctgctccaagggagcgaaggtgaccctactacgggtgcgtggctggtaccagcgtaggtaggcctggtacgactcctcagtgtgtggctctccctcgtggtccacgacctcctcggttgtgagcaaccagtactcaacaaaagtcgccaacttggcgggccaggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacacggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacaacgtcagtcggcagaaggcggtcgaactccataacaaactcaggatacgactgcctaacctggacgtgagcccatcggcgctgcaatatgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtctacctcagggcggccgatcgcaatcctctcagctgcccagataaaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcagcgatgctcctggcgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgctaacggctcgagcgggaggtgcggtgcgcgctgtactagtgcgaaacgtgccatcagattgtcctgccagtccacagccgtggtcactggcccaacagcgtctctcgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtacgaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtaccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagatcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagtctccgactcgtccatatcattgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttggttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgtcaaatttgttgtcataattccatatctagcaccacctatgtcatacgccttgccccatttctcttttggttcatgcagaatccactgagaaaatttccgaatctccaatccagtttttctaaccaatgttggactatccgttgggagaggtccaagagcttgaggaggctcagcaacggcggtcgatggagccgctgcacgctgatcactgcatttggctgtcaactcatctaatctcttccaaagctcattgaattttttctcctggttttgattgcacagcctcttgaacatgttcatgagctctttgttcttgaattgcttgaagaaattagctcccatatgacgcatgcaccacctactctgtacatcttcccaaacaccggggtatactcgttccatactcccaaactgcaactcttctatcgctcgcagaatgccagcgtgcctatcatgtatcaggcacacatttggcctcataccaacaacttttgttttaaccaatttcaggagccagtaccagctgtcggtattctcactctcaacagaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttcaaaatctcatctctattattttctgtttggccctccagaccttggcatagctaatagtatacttgta

SEQ ID NO: 4241 - DNA, 6604 bp, Oryza sativa
tttttttctcttctccgcattatatttcacttaaggataatgttttcttttcgcaaaatttaaaataagatgtaggtagcgaaaggagtttcgctattttagaaaatatcaaaagctttcgtgcaaaacgtgtagagctaatccatacgtgtctagcatgcacatgcccctaattaagagcgtttacagtgcatccacacaaaaaccgaacctgggatgccatattggatggaactctacaaagcaactcaacccatagtgcaagctaattataatgggccccaccaacatacactttttcatcttccctgtctttcctcattacctttttaaaaatcctaacacatcccctccgtaaccgattcctctcctctcatatcccagcgaccacgtcagtgcctccctcccctacccacctcggtgatggcggatatggaacttgacgacagcgaacatggatagtggcggtgatgggattggcgctcgacggcggcagtggacttggcctcccctcttctcgctcgccgccgccgcctcttctgcgtcttcctcgcggaggtcaccgccgactggagctgcgcgactcaccggatctggcccggcgcggcactgacaaggctcgccagatctgatggcggtggcttgtcggggagcagcacagcgcggtggtggcgagtctcgacgacggcgtggccaagctcgacaaatccagtggtgatggctcatcggggcgcgacgtgaggatggtcatggccatggcttcgtcgtcgccgccgtggttgccaccgcgctgccctcctcgcctacgccggcgagcccctcccctctttaccatcgtattctcctctctctctctctcccttgcttcctgctgcgcgtaaagacccactccctcacttttcctaacgaagttgatgaggtccctggtaccaaaagagtgcacgagaaccccatgaaaacatggtccccatccctttctcttctccacgcaaccaattcatctacgtggctagtcggagctgaatgacacatcggagctttgtgaatggcctaataacccatgcccggacgtccatatcagacaccaagctaggcaacacacaacgccatataaacaagcacgtgcccagtcgcccataccaaacacggaaacgcccgataaatagtgcgatgacagtccaaacacaaactccttttcctctagtccaatcaggaagcaccgctgaaaaaaaaaacagcgtgacagtcaatcgaggataaaaaatttcaataaaggagaaagacggtggggacagggatattattaaccgatgatacatgatcgtgctggcaaatcttattcgagcggtacaaagattcattcttaggccctctcgttcgatggtaaactgataatgatacattttagggagttgatagttcgttgatgcacattttgttgggcatatttgttttcatcgtcagatacgcccccaactttgctccaaaaggcatgctcgctacaatcggcggaagatggcaagtgataatttgcattgctcggagagattttcaattgacagtatttctggagctatcgacaaagacatcatgtattttaacatcactcaacagctagataaatatcattcacacctgtaacagcgcacgaaattaccctgaagaattgcaagttaggccaatagcaaccaataactttctgctacctgcaaaactgccaaatttgccaaaataacatcgaaaaagaaacgcgaaaagagtaagctaaaaatggcgcgagaatctcctcttcctcttcgtccttggtctataagcacactcgataagcttagccacatcgagcaattcttgtagtaatcctgcagaaagagtatacaaggaatccaagaaacctgcaagcatctatctagccatggccgccgcgagagcgggcaacgccgtccggttaaccttcgccgaggaggcggcgccgccggtggcagctacttcgccgggccgccgctcgctgcctcgaccccattgccggggagaccgacggcgacgacgacgtcccttgcagccggtccaactgcgtctcctgcagctgggttatcgtctgaggacagttcagttttctcgggcgtttcttgatatgttcttttcaggtttaatcagcgagttttatgggagtttgatgagtagaaaaaagagggggcttaattagcgtgttctatggctggattaactaatcctcgatccaaattcttcatctaccaactcttctaaatcaatcataatttttctctattgaattccacatactttcttaaccatgtccaagagttttaggagatattagcaaataactagcttttatctcccctgttgctactcgaatttgaagtaagctttaattaacttatcggttttgagcgaatcagcgagtcgtactactctggtagatagataatcttctagtacctatgtaatgcgaactgttaagttataaatctttccctttttttgagaaagagaggatcacctctcccatttcaatacagaaatgagaataatactgtcagttattacaataccaaaaggaagaaccttctaccgtgatgcagcaaacaaccttctacatcatacatccaatctaacggtaagcaactatcagcggattccatacaacatcaagagacaaaaaaggcaagttaaatctacatgaatacatcaaatcaagtgggaattaattcttttgtttatgccatttcacattggattctaataagtacaattacttcagcacatgctacaagattgggtatacttaattacattaaggaacccagttaagacaacaaaaaaaaaaggacaaactggaagcatttcatctattaattataagttctacaatgatatacataaattcagctttccgtacagtggtttggctatatgaagactactaaaagaagctacgttcacaaagaaccaaatctgcacaaggtattcagctgccaacaatgtccatggcaagtcaacatctctgaaatctaactagtagctggccttattcagttctctgtggtatgtcttccaacctaatagaactgggacctatttttaggtgccaaaaatactccagaatgtccaaggtaccacagcaagcggtacattgaacaaaccaaataaataaaacaacaaaaatcgattacaattgcgacaaacatcatacctagcgacgtgggtacagatcccaacctaagtctggctcttttcgcttcaatactggcaccccagagctgccaccctgtgacatgttacccatgcgctcgtccacaaacatggtctgaccttggaaagacacaggccaatagcttgcaccttccctacgtgcaccttcatatgaccttccatagttgagatccatgctgggatgaaaatagctcaattcactagagggtgggattgctctgctgccgagagatggatgagatgtgcccactcctaagtttggcaccgttggtacaccgaaacctggcaatggaggtataactggcgtgccctttgcatcaaccatataaggaacagtccctggtgcatagaaaggtgacgggaaagacaaagcagaatgagacgaatagctgacaacactataatcagggggtgtatgcccgtaagattgcatagaccttgcaggatctcttgattccacacttggcccaagaaagttatgctcattttgatggctatgttccttctgtccaagaactattctcttgcccagaattgtcactgcagaatggtctgacacatccctcccagaagtcttgacagaggactcatctgcacctcgtaaaaagccatccacgattggtgtgttgtcattcaagtcaaagttccttactgcaggttgccttgaagatgaagaggaagaagggtgactccaatcgccattacattgttgtcgattccaaaatgatggtacattacttgtggtgattgcagcttcctcatcgtcacatggacaattaaggtcaagttcaaggctattcaggccaacagttgcagaggcatcctttcgcactatgtcagaagaaagcggaaggatggctgctgaaagtggttcaccagcagtagcattgtcactttcagaaacattcaagtcaaacagagcattgcctgttctctgtgaagaggcagatactgatttctctccatcgggagtacaccgaggagaagccggtcgaaaagcactggtggctgcagaacctttccatcccagttcaccttcaaagtgcaatcgagctgggaatacagatgaggttcttgaggcagccacagctataggtgttgataaattaattgaattactaagcgtggacttcgtatgacaatcaacttcctcagtgcactggttttcattaagatcaatgcctcccagcttcatgcttcgcgtatgttttctactgaaagtaccactgtcatccgtgatgcctgaaccatcctccttcatagatgaggaacttcctgaatcctcccctgtagtggaggatttattatcattatccggttcatccatgggcggttcaggctgccggcgtgcttctaagtcgggactatcagaccgtctggaattaatatcaggggaaccacaaaatggtcccctgtagtcaatgacttcccgctctacctcaatagcaaccagacgagctacttccagtgcatcagtatcatcatactcagctaatggtgttgatgtatctcccttttctgctttcgatttcttgtctgctgcctttgaggaatccccaaagctcgtcatgcatctcttcaacctcaattcattgacagcgccctttacatctgtatcagatgatgatgtaggcccctcctctttccttgtactttcatcatctgatgaatcttgcatgtcaaggggggctaggtcccagcctcccactgtattcttctcagagtgtggcatatcttccaaaaaggattcacctttcttgatatccacgctaatagaaacattttggtcctgcacatccattttgttactaacaaatggattttctggattattagtcccagaagacttggcctctgcagttccatctggcagtgagacttgtgcagcaccactttttgcatcattgttagcagaagactcctccgtcacaggtacattttctaaaccattacgacatgcaagtgatggtactgaggggttcccatcaccaataatggcatttccatcggagtttgggggtatcatcaccagcgactgcttcactatatcacagttatcattggtctgggagtgattaggcaaaggaacactcgagcagaccatcacctcagacttcgacttatctcctgcaattgcagcttcatttgccccaccagactcaggtttaggttctgggagtttgagttgatctgggttccgctcttttgctaccatgtcatggacatcagaagtgcatttcggtacacttctccatttatgacaaagcactcctgcctttttgttgatatcagtattgctatgagaaagtagatgctcaacagtatgcagaacaccacaagaagtaatttgtgcattttcaactggaagacactccagtgcagacaatactgcaactattaggtcttctgctgcattgctgatatcctcaccacagttctgagcatcctgaagccattgatggaggaaaccgacaccatttagctgaacaaaatgctgaagacactcttcatttttggtggacgctagagtgtttgcagccgttgcacactgccttatcaagtcagcggtgttaagttcagcagcacttttgagcttcttgatctcagataccagttctccaattcgtgctacagttgaaatgccatccttcatctcagtaagagtaaagaaatcctcaagcatcgtgcttcttgcactaagtcactatacggctgcttgagtgctaaactgagtgttatctggtttgatggttatataacatcctgaaatatggaaagcagcttggccattaaaaagtattttggatcaacttaccacaattcaaataacagtatgaatcatggtgaagaaaacagctaaaaaagataatatcgaaagtgtatctaggcaaaagaagaaaaaagaatatatgagcagaagtgcaagcagcagcaccctttatctctaggaataattgcatgtgcataacccaataaggcattagttttagttaattgcataggatataatgaatggcttagatccttatttggtcaagacaatacaagtattgactttgagtgtgtccgtatatgccactgacaaaaagatgcctaacatttcttaatttacagaactacgtccactgctcagagctcagtaattctttatcagcaaattctaaagagtcatctaatcggtgcgttctacaggcggagtaagaagtgcaaattatgccacaattacacatgaatcacacataaatctaagtgtagtgtactagtgcagtaagccactaataaggaagaaacacgcatccaccagaatcaaccgcaatttccccgcttataacgaatagcgcatccaatcagtaaatcatacacacaggag

SEQ ID NO: 4242 - DNA, 421 bp, Oryza sativa
tctgtgaaggttcaacgtggtggtgtggtgcggtagcgtaactatggccgggcgatggcaaggcggggtaatttcggggcaagcgggtcgcgcccgcgcggcgccgtacgtacgttacgtacgcgagtgagtgttggtgtagccccgttataggttgaccaccacggcgtgcatatttatgctccgtgtgctaccagctgctccttccgttttactgtctccgtcccatactacttctcactttgagtttttttttaaactacgcagtacaatacaaatactcacaacacacgcgctcacccttataaatacacacacgcaaactctaccctatttgagtttttggttgtactccctccatcccataatataagggattttgagtttttgcttgtaacgtttgaccactcgtcttattcaa

SEQ ID NO: 4243 - DNA, 588 bp, Oryza sativa
gcaaattacaagtacaaggaaaattactttttctcatctggagttgacaaaaatttaaataaatgtcattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctttaagaccataaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatag

SEQ ID NO: 4244 - DNA, 6244 bp, Oryza sativa
  unsure (1)..(6244): unsure at all n locations
gatctgtctaagtgataactgtggaggagaggataagtgatagggattatataatacatatttaattttagtctcggttggtactactaaccggggctaaagattatcttgatctttaataccaaccgagactaaagtggtgatctttagtactggttattaacaccaaccgggactaaagatcctcggccccctgacatacatctgacaagggatgaacggttggtgttaccaaccgggactaaagataaaaatttttataaccgggactaaaaacaatctttagtcctggttctttttggatccgggattttgccggaccgaccaaaatggtttctccactagtgattgtagtgaatatccacggcttagagtagcattcgagcgaatcctataataacaatgagcgaagcagctttttaaggatggcgcatatctaaatttctcgttattttctatccaactgtatattccaatattggacggctacacgatctaatccgcacgtgagccactgcaatctacttcacgtccggacagcatggatcgatgaccaacagcatggatcgatgaccacatatcggcgcctctcctatacatgcagtcttccctccactcgaatgaattgttgtatgcttgccatcaccgcttgtgtgttagagtaggtacataaagatattgagaaactaagcaatacccctttaccacaaataaataaatagtccactttgactccttcatagtgttccaaaactaattcctgaccctgaaccgtaaaatcagatatcttaaccccttaaactgttaaaaccggtcaaccagtttgactctctcggtagtttcggagagcggtttcgctgatgtggcacgttacgttacggtgttgacctggtctttgtcccacgtggcactcacgtgacattagaattaaaaaatatatatgagcccatttgtcattaaaaaaattgtggggcccacatggcggtctatctcttcacccatctttctctgtctctctcatcttgttacccctaggacatccccgacgagctcgacgcggcggggctattggcaccggtggtggctaccctggtggtgtccactggagctccctcgccgagctctatcatgctaccgtcgccatccaccactagtcatcgtcccgtgctccctcgatgtcccacgtgaataagaaaaggagaccagcggtggctaccccggtggcggcacaacgggcagtggcttgcttcaccaggcatggccagccaacgtctgctccttgtcactatcatcatcctgatggagctcccgcaggcagggggcggtgttgaccacctatgagagatggagctcgccgaagctcctccaataccacccaaatctaaccgaggcttgagagcgaggcttggcgtcgaccaccctccttcttacgtcaacgttagactaggtcaacattgtcacgtcagcgaaaacgctcttcaaaatcaccaatgagtcaatttgcactagtttttaatagtttagagggtcaagatatctggttttgtggttcagggttatggattagattcaggtcactggttcaaggttatggattagatttgggtcacttttaagagagtccagttgaactttattcccttcttaaatagaacgaagtctgagcccgtatatgaacccacccttgcccctctcttctctcatnactcgttgggcttttgcaggagaccaattgcatattgcgtattcgcgatcccccgggtctgctcactgcgtgagaagaagagatgatgcaatcgatggtgcggtcggcggcgcggcacgcggtgtacgtgctgcggcggttcggctgcgtctgtgaaagcagagccgccgcggggagaagcctgagcaacgtacgcgccggtgagccgccggcggcgctccgggaggagaagaagaagaagagattattttctttcaggatgaccgagaaagagaggtcgagggtcttccacgccagcgtcatctggggcgtcgtattcggccaaatagtcatcttcacgatgcataagcctcggtcttgcaaagaaatcatggccgaattagaggctaaggctgctgtttcgagacaaaattccccgaattaagatgctaggttccatatcgttggctgtttaccatgtactactagtatttcttgagtaatttgagtattagtatttgcttatttgctactgttcccttctttggaattgctagataaaattcgttcttttttttgggcaacaatacatgattgtgctggcaatgatacatcgaacgaagagtcgaatgcgccgtcggcgccgcctgtcggcacgcactggtggagaaaccatctttcgtcggtcggccgatttccacaatagtcccggatgcaataaaaaccggggctaaagatcatctttagtcccggttcaaaagggtaacgggcatatttgatctttagtcccggtttgtgtggaagccaccgagatagaaggcgctggagtgttgccttgtgttatcggcggaagagccagtttacatgtttgggcctgagtgagaaggttaagaatggaaagagatgggattttttttaatcggttaactgcacatgacattcagcccttgcaggagtaaaaagtctatatgacttaacgtcttagcatagcttttcttttaaaaccctgtataagcacccgggactaaagatcatctttagtcccggttcgaatgctgtcaggacctgtcaggccccaccaggatctttagtctcggttggtattaccaaccgggactaaagacgtactttagtcccggttggtgttaccaaccgggactaaagatcccggtgatctttagccccggctggtgctaccaaccgggactaaagatcttaactttagtcccggttggtaataccaaccgggactaatgatcccggtgatctttagacccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgataccgattattattcaaggccccaagcaacctggtaacgacatcgacgtgtacctaagaccactggtcgaagatcttacatagttgtggaagaaggaagatgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccgaaggagaaaggaagccattacttgagtctagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataataacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcc

SEQ ID NO: 4245 - DNA, 884 bp, Oryza sativa
acatctgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgtaagtctttttcgtgaaggacatgtctagcaaaggaaagaagggcagagggcctgatgagcctaagcgtcaagtggttctcccaggcaaaagaaaaatcgtcggagttgagtacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacacaagtggcaatttcatatgttaattagagtttttaacatttactttactatcattcatatgctaattataattgactggagaatttttaaaagtattaaatttaatatatttttaaaactatcattcatatattagagtttttc

SEQ ID NO: 4246 - DNA, 1332 bp, Oryza sativa
agctttgtacatgcgtactcctcacgcatgaaaaagctctccccactcgtctctttcaacatagagtacggagagaaactactaagtttagtttgttggtaacctattatgagacagaacagtaagagtgagacatattatgtgcatgtggttggttatgaatgaaaatgaaaaactgatacaggcttgtgggtatcattacctccatgcgaagagggagttttgtgcactgcattaccttctccggatttgtcagaggcatctactgactttgagattggctgatctggggtacgtgctaaaaagttgagttcttgttctttgtcagagtcttcagccacattggagatgtcatgacctggggtacatgccaccatgtttgcttcttcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctattgcacccgtatgatggccaagattgtatttttcatcatgtttgtttcgcagctgaaacccaaaaaaaatgtcaatagtctgaagtttctgcacaagggaaatttcaacaagaatactctaccggcaggagagttgattttaccttcatctttccatacgcggggaaaggattccggttcttgagaattacatccctctcaatgaattctgctatcatggagtcattgtacacgccaatccttggaatgttttcatgctcggaagtgtccgtcccgaaatccagattgtccagataaaaaagctgagcagtataaattatagcatgtgaaaagatgttgcgagtatattagaaagtaaaaggcaaataattcgaacgaataataggataatctcacctgaggtagtataatgcagccattgatgtaaccaatgctttttcgatggcgtattttgtgttgcaatgctgctgctgcatctttgatgtcatgcaaaccaaattccgcccagttgtacttgtgaatattttctacatcaaccaaagccttcatataccttatagatatgtgattgttaacagattgaggagccaagaatttggttacaacgaagattataaaagcagtcttgaatacaatctgttcgtgaacagtcatcgtcctgttaaattttttctccaatatcctctgaattgttacaatggtaagtccatcaaaggaatctttctcaaagatttcacacatataagccttaacatcttttacctcatttttta

SEQ ID NO: 4247 - DNA, 1038 bp, Oryza sativa
gcatctttcttgcttgagcagcatgaagggctttagtgaaaacagaactagagcccccaccaccttgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggcgttggggcgctcctctccggcagcctgcagcctgacactgctataccgtaccaatgtcgggttggtgctgttcatcgtcgccatggccggcaccacattcactgcaaaataacagatgaatatggcaacaaaccttggaactagagttctccatgctagacctttcaacgttatctgcaacgcagccgccggcgaggctactaatctgagtttagatgggttaagaactctcaaaacgcaaagaacggttttagatcgataatgttctgctcaacgggataatcatcctgctttctcgctttggataagcaaactgaagagcgaaaaaaccaccctgaaatatatctggtcagctgtctccgaacaaaattctatttacaacaaactcaggaatcttgattcaattttcgaatctgctacagaacagaaacaatcttgttgaccccaagggaaaaaaaatacgggtaaaagaaaacgggtaaaagtattcgattcaataaacctgttaatagtcattaccattatctgggcaaacgaattgaattggtggcggacagggagggagtagctactcccggtagtagtatataattttcctatatatatatatatatatatatatatatatatatatatatatatagggagcgtatcctatgcacacaggtcctggcgtgtacacaccgtgtacgccaactaaaaattatcgcgaaaaattctagaaaaattcatacatgtactttcaatagcattacatctacgtgcaaagtcgcatctttaaattcattctacatagagaatatcataaaagataaaattctg

SEQ ID NO: 4248 - DNA, 447 bp, Oryza sativa
cagacggagtggatgagggcgtggcgtgggcccatgaagggcccactgtctgatcggtggggggagtgtgggcttgacgagtccatcggaaacgtccgagtggcccaggtcgaattgatgaggcccatttgggaagttgggctggttcttgtaaaatgaaaaaaatgtttaatatatatttatattaagtggagtattgttataaattatctatgtaactatatagaaatattttttaaaataaaaaaataagtgaccttacaaacagttggagatttttctaggaacatatttaaataatctgttttaacaataccgtaaataagatgtaggtcgtacacttcatgattagaactagttaaatttaacattgcaagaaaatgtttggtttttttaagtgagcgtaacttaactaatcaagttttttctagtcgaacccgctctttt

SEQ ID NO: 4249 - DNA, 19683 bp, Oryza sativa
  unsure (1)..(19683): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcggcatggcaaaggggctcctcgagcggtggcggtgcagatcctcgccagatagggcaacgagctcggttgctgtgcgcggggatgggggaggagaaaattcacatccatcgccgtgcccgtctacccagccgccttttgattcgccggccgcctcagacggaggccgttcgccgtgcagcaaagggcgtagtgccgaggaccacgctatggcagccgccgttggacgccgcgatgtaggagttccctcacatggtcccctacgtgttcacgccacatgtgattaatttccaccgataattaagaaaaaaaggattttcttttgctcttggtggtttttgcgtgatacacgatgctactgaatattgataagattggctccaaggaatggattggttgtcaaaattaattgtcacactcacatgttttgtcttggtctgaaatctgatgagttggccattcttgacatgcagtacaagggtggtgcagctgagggtggcagaagaccaatcatctggaacatctttgaacaacgaagcacgcccgccccgtgtgcgtctttcacgacatgctctggtcccgggtttcttcctgtggtcttctagcgttagaagaagtcgtgtccgtcccggacatctgcaacgtcctctcacgcctttttttggggggacaaacaaagatcaggaaaagacggaccgaacccattcggtgactttcgcggttgccctcactgaaccgacttggatctgaactacgattcagatcaagtcttaccgaaattggatttccttttcgtgccatatgtcgcttagactttactttttcccctttctgtcctttcctctatttgttcgatagggtcttcaatctggacccaggcatgttaattacatctctgtttggctctgccttctagctgtgctatactttcaacacaaatcaagttcaattaggtgtatttcatatatatctacaagcataaaatttgtcctatttagtaaccagaaccaggtcaacgatgtaaatgcaaaaaataataagctgaatacacaaagacacaaatgatatcatagaagtatcggaaaaaacatgtatatatgtctattattgtctgaaatatgacaaatagtctattatatgattatccttgttggtgagttttttatgcaactagagcagcctatcttttgtcaatggtcatagctttgttgtaagaaagattatactctttggttcttcctatgatagcccagagagtatcttgacctgccaagtttatgtcatcaaactaatttagttcagtataggtcctatcagttaaagctactcgcaggcattattcctgttgttgtcagttcacttgtatagttatagctttgacctagctttgacctatccaactagctttgacctagttggataggttaagaaatagaatattggcaatacaatatatcatgcaattttctaaacatagcttcacaaaaatatggttcattttattcctcacagaagaaaagtgttcttcattttacagtgaatattccttgaggcattgaagttagttgttattgtgccaatgttgaaatgttcagtatatttggtgaattgatgctctatttctttgcaaaccatgatttctgaattcttctcagttgctactttggtcatgacaggttaaatgtgttataggagtacttcagcttttactgtttcatgagttcaaaatataaattgatctttgaggaatgaaaagcaaatgttctcttcagctatcttttctgaagttcaaatgtgtcctttgattgaattaatcttctgtaacattttgaaacctccagactagcatcatcatctctcaatactatcgacattaattcagtatccattttattaatccagtttcacattttactttgatgttcttaataatcttcagcggaaagagatgttctacagctctgcactttatctctgcctgttagtagcactctgaagaacagcctaagcttatcacccatcatttcctctctctccttttctactgtcttcattgatgctgctatattgaaattgcattttgatattggttctttgacaactgtggagcagcttgccaagacaaaggcagctcatctgctgaagtatcctgatgcgaagatactgtggatcggttgccctacatatctttgcattgttgctcttaatataacaaacgccagtcgtgtagcttcagattatttatattgcagtatatcaagaacatagctatacgatgtttggttagagatatcaactagctttatgataagcagctttcaatccatttgtcatagatgggctagcaggcagccagtcactgtgtctgtgcacatacacaaagtgagaacattgagattcttagctcaaatgcaaagaatctgatattgtcctcctcttatccacatgataaaagctagagctaaagtgtactaattcaagtcaaaggtcacattgactgtgaagtgaaataatatacatgtttgtaaccaggaaaaatagtatggacaagaccaagtaaagacgagaaattatttccctctgtttggaactcgtcttgctttgatccaagctccatatactttatcttgacacaccaaatataacctcaatttgtcacctttcctcctcctctcttagtcttaaaaagagcgaaaacttagctttacactgcactgcaaccatgttacacatatatatgcatgtatataactttaggttcacagatagcgttaccacatcaaccgaaaaaaaaatatttctttcaatatttggttaacaacttcttataaaagaaaacactagtatcagcaaagaacatggatcatgtgatctgatcatctgagtaactgatacaattatcttgatgtagtatttgctaaaaaaacattaggtatgcataatcaagaagcatcgtctgacttttgcccccccttttttttcatagatttgctctttcattgtgagactaatggtatatcaagtcctaccgttttactttatttttctctcattttgctttgtctgtgaacataacaatatatcaagttataactgctttactcaatttgttttctagaaaaagttcgtttatttactgtgagcatcgagacataaagattatgcatctacatggcaggctgtatcaggggtgctgcaagaaaatattttgagggaacgttactacgaacatatcatgtacactaaagtccgtatcaatgcatacaattgctatgccgttatgatgtgcactctatatcaggaatggatttattttgatcccaaaatggacgctaagattgctgagatgaatccgatgaatgagaatgaggttgattgggctatggtttattggttttatcaaagttggtacgacaagatatggtgcaattcttctatgtgcctcaacgatgacttgtatagttatacttattgtcttttgttataagcttttttttttttaaaatggaagcatcatacacatgtgagctgtgtaatttaatattttcaaacattttaatgaacatcagatattggagtattttcggaaacgaaatgcattaccatgtaactgtgtatgcacataatttcctgatttaaggccactctgcaagaacactaggccaatcactgtgagggcgcggcaaagctgcgccaagttttctagtttgagctgaaagaaatgctcaagttataactcaacttccctatatttcattttgctatttctgctgtaaaactgctggatgctactatgtactaaaattagtctcatcaccaggagtttcaaagaacacaagtagcccctgtgacgtttatcgtctcaatttgttttccttatacaagggacgaggaaattactgctatttgtagtaggtaacaattgtgtatgaccatatcctatttcccgagctagaagaacttatttctatatgaattatcctgcttttcccctttaacaaataagcaataagctctgtgcattttatcctattgagagaaaacagctgcctgaatccagtgtagttgcctgaacttttgcagtggcacaggtatttagtttgatcatagtccataccgctttgtctcttgcttctttgtttttagcccttataaatatcacagttggatgcttaggttgaggtgtcagatatcaaattgccaacttgtgaagctctcttatatgcttgacaaaagttaactcttaggccatccacaacaaagaaataaacatacaaaccctttggttggcaaaagtcacgtgtgtgtatgagaacttaaccccaacgtcatacgagaccctccattgaccagcaagtgtatattcagcaagtcctaatgacatcctactcactagtagtgatgttgattggagacgaaaaagttttgtcctcgaatttcgatatgaaagatcttagtaaagtctcatttgttctaggaatagagattcaccgagatagaagaaaaggggttaggattatcgcaaaaggcatgtctatgcatgcaagtaagcctacatctgctcccatagtcaagggcgatagttttgggaaatttcaatgtcccaggaaccagtatgagttcgatcaaaagaaagcggttccatatgcttcagctgtcggaagcttacagtatgctcaagtatgtatgtgccctgacttagcatttgttaccgggatacttagcagatataaaggaaattcaggattaggtcactgaagaatggtaaagaaagcttgtgcaaggcacaaaaggcctcatgctaacgtacagaagatctgattccctagagatagaagggtattcagatgcagattttgcaggagatgtagatgataaaaagttcacatcatgctacatattcactctcgcaaaaggggctatttcgtggaaaagctccaagcaaaccgtcgtagcatcatcgacgatgtatgccgagtttgtagctagttatgaggccacggggcaggcaaaaaatggttaaagaagtttgttcccgagttgaaagtggtcgacagcattcaaaggccattcaagatgtactcacaacaataagtcaagtggtgctgccaaacacattgacagtaagttttatgttgtgaaagtgaaaatccaggatcagacaattagtctcgagcatataagaacaaaggaaatgttagcagatctgcatgcaaaaggcttaccgcccagtgtgttcagagaacacttggcaggcatgggtttttacaggaaagcctattatccttggattacaaaagaaagggcctagtgtttatttcgagatggagaggtgcattgtagtcgttgcgtctgatggttcaatggtgactgtcatgatgaagcgtactctatgcgtcaatccattgagaagtaaatgttgagtaagagaagtaagaaaggcggagatcgaatgggagaatattagttgcgatcctggggggaatcgggaaaacgattccccactccgcctacgctccctgatcgggggcgccagccgatctattggcagtgggcccctctcacgcagcgctaatatataaagagagggagctggcgggcgcgcgaaccaaggttggtcgccgcacacacggactccccacaaaccctagaagtccctccgatctgggaagcgctgaagtgaggggaagcccgccgccgggtgtcgccaccaccatcactgacaccgacaccgtcgtcctcaccgacgccctcacatcaccgcaccatcgccatggctgtgtcaagctctaagaccggcaaaggtatgggttctctctctctctttctctaccgttcactctccaaggcaatcacccattattcctataagctagagttgaacccctagatctcacatagcaatcctaagaatctaacacatgcctcagtcagatttgagtggtagcagaggagcgccggcgagctccatctctccccggtggctgccatcctcggcgccgtgaggtggccgccactgaggtggaggccgaagctgcggtccgccggcgcgcgccggccgtcgttggccaaagacaaccctcgtcggtcgacttcctccacgacgccgaccccatgcgccggccgtcgttggccaaagacaaccctcgtcggtcgacttcctccacgacgccgaccccatctcaccgagcgctgcctcgccattgtcgactcctccactccggggaccgccgctccagctagctcctacgtcagctcccgccgccgcccgccaccaccactccggcctatgcccgccgccggctgaaggggacagtgagaaagaaagagagaagggaggaagaggggaggaaaaagaaagagagaggatgacatgtggggcccacaagtcagtgggacccacaattttttatgtgtgtgaatgactaacgggtcccgcatatatggctttaattcaaatgccacctaagcgccatgtcaaccccatagactggtcaacaccgctacgtcagcgccacgtcagcaaaacctctctaaaaatcaccaagggaatcaaattgtaccgatttaaatagttcgggggtcaagatatccggttttagggttagggttatggattagattcgggtcacttatcaggaagtcaaagtggacttattccaccaaatttgtaccggcactccactctctggtccgtgtggtggcccatggcatatggccgcccaacccattcgcaagaagaagaagtgccactggcactgggccgaacactggtttacaggcctgggcctacaaggcgaacagcagcgacagcaatctttagcgaccaaaccgcgacatcatccccatccaaccccgccgcggattgggatcaggtgcagtctctatatcgactgtaactttggcagtcgcgtcatccatagcgtccaaattgaatcaaacggtgttcactgaaaagaggttcgtcatggctccacttgagcacaaaggggctgatctggccggcagtagcgcgccagcgaacggcggtcggggaaaggctggtgaactaaaaaatgagttgcccagctcttgaggatcccgtgcatggtgaaatgaaagaggaatgtaatatatatgttccttaatccgggcagcactgggttcttactacggatccgtccgctctcaatcgagatagtaatgcatctgtgaggttggagatcgatcgatcgatggagatgcatgacgaagatgaaggcgaatttaataagctgctaattaattgaggctgtgttctgcttcaattttatttttaaggaatggtgagcttctacttcacgcacgcatatcagcatatgttcaaggtctgcttgatggggagatgaatatatagttgatgacggaagcgggcaagcgggtgcttggggttggcatgttgaggagcgagagcggcggtaaggcgccgggcaaggagcggctagctagcagcatgctcaggcgcgcgccggccgcaaggtccggtagcacagcgccgtcgtgtcgacatgctctggcctcttggctttggtgtgttggtgttgggctgaggtagatgacgatgtgcagggttgccttaacgtttggccgttacattaattttgtacgtggtggatcacgcgactgctaaagttgcagtcaatatacaacttcacctgatctgaatccccccggcgctggccgctgccgcccacagagcactcgcagccgcagcgggcaacagaaaaatcgacgtcgactcgtcgtcggcgccgtcaccatcgtcgcgcgcggagaccccatcgacccctagccagaacggcagaaacgatgtgtaacacaacgagagcgagaggaggccgaggccccgcagctaaggtgatgttcggatctgggactaaattttattctatatcacatcggatgtttgacactaattagaagtattaaacgtaaactaataataaagctaattgcataaataaaagctaattcacaagacaaattttctaagcctaattaattcataattagtacatgtgtactgtagcatcacataggttaattatggattaattaggctcaatagatttgtctcgtaaattagtctaagattatagattgtattttatcattagtctatatttaatacttttaattagtgtccaaatatcaaatatccgatctaacgtagagcagatgccttttttatacaccacgtcgccaacgcggcgtacgtacgtacgtcgagctggaaagcgatgggaggaagcagccacgatgatactcgcgctccgcgcgcgccggcgttgctgctgccgccgctcgcggagtgcacggctcctccggaatccggtgctctccaggcatcgaatcatccaacacttttttttactggctaagcacgcataatattaataaaataaggtaataatccatattaatttgcatgggggtagaggcgaatcgtactcacacacggccgtccatggcttctgccgcacgtgcgtgtgattaattaactaactatatccatggaattggataacaagatagccttacatacatccacagttctgcccaccactatggacggaaccatatgatatgaagaaatcggaggattaattaataagagcaaaacgaggaaatcgtgcagaaattgacatggatattagtcttctccagtgcgtagcggtgtgtggtttcgtcgtttcgatgtggaagtcgcaggggaatctagtctttgtgtcaaagtcgggcgatcgatcgccgcccatcgacaagccagacagcggcggttttgtacgcgcgcacgcttgctgctgcatgcgctcgcgccggcgagcggtggcccgtgacacgcgtactgtgcgtgcgtaactatcgtgacaaaacattgtactgtacccacttaatgataggggttccaatagtggggtaactgttcttaattagccattagtttccattgtcacggattgttgaatcgacgttggtttcgaattttggaaatttttgttgaacgaacagtatcaatccaccgcgggaggcaataatcaaggaggggaaaaaaagcaccattgtgtgctaacaactcctatacactctcacagggaaaggaatggacaccaatcaagtcgatgctatgcgaggctggataccgctagcccaataaaagatacatatgggctctcggccatcaccatgtagaaagaattgtcgagggaggggacgagagatgagaagttctgcttctctctcgaatagatccgatggtaacatccaagatgtcgccgaaaattgaattgatcgaagatggaacaggcaagaaaagcaggatctcctagatgacgtctccaaggaggtcccgctgcttgtcaaacttggactcataccgccagagagagaaggaggcatcacaacaacgtacgccctcaagagggatcgcattgcctagagcaccaccgttatcagcccgaacatgaaatgtcatcaaggcgcctataacatacctctcattgttgttgtaacctcgacgttgcaccacaaaccgaattctgccatatgcccttctctgccacaccgatgctactccacctgctatttctcatcggacaaggagctccactgcatcgatgacccttcgtcggctcctttgcagcacccctcctcccgcggccccctcaccccaaaagtctacgccaccctttctgtagacacgaagcaacgagcaccactgtctcctacattaatattgctatgccaccacagggtcacatccaccatgtctccgagccaccgcaaggcccctctcctctcatgccgtgtcaccacgccgtcgcaggcccttgctcaccgcatccacccttcccctgctgcggatacaacgacccttgctcggcggcaccccgttgcctcgtttctggtcccaatgcacatcatctccatcgtcggtccacgttcgcaacagcccgggaggctttagatccagacagcgggagggcattggaactgcccaagaggcatcagatctagtggctctggccctctccggctctccctcattgcctcctccgtgtctgaactctaccgtgtgccactccatcgcacaccgccaccacgtcctctactacgccggcctcctgatgtccatcagtctcctcatcagtaccggtcgaggagaggccggatctaggcaacaccaactcccgagccgcctcggtgccctagctgttgtggcatagttgggggaggaacagagtgccatgaaaccgtcgtggttgcggaaactgcatatgtggacatcacatccatgagtaaaattattacttcggataacgtgaacaaatctcaaaagttcattatttttttaatctaataataattttaggtattcactgtataagtgatttatcgtacataattttccatggttgcctggcaccagttgccacccgcggtgtcatactgagatgatgcatgagactgcaaccggccggaagtgttccttcctggcttcctcttctaccgggacgcgtcagatgaagcactggccacgtcactttcgttgcagccattgttgttgtcagcgtactagcgatcatttattcctcggcgcatataggggtacaaacaaagtcaaagggctccatcgaaactgcgtaatgcgtgccggtaagagcctctcctgcaattgcccgctgctagcaaatgttgtgcggattcttcctcatccaaatgcagcaaatggattctatatagcaacgaaatgctaaatctcagccacctcttaacggcaagacctgtttcagaatagaaaaatgctaaagcaatcttacttgaattcagctgcgttcgcttctaaaactaaaactttagacgataactttcttgtttttcgttagtttttctaaaccgtaaaatgatgtgtttttttaaaaggttttttctaaaccgtataacaattaatacttgattaattatatgttattggattattttattttacatgtcactgaaaagctaaaccgaattacatattcaaaatatgtactccctccgttttttaatagatgacgccgttgactttttctcacacgtttgaccattcgtcttattcaaaaaaaaattatgtaattataatttattttgctatgagatgttttatcactcatagtactttaagtgtgatttatatcttatacatttgcataaaatttttgaataagacgaatggtcaaacatgtaagaaaaagtcaacggcgtcatctattaaaaaacggaggtagtaattcgaaatatgtctgaatcactcttgtaaatttactactccctccgtcccaaaaaaagacaaaccctgcttcccgtgtccaatgtttgaccatccgtcttatttgaaaaaattatgaaaaaaataaaaagacaagtcacgcataaaatattaatcatgttttatcatctaacaataatgaaaatacgaattataaaaaaatttcatataagacggatagtcaaagttgaacacggaaacccagggtttgactttgtttgagacggagggagtacattcgaaaggaacctctagaattgctttgagattgagtaaaagaatatgatccctcggtcttctaactccgttccctcttccttgttgctatctctattatcacatctatcttacccattgatttttcggtttcaaaaggtgtctaaaacactagaaaacatttttttcgtctattataaatttttattttttgcttcattaattttttttcacttaattgtagagcaaacaatggaagcacataggattttggaaagacataacacattctagtgttatgaatctggataggctctctatccaaatccgttgtattaggatatgttatatccctctaaagttactcatattatgggattgagggagtacctcttaaaacatgcccctgtgttgtggcatccgaggggaatatctcaacaggttatttccagaaattaaacaacaatattactagttcgagaaaacggcagacgcatatgcagcgtgaggttagtcagagggagcaatgattatagtacaccaatgatcgacgcagcgttaatcagtgtgctaactgattggagtggccgtagtcgcagtagcagtgatcagcttgggatcgcgacgagattatatattttcctttaaacactcactcatcacttgattttgaattgaatcgttcgacacgacggtctcgacagtgagaggaggaagaagcttccaatatctgattaaccgattaattaatcctgtattatattgacatcccaacgtgatgtgctcatgtgcatatgcatgtcgacaaaatcactgattaattaatttactagtttacttactatactactgctgcaaagaggaggcccaagctagcaaaagctttacagtcttcatccctgaatattttctcaattcgatctgcagttgtaacttgctagctatctgctctctactaattacaccccaaatcacacatacagcctctcgacttatgtaattagacgctggattaattatgtgaatttgctaatagctagcagggatatgaaactactacaagctgttccagcagcagcagcagcagcagcttcagcttgactgaattcatgctctcccaggacctttgggagggtcatggcggttgttgggtcctgacccggggtagtcgttcacctccacgtccatcctcgccgccggcctcctgccgagccctctcgccgccgccgccgccgccatctcctgcaagaacggtcacaagccatggtcagagttgctgtcactaacactattagtttgattcagaatttggcttcgtttcagaactggtttgagcactgtgctgcccgtattctgaatagtgtttgtgattttgcagcaacaaagtcgacaaacttaaattggagggggaaaaaattcagagattgcaggggatgagaaagattaattacatctggagagaggttcagagacggcgggtgttgctgctgctggctgctcaagtgcaggcttcctgcaaaagcaagaacgaatcaacacacaaatcacaatcaagaaacagttaagcacagagatcaagaactcgagggagaagaatcaagaaacagctacccatcaacgaaagcttactcgacatgggcaccgaggagacgagcagtgggaggaggaggaggaggcaggacagagccaggacggcgacgaggtcacgaggcctcctctccattgcgcggcgcatgcaggagcaaaagcagaagcaaaccgagccagacaaagccaagaacggccgcgagggcgaagagctcgccgctaggtgttcttggtgtgtgtgtgatctgtggtaggatgagacgatggatggatggatggatggtgtactgatggtgtttattgctggctgctgctgccgccttggggttttatagttggaccatgctagctaggcaggcaatggctctttccattttgttcttcttctctctcttaaaaggtcaacttcacatcagtagtactccatctagttatgacttatgaggaggaaaaaaaaaggtgtactccatcctagccgaatggctttaattagaagaaggtggtgacggatgcaatgtgtggtcatgactcgtggactctggtggggctatagagccttcgcaacacgtctatgtggcgagtggctttaaccggccacgttggagctgcaagtttagctcgagtcaagttgtgtccctttagagctacttctgacttgcagagagcacatgtgtcttgtttgacgagggcaatcatgtgtttgaagctacgtctcgccgatcgtgttggatgagcccatggctctaagctacgagaggtggggccttgatttaaagctgggaggaggcggtggaggctagaaagaagacaatggtaaccactgggggtgagggaagagaggacaaggaggatggctaatgactagggagaagaagggcccacctactacggatgatgccactagatgctccactaccccaatccgatctgccgttagggagcctgccgccctattttgctctgtgcaaccccgacatgtgcaactgccgaggagcttgttgaccacatgcgtcgccaaggtgcttgttagttagatgcactgccacaagggaggtgatggccatcttcttcaccggtgaagagatcaatggaggtggcggcgatggcaatggaatagcgaaggttcagatgaggatgaccttcgcatggccaggtccgtttgcgaacgcttgtcctacttgctgggagagaagaggcagtggcggtggtggaagtagggatgaaaatggagcgaatatagacggataatgctcatatcatatttgttttcatttttttttgctagatatgaaaacgaatacgaatagctcggatacgaaaataaatatgaattatcttgaatacaaataacgattgaatatgatcggacacgaatacggaaatattttttttttcttggaacatgaaaaccaccttaacttctaataaaaacaaatatcatcatatataattagcttgttttatataaaatatagtataatttataaaaaatatttaaaagtttaaataatattaatagtgtgtattagtgttaagagatgagctactattaaaatctaaaaaggtagattgaaggtcgtagagttataaagaaatggtgtatgtctcacgacttcagcagatatccgaatagcactggtcatcgaatatccttatctgtcggaaaccccgataccatatctatcggcggaataggtcgtgactacaatatttacatagtatgatgatcgttgggaccaatatatacacgatattgagataaagagatggataaaagaatttttatacaagttcggatctcttaactgataggtaatagctctactcctgttggctgaagccaatgatgctcttatatatctgtatcacatctttactattataaaattcaaccatgtttttgtcgagatttttgttcattatccgtatttgagtgagtttttagtcgcttaaccatttggtccgtttatatcgctgaaaattaattaactatttgtatcaaatacgaatacggtgaggtgtcgtggacgtcgaatttgtttatgccgatgaggtcacatacacgtatatatgtacgacagtttggagtttgagtcttacattttcttggtacgtgccgatcgatcgagctgtccagcagccatggacgtacttcgtttttcagatttgcaacgtgaattatatagtagtatatctctatctcttctctactgatattttcaccgggattttagtatttcatccgtgtttaaattagtttttaagttggttttctaatcttcattttttattatatttattgtctctatgtcttctctacctctacttctctatctctatctctatctctatctatatctcttctctactactacctccgttttttaatagatgacgccgttgactttttctcacatgtttgaccatttatcttattaaaaaattacgtaattataatttattttgttatgagttgttttatcactcatagtattttaagtgtgatttatattttatacatttgcataaaatttttaaataaaacgaatggtcaaatatataagaaaaagtcaacgacgttatatattaaaaaatggagagagtattataaaagatgttctatagctttgatacgtcgggtatcaccgattcaaagattgccgacatgaatccaaacgcttccgttgctttttttttcctgcgctcgcatgcgtttcacttttgcttcgtctgcagcacatttgccccctccgattcggttttactgttgccacgatcaagcgagatggacttggcttgtactccgtggcgatgggagaggtgtgcgcctggttagattggaaggaaatactgatggagatggcctgcctgtgcatcgctgcatcgtttctttttcagcccagtcaagtataattaatagatcccaacgagcaaatatatctgttcacctcctgttatcgtgaaaagaaataaaaactgaaaattactgatgggagacaatagcgtggcatctcttctctactattataaaaatcaaagatgcttttgccagtactttagtgcattattattgtttgagtcggtttttaagttcattcgcttttgaaaatacaaaagaaattgtataagaaactttttataaagaaacttggatgctaacttgagacgaaagttgaactcctaattgcagctcatgattttctttaaaaaaaatccatgcgaatatttgggacacacatgcattttttctagtaagtataatatttgggctaacctatctagccatcgtcaacttgatggcgtggatctccacacatggtcgatgacaggtagtcttcttcctcgaacatgaacttggcgagatcagagataacactagatccctcttgtcagcctctgcggctccagattgggtatatctaggcttatctctgtgtttgtgtctggcggcgtgtattgatgattgggcctccactttctcctcccagggatcttgtatttatacccaaatgttcccttgtccatgtagaactagggaaacaagaatgtatacaatctgagtactccttatagtttccaatattaaaccctgcttcttcttccttatctggaacaccttccgtatgcgaggcatgatttcgtataagacttggggcctgtttgggggagcttctagcagctgcagcttctcctagaatctctagttgccagaagctcccccaaacagtccagtttttacccagattatgaaaatctgtagttataaaatttggaaaatgaactagaagccagaagctgggtttcctagcttctccagattctcaccagctagcttatcagcagctgcttctcagaatcttaagctcccccaaacaggcccttggtatatggtaggtcctgccgagcttaacccaagatcataggatatgccttatctataaccttaacaatatccgtattcttatccggaagaaaatatatgtatccaaactatccgctccggaaggtatctgtattcatttttctctgggggtggcaatttccccattggggccagggaccctatagggccacggtgggttggggggagggatgattttcacccggggttgagcggggacggggccccgcaaatttccggggctggggcagggattgtaaaccacctgcgcggttgcgtgtgacctgatggggcctcgggatatgagatatgtctcaaaatgtagtccattccaacaatacaagcccagttggcctagtaagtgagacatataaaaggtaaatcctaatctcccaatcccccatcccctactcccactcccctcacccatcctccacagctgccgctggctggctgtcaccgcgtcacctccacctccgctcatcgccgttgtttccactccgcctctgctcatcgtcgcgctgcctcttgcctccgcctctgctcgttgccacgctgtcattgttcgtcgccgcgccaccgctgccgccgccttcgcttggcggcgcctcctcctcgtgtcacacgacggggcatccaccagccgcctcctccaagaatcctctcctgcaggtgcagcgggcccccggtcgagtggcggggcctcgggggggccggcggtggggattaatttcgacccatcctccacttcagggcctaggcggggtggacccgcaatggagcgggagcggggccgttacaacccaacccggctctgccccgccccgttgccatccctatttttctttggaatggacggaaactatccgctccattttcatccctaggtggaaggggataggccagggactttgaatgtgccctaggaagaagtgaattaatttgtgccctatgtgacaggaatacaaactttcttttatctcttctttgaatgtgcattcagcaaagaatgttggcttcaggtggttatagtctggcactagaatttcaatttgggagatatgcttcaagcagcaaaagcttcatatacttcatctcattttgtggagaaatttttatatggtgcttggcacatttggaagcagagaaatggttttatacttcatcttattcttggagcctggggcactataatcttattttttaggtaggtttctcggggacatttgaaggaaaccaaacggcattgacaagacggttgaatgacaatgcaaaaaggatgtagaatggtagcaccgtgagcccctccttgtactataatagaaaagggacatgctagaaaaaagggctaacttgtgtctggtttgaaaaaggcaaagtttgtatttctccagatatagataccaacaaaaagaacatgagtagcgtattacacctctgagtggcctgaacctgtataaatatcttgtgttcatatgcttggtggggtgctcgggccccacaaacttgttttctggagcatcgtgcgcaactagctcctggtcggatctttatttttggggaggggtctacacttccccgctgccagagaatcgctccttcgataatgttagtataaaattagttgttgggtcaaggagttacttctccgcaattataagtcatctcttatcttgagccatttgataatgttagtacaaatatatcaaccgttggatcaaggagatacttatccccattcattagtcatccccatccctccttgacgcctttatccaaatacacatcatgaatcatactaagccatttgatcatgctagtataaaatcatcaaccattggataagggagttacttatccacattacattttagtaatttctaccccttctctccacctttaattagatacatatttgattaaccgttggatagaggagttgcatatacatatttactagtcgtctcttatcctaagccattcgattatggtagtataaaacagtcaaccatttgattaaggagttatttattcgtactcattagtcatctctacccctcttatctacctttaactaatacacatcatgagtaacctgtcatttgatcatgttagtataaaataatcaaggagttacttatctgtatttcttagtcatctcatcctctcctctctacctttaataataactatatggtaacacctcctcatgacctatataataccaccttctcgtgaccaatatagttctgaccaaaataatttagacctctttatgggtggtgtcggtgacatggggccgggggtatcgtgactagaggcttgggtagccgcggtcacccacgtggcctgaccccctcgggggggggggggggggg

SEQ ID NO: 4250 - DNA, 14915 bp, Oryza sativa
ggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtagggggtgcgcgtgtctttctaagccctcgtcctctttcgtgtgcgccaagcttctcccgctcagcccaatggccggacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgtgacttcgccgcccgcgggcgacgggggaggacggcgagacggggcgcgtcgctgcctcgtctacggcgatggcggcacgccccagggcgcgctccaggctgcgggtgcgctcctgcgtcacccgcccgtcgtccccgatccagagactccagcccgacgttggctggatgacgtggccgacttggtcatgacggcgcagcagcgcctaggcgccggcgggcggtcctccgccaccgaggcctctggcgctgccgccgccggctccatgtcgtcgaggcggagggcgcggcgagcggcggccgtaacccgccgttcgtccgccattccctcgtcaacgcctccgacccaagaagatgtgcgtggggggccggatgcccgcctcgatatcgagcgccggcgcgacgttcgtcgcgccgcccacgcaacggagggcgcttcctcgtccggagcgccacttcggtccggacacgggggccggccccccgtgtccccggttggcggtgccggctgtcgagccttcggaacgtccgttggcccccaaggttccggcccaccatcaccgaaaaatacgatggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagtagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgtagctttttgagctcgcggaccgtgtggctcgcaaggaggaggcctgggcctggaactcctccggttctggtgtggcagctccggccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagagacaggagcgccgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggctgcggcccctacccatgaggcgacacggcgggtgcggtggtcggaggttgccctcacctttgactagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggaggcccgcgttggtgaagttcatggcggcggtccactacgcctatctccagatgaagatgtcgggccccggtggccccatcaccgtccatggcgacctcaaagtcgcgcttgcttgtatggagcagcgcgcagaccacctcgccgcggcgtccaagcccgcgggtggcgacgagaggctcagcacctccgtcccggccgccccaaggcagcggatggtcacgtgcgacgaggtcccggtcaaggaggttgccctgggcgatggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagagtcgcatggctagggaggatgaggaaaaaactgcattcattacccccataggaacttattgttatacgacaatgcctttcgggttaaagaatgcaggtcctacttttcaacgtactactcgaatttctttgagtagccagataggacgcaatgttgaggcctatgttgatgacttggttgtgaagtcgcgcaaccaagataccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccaccagcaagcttagggatgtgcagtgcatcaccggctgcatggccgccctaagtcggttcatatcgaggctgggagagaaggcactacccttatttaagctcctcaaacgctccgggccgtttacctggacggaggaggctgagcgggccttcactcagttgaaggcgtacatcagttctcccccggtcctggtcgccccgaagccagatgagccgttgctactctacctggcggcaaccccgcaggtggtcagcgcggcattggtcgtggagcgcgacgaggacaaccctcactccgcgcatccccaccctgtatcggctcgacccgggagagagcagggaggagaggcccccgagccaaacggcggcccaaggcccccgacggccggagctggccctccacctgcttgtccgacggtgccaggcacccccgacccccaggatggccccagggccactgcgggaaggccgcgcctgtcgccctctgaccccgaggtcgtcggcacagaagccgagtgcgccccgcgtggcctctcagacgaagagcgccctggagatgcggcccctggcgaagaggatcggccccgccgaaaggtgcagcggcccatctacttcgttagtgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggttccctgtctcttcagggcgcctgtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtacggcgtatggagcgccatttcgacgggatagagctttggcacatgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccacggcccgtcggagtccaagcctcgggacccgaggggagcgctcccagctcccctagattgattgcttggatcactgagatccaggcgtacctcgcagatgagactctacccgaggaccgcgaaaggagtgaacgcgtccggcgcatctccaagcgctacgtgctggtggaagggaccctctatcggcgcgcggctaacggagtcctcctgaagtgcattcctcgggaacaaggcgtcgagcttcttgccgatgtccatgaaggcgagtgcggagcccactccgcctcacgcaccttggttggcaaggcctttcgccagggtttctattggccgacggctctcagcgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgttgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaacacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggaactgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagattagcttcgtcgagacgacctcgactatctggaagagcgaaggcggcgcgcggccctccgagccgcgcgctaccagcagagcctgcggcgctaccatcagcgccacgtccggacccgatcactctgcgttgacgacctcgtcctacgccgcgtccaaacgcgtgctggactagcaagctctcaccaatgtgggagggtccgtatcgagtgatcggcgtcccccggccgggctccgttcggctggccacgggcgacggcacagagctgcctaacccgtggaacatcgagcaccttcgtcgcttctacccctagtgggggtcgggtgtcatgtctcaggctcgggccaaccccgcacccccccgggcgtgcagggttggccgggggctaccacatgcatatacttaccttttttctcttccgtatttcaataaaagcatttttgatttcctgaggactgtgtttgtgccatcgtttccttttgaagaatcttggcttgaattagcacgctcgtgctcgaccctgccctcggtggcccgagccggctaaaatcgccaaccggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacacagaaggaccgcggcacaaaccatcctcgtctcatacacacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcgtcggagtcgagcgcgaatgcgagccgaggggccgtaccctcgaagctgtggacgatgtggtcagcggcgtcccggacctgcgcgcgcgcgccgtcctcggttccaggagggaactcttccagcgctgcccatggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgcccagaggtccgcctgccgcccggcgcggtctagatgggagacggcgtcccgaagcatgccgggccctacctcgctcgccatgcggagggcctcgacctccccggcggacgagtccagcgcgccctgcagctcggcgatggtgtgttcagcggctgcgaggcatgcggctaggtcgccgtggcccgcggccgccccgccgctgtgcgctctcgcgtccagctcctttgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagcttgcccccgctcggtgagcgcgtcctcgcggaggcagagtccggactcctcttcggcgcaggcggcctcgtgcgccgccagtgttgcctcccgggtggcaacggcggcctcgcggtccgccaggtctctctccttcacgtccagggcgtgggcgcgctcctccagtgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgtcccgcgcctcgtcaagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacacgcgcccacgccgcgtcgagctccgcccgctccgcctgcagggcctccatctgggcacttaacccgtccagcaccgtgctgttcgcggcggccaaggcctgcaggaggggctccgcgctcagtggggcagcggaaggcagaggggagagccgcctcggtgtgggtgccgcgcggctcggcccgccgatcgacgagctggactcgagggcgtcccccgaagctggcttgtcccaagcgtcgcccgaggggtcgggcccgagcggcgcgcccgcggcctcgtcgtgggtagcctcggaagtcgtcgtcgcctcgggcggagtcgggtcgggggcttggcaggtcgcctggcgcgcgcgggccgcctctgcctcccggacggactccccggcccggcggagtctggcctcctcccgagcggcctcctcagcctggcgaacccggacggcctcttgggcagcctcctcggcttcccggaggcggtccgcggcttctcgctggtcagcttcccgcctccgggcctccgcggtcgccgtctcctcggcctcagaccggctggacttggaatggcggggggggagggggggggggcgcgacgggatctcgctgaggcagaagaaaaaccagaagacaaaaagaaacgggtgagtgaaaactcgccttgggagatgggagaatgaatacggccgcggtgggtgcggggacgaacctgcggggaggtcggctaaacgaccacctcgggggcgagatgaggttcccccggcatggctcggtcccccccatcttgcggagccgtttcttctttcgctccccctcgggctgtggcgtcggcagggcaccctccgggcgcctgctgctggcacgcaccgccccgccccctcggggaggagatgggggaggggtaccctcctgcttcctcttcccccgggcgtcggcagggcggctgccccccgggcccccgtcaaggggcccagaagcacgaccccctcccggggtagattgttcccccctgcggctcccgcccgcgccatcgtggcctcggggggcccgctcccccgacgccccgaccacctgcattatggccaggatcttggcgcgctctggatcgcagcagagggggaggaccccttgggggatgagggatgcctccacggagctgagattcagcacccgttggatcaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccaccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagtcggagagatgggcgcaccccgataaacatctcgcacaggtgcgcgaagatggccaacgtcattatcgcgttgggggtgaggtgcgccatctgcagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgcttacgatgcgggaaggcggcagcacgctaccgtcgagcggtgcggagccccgtgccatgacgccggcggaggaggagcttgagagcgagcgagtgcggcaagggtagggcacaggaaacgaagagttagagcgcaagtggcgaaggcaaggggaagagtagcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagatcgtgcgcgcattaactacgctcgccaaccgtgaaaagcgccatcatcatgtctccaggcgaaacgagccggctcgttccgattcgcgcgctgctcgagtaatgtagcggtcttaaagaggccgctcattattgtcggtcggttttcccttgccgatgcgcgcgatttgcgaccgctgggtttctgcccacctgtagggaccggccccacctgtcaccgggcctaaggagtggcgtcacgcccgagcgcttccctcgaggggggcgatcaccatggcgtaacgccgggggctactgtcggtgacatggggccgggggtatcgtgactagaggcttgggtagccgcggtcacccacgtggcctgaccccgtcggggggggggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacagcggggctcacctaaccgcatttatagcaggatggacgaacgcgccacgccgcatttaatgcggcgcagcgcacgcttatccggtccgtgaccggtcgcggtgtgtgaccggtcacagaccagtcagatcgcgggttaggtggcaacaggcggcctgtcacacgcctcgccccgtcccgtcggaatgatgagagctttctggctctcgtccctagccggagccggcgtgctaactcctggagttggtatgtcagtcccggtcagatccattccaggcttcagcgcaagcatggcaaggaagtcgctggccattgaatgaaggttgaaatgggcgtccaccgggaaagctggcaagcggggcaggaggcgtgtgctctgcttgtcagaggtcacttccggctgtagactagccctcattgtaaaaagcatgtttcctttcttaggcagctagaggcccatgtggtgacccctgaccagatcaaaaggaggcccaggcctaggaggggaaaaaaagagaaaaaagagaaagaggggttgggactctggcgaaggggttctagagcctgaactctctctcgctctctggctctttgtattccttcacacacagatccaccagaacacaggagtagggtgttacgcttctcagcggcccgaacctgtctacgtcgctcgtgtcttgtgcacttcctctctcgctgacgttcctcagatcgagggcgaagaacctcacttagcgcccccggccgaaccggcaaagggggacctgcgcggtctcccggtgaggagccccacgctccgtcaggtggcattcgccctgcctcgccaatgccaatgatggtgtgctgtgtcggcttctccctgaagaagacgctgcagaggatgactccgacgctgggatacgacgacaaagccctttttggaattgcatttgacatgccaaatgttttttaaatttgtgatggtggaattgaactgtgaattttcttattagaggatattcaaatctggattttctttttttttacactagaaattatttttgcatgtgggtgaattaagcatgtcgcctgtgaaaaatcaattttcacaagcggatctcttagggtgcccacctttgaaaaccgtcgattttcacaagccttcaatcgcagacggggcgtctggcaatgtgcaaaattgcattttggccacctcgaaaaatcttgatttgtagtagtgcactcaacttatgtaattagatactttattaattatgagagttgctgacaactagcagagataatgcgaaactacaagctagctagttccagcagcagcttgattgatttcattctctcccaggtggacgtttagggttatggcgggggttggctcctggcgccaggtagtcattcacctccacatcggtcgtcgccgccaccatgccctggacggacatttctctccctggtggacgtttagggttatggcggggattggctcctggcgctgggtagtcattcacctccacgtccgtcgccgctgccaccatgccctggacggacatttctctccctggtggacttttagggttatggcgggggttggctcccggcgccgggtagtcattcacctccacattattcgttgccgccgccaccatgccctggacggacatttctcttcctggtggacgtttagggttatggcggggattggctcctggcgctgggtagtcattcacctccacgtccgtcgtcgtcgccgccaccatgtcctgcacggacatacacaaagccatgttcagaatcactatcaacattactatttgtttcagtatttagcctccagaacgtacatattcattttagaattggtttgtgaaggtagctatgaactgtctatgatattttattaacaggccggcaaatttaaatattaggggaatatagagattggaggacttgagaaagattaactacatctgcagagatgtttggagacgacaggtgttgctgttggctgctcaagtgcaggcttcctgcaagaatgaatcaaggcacaaattataattagcatatagtaaaaacacatatcaagaactccaggagatcaatgacgacgaagcttacccgacatgggcaccgaggagacgagtagtgggagaaggagtaggctggacatagccaagacggcgacgagatcacgagacctcatttccattacgcggcgcatcaggggtagcaaccgaggcagccaagaacggctgcaagaaagaagagctcgtggctacttgttgttctttgtgtagtgtgatctgtgttaggaggagacaatgatggatggattgatggcactgggatgagtagtggactcgcagtgttgctgccgctgccttggggtacttatcaaacgttggatgaagcatttacttatcaacattcatctgtgatctccttagcccctcctctccacctatatttagctacacatcatgagtaatccttatccaattgatcatgttagcataaaactagttgttagatcaaggagttacttatccgtaattataagttgcctcttatgccgaaccatttcattatgttaatacaaatatatcaaccgatggatcaaggagatacttatccccattcattagtcatccttacccctcctcgacaccattatccaaatacacatcatgaatcatactatgccattttatcatgttagtataaaatcatcaatcattggataaggcagttacttatccacattaatttttagtaatttctaccccttctctccaccttcaattagatacacatcacaagtaaatcgaaacatatttgattatgtcagtatgatattatgaaccgttggatagaggagttgcatatctatatttaccggtcgtctcttatctaagccatttgaatatgttagtataaaacagtcaaccatttgattaaggagttacttatatgtgctcattagtcatctcttctactgttctctacctttaacatatacacatcatgagtaacctaagtcatttgatcatgttagtataaaataatcatctgttagatcaaggagttacttgtctgtatttcttagttgtttcttcctctcctctctacctttaataataggaaaaagtccgaattagccccccacgaactattgtggcggtacgaattaccccctcaattcaaaaaccagacattcttcaccctcaacttttcatatcggacgaattaccccctgatcgactccagagtggttttggtcctacgtggcacaaatgtggcagtccagttagcataaaagaataaaaaaatagaggagcccacttgtcaattttgcctcttctcttagtcaccacatgtgggccctatatttttaatttttttatgctgactggactgccacgtgtgcgacacgtaagaccaaaactgttccgaagtttgtcaggggtaattcgtccatataaaaagttgagggtgcagtttttgaattgagggggtaatttcaactgccacaatagtttagggggctaatttgggctttttccttaataataccttgatagtagcatcttctcatgacctttatagttccacctccccgtgacatatattgttttgaccaaaataatgcagacctcattgcggctggcattcgccttccaccgtcaacgccagtgatggtgtgctgcatcggcttctccctgaaaaagacactgcaaaggatgactctgccactgcgcaaaggatgactctgccactgggatgccaccgacgaagttcttggcggaattgcatttgatatgtcaattcttttttaaatttgtgatggtggaattgcattctgattttcaaattggaggatattaaaatctagattttcattttttacactagaaattctttttgtatgtgggtaaattaagtgtgccacctataaaaaattgatttttgcaagtgggtctcttaggatgcttgccttcgaaaactgt

SEQ ID NO: 4251 - DNA, 25670 bp, Oryza sativa
  unsure (1)..(25670): unsure at all n locations
cagaaataatgcagaactacatgctagctagttccagtagtagcttgattgatttcattctcttcttggtggacgtttagggttatggcggtggttggctcctggcgtcgggtagtcattcacctccgcattcgtcgttgccgccaccatgtcctggacggacatttctctccccagtggacgtttagggttatggcgaggattggctcttagcgctggatagtcattcacctccacgtccgtcgccgctgccaccatatccctgcatggacatacacaaagccatgttcagaatcactatcaccaacattactaattgtttcagaatttagccttcagaaagtacatattcattttagaattggtttgtaaaggtggctatgaactgtctacgagattttgtagtaacatgccaacaaattaatttaaatcttacgggaattcagaaattgaaggacatgagaaagattaactacatctgcatagatgtttcgagatgacgggtgttgttgttggctgctcaagtgcacgattcctgcaagaacgcatcgacacgcaaattataattatcaactagtcaaaacacatatcaagaattccaggagatctatgacgacgaagctttacccgacacgggcaccgaggagacgagtagtgggaggagcaataggcaggacatagccaggacggcggcgagatcacgaggcctcatttccattgcgcggcacatgcaggaggtagcaaccgaggcagccaagaatggccgcgagaaaaaagagctcgtggctactacttcgtttcacaatgtaagactttctagtattgtccatattcatatagatgttagtgaatcgagacacatctatatgaatgtgggtaatgctagaaagtcttccattgtgaaacagagggagtatttgttttttttgggtgtgtgtgatctgtggtcggaggagacgatgatgtatggatggatggcactgggatgggtagttgactcgtagtgttgggagaaagctacccatcggacgtccgatgaaaaaaaaacggatggtcaaatattgcagttggccaacaagtcaaacattagttatatatggtgaaacaaaaaaatcagcaactgaaacatttaaatattttatgaaacatggtgaagatgcacgttgaaacaggtcgctgtcacatatgaaacagcaagtattaacggatacatgtgtttttctttcaacaaaatataatcatgcaatatcttgttgtaaagatttaattaaaacgaatacaatggtgcgatcggatcatagattggataaataatttaagagaaaaattattttgaagtttgctaaaatacatgcatgtgtgcatggatgagatggagagaaagtagtagcagttagtttcaaaaaatttatgaaaggaaaaggctatacgtactaactttttcttactaaattcttactaatactgatgtgtcatgctatgagtgcatctagatttttttataacttctatctacttaaatcaaacggttgaaatgattgttagtaaaagtttagtcagaaaaatttagtacgtgtagcattgctctttatgaaacacacggaagacgcacattgaaacatatcactatcacgcatgaaacatttagttttaacggtttgaaacacatgtttttcttttgacataatataattatatgatatcttgttgtaaatatttaattgcaacgaatacaatagtgtgattggttcgtagattggataagtaatttagaagaaaaaatatttaaagagaggaggaaagaatgaaaagaaatagctaggcatacatgttacagtgatagggttcgtccgatccatcaggccgctgatttgcagcatttttagtgtggtagatgaggcgtccgatatttctgtttcgtcggacgtgcgatataaagcgttttccatagtgttgctgtcgctaccttggggagggggggtacttatcaaacgttggatgaatcatttacttatccgcgttcatttgtgatctgtacccctcctctccacctatatttagctacacatcacgagtaatccttatccatttgatcatgtttagtataaaattagctattatatcaaggagttacttatctgtaatgataactcttctcttatgctgggccaccattttattatgttaatacaaatatatcaacgttggattaaggagttacttatttgcattcattagtcatctctacccctcctctccacctatgtttaggttgagtaatctttacccatttgatcatgttagtacaaaataaactgttggatcaaagagtatctgcatttatttgtcgtctcttaacttgagccatttgattatcttagtgcaaaaacatcaaccattggatcaaggagtaacttatcctcattcattaggtatccctacccctcttctatgcctttatatagatacacatcatgagtcatactatgtcatttgatagtataaaattatcaaccactggacaaaggagtagcttatcctcatttatttttagtaatttctagcccttctctccacatttaattagatttacatcatgagtgaatcaaaactaatttgattatgctagtatgaaattatcaaccattggataaatgagttgcatgtctgtatttactagccatctcttatcctaagccatttgattatgttagtctgaaacaatcaaccatttgattaatgagttacttacccgtactcattagtcatctctatccctattctccacctttaacaaatatacatcatgattatgctaagtcaatttatcatgtcagtataaaacaatcaatcgtgatcaaggagttacttatctgcattccttattcgtcccttcctctcctctctaccttcaataaaacctgtagagtaacacctcctcatgacctatatagttgtgacgaatataagcacatgcacgaagccatgtcatgaacaatcctaagccatttgattatgttagtatgaaattatcaaatgttagatcaaggagttacttatctgcattcgttattaatctctacccattctctccacctttaattggctacagttattaacaatcctaacccatttgatcatgttagtttcaaattatcaaccccgtccgctgccacgggaacagccgctgacactgccctaccccgctgtcgacgccactgatgtcgtcttgcaccgagaggggaagggggagggggaatcgctcgcctccgcctccaagaggagcagcatcgccttgtcgcccacctccacctcctcggttgggtaatactgtttttttaaaacctgcatgtgtctttttagtagtgttcacatttaaccagatacacataatgggtagtcctaagccatttgattgtgttagtataaaattatcaactgttatatcaaggtattacttatccacatttattagtcacctcttcctctcctctatgcctttaataaatacctatatggcaccgccacctcatgacctatatagttgtgaccaaaaataatgcagacctcgtcgtggccggcctctgccctccctcgccaacaccaatgatggtgtgttgcgttggcttctcccaaaagaagacgctgaagaggacgactccgacgttgggatgtcgatgatgacgtccttggtggaattgcattgtgaatttgtcaaatctttttaaaatttgttatggtggaattgcatcatgaatttgtgaattggaggatattaggatttggaatttcatctttttacactagaaatccttaggtgagtgacttaagtgtgccgcccgcgaaaatcaatttttttaggcaggtcttttagcgtgcccgccttttaaactcgtcgattttcatgagcctttgagggtaggccacagcgaaaaaaacatgtttcgtagacaatttataaattctaggagttgccaatacatagcagagataatatgaaactacaagcaagctaattggagcaacagcttgattgataaagtatttttgagtcatatctatgaaagtatttttcaacgttaaatgtgcatgcatagctctttagcctcaaacaccattgcaggcaggcaaagaaacacacagctaggatgtacattttgttagaaatagaagctttctttgatcttagtcaattacatcaaaataatacaattgtgcttggagtattctcgatctcggtataactaggatgtacacaaccaagacacacatgaaccagtttaaaagaaagaaagtaaaaaaagtattaaggaccatcaattttaaaactagaccgtcacatatgtttctaggtaaaatactcattgatcacctactccaagtgtagacattctgtaataaccaaatcccagcccagcttatatagtataacctggatgtacatgtgattttacttcgtttagtcttattttcttcattctttgttgcctcagcttcatgacgacaacctgtaatacaacctatttcttgtcctaattaacgctggcacgaatggatatacttaaagcaatcaatgattggttttctcgagtggtacaggatttattcacgcactgttagttactccttgaagcaacaacattctctcagtcaagttatgatcgtgattgacatatgtcgttaggcttagttaaggcttaaccaatgcatgacggctttggaagctactaagatctgccttaaaaaaaacaaattctagctacaaacctctatacgtatatatctagattcgaagttaggattataattttttttacaaagaggataagatattgtacttgatgacatgttggcattgcttcaaccgaatatctgctaggagtaccatgttttacaacaatggcttccatcggatggcctattcagccaaagaaaaaggcaaaatttaaattttcaaacttaattttaacattgattttgtgatattttcaacgtagtttctttttcagcattggcttttacgtcaccgagaacacatatataaaagttttacctacaaattcatttttattctctaataagccgttttggcttattacgaaaaaagccaaacgatgaggcccacagacagtgccacagattatgaaacttttttgggtgttggggcaaagagaagttatactgagttgtatgtatcatccagttcaatataaactataaaaacttagctcataaaaaagacaaacaattcacttatactttaatataagggtgcgttcttttctaagtagctagtggtagattttcggctgcactttttcacgaacgtaagataaaccattggcgcatgattaataggtattagttattacaaacttgaaaaattaatttagttacttctatatacaatttttttttacaaaacatatcatttaatcgtttgagaaacatgctaaaaaattacggtttggggttgatgaaaagaactcagtctaggtacattatcgactttgttgcccatgtcactcttgtttccgtggtcttggctggttgctcccaagtcaaaataatgcagcttaaagaatttgcagatatactttaatctgaagaaaagaaatactttaatttgacaaccggtttcaacgcttcgatgcaaaaactgcgtcatttggctcgtcatcttccaatcttggagatagtactgcacatcaggacattgatcataaagtcaatcacatgacaagttgctcggtaccgggtagtcaatctttttcatgtagaagtatatattacgagaataaaagctatacactttaggaaataaactaaaaatcagaaattaaaaccttcaacctttttagattctcaccagctagctactactcactttatactttgtatgctaagttctagagagcaatttacaatggcaacttactcgttcttcttcgtgaacacacttccagaattactaaacgttgtgtttcatgtaaaagtttctacacaaaaaggcttttctaaaatcaaataattctatttttaagtttataggaaccgattaattatgcattaatagattattttattataagtgccgccagttagctgagccaaaatgctcgttcgaacgggcccttggaatctacagctttcaagcaggtccatactccatagtactatgtggctagtgggctatagtggccagtgccaggagcttaaatccaagcgagagcagccattggcaaaggctaatcaaagcttctaatagtctgctgagggaatcatatgaaccatgtcactgtcggactgtcatctacaacgttaaaataagtgcagtcgtgggtattcgtgtctaacgtttgaccgtctatcttatttaaaaaattatgaaaaattaaaaacaaatagtcatgcttagagtattattcatgttttatcatctaataacaataaaagtaatactcataaaaaaatttcaaataagataaacggttaaacgttggacatgaacagtgtaaaagtgcacttattttgggactgaaggaggaaagagtcctataaaaaccaatctaggattagatgtaatgttttctattacaataaatctggttaaaagcctgtttaaattcattatactagaaaatatctcttattatcttaatttgattttttataggacaaaggaagtatgttgttggagattccattgaaacttcatatgatctcgagctggtctagtgatcttgacctggttagtcacgagtggtcgactgatagttgctgccactgttcatggacagaagaactactgatgagatttctagtactatgttgttttttttctcaaattaattcagtgtgctgctgctgctaaagtctgaaatttattcagttgaccctccacaccgatcactaaacagcacattgatgctgcagtgcagtttggccagtcaccactacagttcaggtcaaaaccacacgcgcacgcacacacaagttctctgcactaacagcagtcatgtcaataatctccatgtgattacaatttacaactcattcctgcattaaatttgactacgtcgactgccagatattttgtcaatggagatatcatccaaattaacaaatgtccaatgctgtcatcgcaagctagtgcagtgtgagttgggcggcacaagcaagcaaacaacgagcagtttagacattctgaagcgtttgcataatgacaagatttgatttcgttgtttgttctcaagtgatgtaagaactagaaaacttttaagattcctctaaagaaaaagagaacttttactatcgctgtgatgattcaacaagatttgacatgcgtaaagttaggtattcctttcgtctcaaaatataaaaaaaattaattgaataggatacgttctagtactacaaatctagagctatttataagatatgtctcatcaaaccaaaatatcttatattttagaacaaagggagtaattagagaaactataagagcatgtacaatagtagactataagccagctataaacatattttaagaagataaaagagaagagataagagcagcgggctacagatttgtagccagctgcagcatggactccaagatacatgtgtgtatgataggtgggatcagacattaattatgtagcacatacttaaagataactatggtatgaattgactattaaattaactatatatgatttggagcccataatcggctatactattaatactattaaacttgctctaatatacagtttaatctggcggtaatgcatgcatgcaagaaaaagtgatgagccatatgtgcgcaggtgattgatttggcgtcggttccaaacacatttaaaagcaagtttaatagtatagctaactactgactcaaaattatctgatatagtcaatttaatagctaattcatataatagttatctataaatatatactatattattaatatttggtctcacatgtcatacacatattgcgttttggagtccatgctgtagctggctataaatttatagctcgctgcttatctctcttctttcatctccttaatatgtgtttatagctagtttataatctgctattgtacctgctctaaaaacatgattgtggggttatgtgtagtataataagcatctgcgtgtgaaagttaaattaaaaaaagtatgatcaatctattggaaattgtgtcgatagccaactattatatgtatgatctcttggtcacctgtaatatgacgtaacgcttttaattgttgacagttatgtattttatacactggacccttttgatttggaggaaaaacatagaaattttaagataacttttatcctatagaaaagatttcaaagaatggctttgaatcaaaggattgaatcatatccaatcctttgaaattcctattgaatagataattctacagagatttttgtagaaaacttagcaagagctcaaaactcttagaaaatttcctttgagtttatctttctcatatgatttttttcctacggtacaatcacatggtatttcctgtattttaaattatttgttttacacttctatttctgttagaataatgggtttttcctattaattcgttttcttgttcctactatttaaattggccctaatctctttttttaaaaggaaaattgactctaatctcttactggcgtactactccgtcccagaaaaataaattatagctacgaacctgggcacatatatgttcaagttcgtaactaggattgttttttagactgagagatagttattcaagttcgtagctaggattaggattgtattttttagatagaggggtagtgctgctgctaatagcattattacgttacccagaaaggttaattattactacgtgctttgatcatgattgttttttgtggcagtaagaaaatttcttgtctttgaattcgagtttagtggatgcatgtctgcatattgcggctattgccgtactactcggctactcctgctttcagatcgatttaatgtttggctgagtataaagtttaaattttggttaaaattagagatgatgtgactgaaaagttatgtgtatatgatagattgatttaatgaaaaatgattaaagtttggatctaaactttaaatctaaacagcctgtacagtggccgtggaccaactgaacgtacggcgacaagtggcatggctcactagaaaaagaaaattcgctgtcagcttcactccggatcggacggccacgcctccagtccacgacttttttgatcgcacgtgttagcttttaaaactactctagctcgggtcgcacgtgtgaatggaagctgtttcgttcttttgacctcatcgattttgtggagcaacagtacacgcacgatggaaaacgcacgtcgtttagcgagcgtgtctattgacaacccattttaagagcgagccacggagcaaagagcgtgttcttaatactctggttgagtttatttgttcacgtttttcacttacttctctcgtttttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtagtgagatacggaaaccccaattttgtggggggggggggggggggggccccccttcngcggatggcaagatggggagacggcgtccgtgagagcaacgatacgggcagcgtgaaagagcgccgaccgccgctacttgatggtgcgggaccaactcgcgaaggcgtgatttgtgaaggtgagaaagcgccaaacgggcgtgcggcgtgtgatgtgttgcgtaatttgtggaatagcgtcaaaagtcaaaactactggaacgagaatagagattggtggcggcggcgacaaactcacgggattgattttacggcccgtttggttggagggagtttttaagaggaattggaattagagggatgaggctattaagtattttgtttggttgggagacatggaaattttggtgggattgggatggggaattaaggaagaaactccctccttttcaatacctgggtaggggcaggtaattgggagggaatttctcctttactttgtctaagcaaatctcagccatccgtttttattaatgagctaatctccaactaaactccctatcagtttctatcacatctaccaaacaagacattgggattaaaaatcaaattcccatcttaatctcatcataaattccctcgtgtaaactcctaatccccttccctcaagttaccaaacaagtcttagggttggcttctctttactgatctgtatatatatatattgggctatatgggcctaaatttgattatgggctgtatgccatattttagatccctatattccggggccccgtgggtcacccgcgggtgagcctgtggccccgcccccacccccgcatagttccggtgccccgtccccgcagccccgcgggttgaaatttcgccccgtccccgtccccgtaggggtgggtacccggcgggtccccgcccccaacgggaaaattgccatccctaggttctacagctacagctttttagaatctgaatgaaaatctagattgtttgagggaggatttgataactagtgcttctagaaaaatcttcagctactaaaagcttccccaaacaggctctatgtccgttctttctagtacttcatagaactagtaatttacccgtgctaatgctacggtgtaataatattttgattaataaattatattattaaatttcatgttagtcaaattacatttctagaatcagtctcaaatgttaatttaagacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacgagtgcgcaggtgtggcggtggccggccgtcgacggcgacgcttcatattgaagactactagcaccgtggatgctcgccggccgttttgcccctcagcttgtctgctggcaaagtcgtagactaaacagatggagtagtaaactaaatcacgtctactatttatttttttcctacttaaatattaattaaaattttaagtttgatcgaatctatagaaatgaaatgagtatagctcaactagattacttgtgatggaaacagctcatctgagctcaaatcatagaattgacatatatacttgtatttacggctaattatattttcagtgataggcgacttacccatcgacagataggcactcgtggtgacttcgttaatctcaggatatgccgaccaagtcttctatcgacacccatagtgacttcgtctcatcaacctcaaaatatatcggtctagtcttctattgacgcccgtggtgacttcatcgatctagagatatgctggtccagtcttctggaggtgctcataggagtgggtgtgtgcacgttttgagcgcatgcatttattctgtgtttctcaaaaaatatagtacacgaaacaaatatattatcaaaatatattaaatgttaatgtgtttctagaaaagttatagaaaaatataaaaaaaaattttgacacaaaataaatatattataaaaatatattaaatgttagttttaataaaactaatttggcgttattgaccttgctaacttttttttaataaatttggtcaaagtgaaaacaatttgactacgaaaaaaaagttagtaccaaatatacgcacttcaactcaaatataaacagaccctagtaggaagatgctctctcagatgatgtaataaaaacgaagagctattacaaaatgggaaaaaagatggttaagcatctcgcagaagaaaatgaaaaaaaaaagcctaagcaaagcagattaggatgggccacgggcccacggaccatacgcataggattcaacctgacggcccacatgccgatggatcgggcccatataggcctgttcctaacttccccaatcttaagcccggcccactcgtgagctctcccccgtctcataagaaaccctcgcggagcacacgctgctcccccctctccctcccgcgccgccgccgccgccgccaccgccgcatcgccgctgccgacggctgcgctccgaaggtatcgcgtcgaaatgctcttcgtctcgcctctaccaccgccgcagatagttcttgcagcgtctatgcctctgctgccctttacatttccctcgagcgactagaagaattagggcgggttggtcgttgcggcggtcctaggctagattcgagaagaagaagaagaaatgccggagatccttgagcttgtaaatggggatggtttcttcttcttctctcttatagttgatcttgacacggtgtagtgcggtgtatatacatctgttgctactcctttggaggcaggattccggttttcttgagtatgtgacaccgtggtgattccgtttgatttgatttaccatggctagctgcgcttctttgatagattctggattatttgcctagatgcgtgtgaaagcaccggtactgaggcgctatggccattgtgatggccgtagcagcctattcttttgtgtgctatatgaaccagggaacccgctttgcaggggagatttgtcccatgtttcttctgccagtagtcgcccgacagttcacccctttctggggttctggattacctgtagtgtagtgcgatgtatatacatcggttgctactcctttggaggaaggattccagttttgtggagtatgtagttattctgtttggtctgatttatcatgactagctgcgcttctttgatagattctagatttgttagatgcgagggaaagcaccggtactgaggcgatatagctattgtgatggcgtagtagcctattcttgtgtgtgctatatgaaccagggaacccgctttgcagggaaggtttgtctcatgtttcttctgccagtagtcacccgacagttcacccctttctgggtttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggaccagggtagtatccttgcagcaggagctaagctaagttgattatgcttctactgcctgtagaatccctacatttttaatagttaaaatttgagatgattaccctgtctgtgtattgtcgatatcttgatgtaggtttttaatgttccatgattacctctgcacaattttgttttctggattctagtcctgattcctttttcttttgatgttggaaatttggcagaattctgtgaggatttaagctgagaagatggtgctgaagtaagttcctgtgtatattttgttgtttcaatatgattgtagattgttttagtgcccttttatcctgtgcatgctctaggctatgtagttttttggttaatggtagtaaaaggttaatagcaatgatttaccaatgagtactatttcatatttggaaggtatttcaactattacttttatttttatcctacaggacagagctttgccgttttagtggccagaagatatatccagggaagggcattcgctttattcgtgctgattcacaggtcaggctgttcatcgaatgattgctttaatgtcaggatatttctctgcttagaaggttgttgtaaacgtattggtatattgtacaggtcttcctttttgcaaactcaaaatgcaagcgctacttccacaaccgcctgaagcctgcaaagcttacctggacagccatgtacaggaagcagcacaagaaggtattgtatctagatttaggcgggcgttttctcacctatatgcacatactctaactggatgacctttaacccttttttttttgttcactgaccgttgctttcttaaatttgttgggttgagccgaatgcttaaaatttgtaatgttgtattgtgcttgaaatgctaagttaattgtttcttaagctatcaaacctggattccagtaaatgtctgtttgtatgattaagtgtgaccgtctacattcaagattgcggttttttttactgtgcaaacatcatgttgattcttcaaataagcgccttgcagtgtttgcgtgcagataaaaatattgtatgtttgggtactttggttatgtctgtgccatgtagttctctttgtcagcttatgctcaattccttgtatatatgtacagttagtcatgctatgtattgcttccgatcagataaattctgtttacaccctttcccaacaatctgcattttaggatatccatgctgaagctgtcaagaagaggcgccgcaccaccaagaagccatactctaggtcaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtctgctcctagtgaactctctgttcatattcatgcataatcccctattgcatcttgtgtatgcataatcctccgatatacatttcgatgatgctaaaggactaaattcatctgagcttatgcattgtgcagtgagatcaaggaacgcatcaagaagaccaaggatgaaaagaaggcgaagaaggctgaggtaaccaagtcccagaagtcgcagtcgaagggtgccgccccgaggggttccaagggcccgaagattggtggtggtggtggaaagcgctgaagatttcttgatccccaggaaagggtcgcctggttctcgccggctgtctaaatcgtatctcatcaaaagctaccctgtagaacctctgttaaattagcactactgccaaaatgttttaacatcgccactggagataatgtcatgaagtttgaaatgctatgtgggaaaaatgtttttctttggttgtgttactattacgagatttgacttggcttaatgtttctgagcaaagtttgatgctgcttggcattttaatcctcttgtgttttgttcggtaaagagcattggtgttcatgtatcatgatctgaatgctcgttctgaattgacggccctagaaatcccatcgtattatattctctacagaaatataggcttttgaaatcctgttagtagcgttaaaagcgaatttgacttttaaagtttcaccattttttgcgaacgggtagcaggaaagctaaagtacgttcccttcaaacaggctagactttgtagtgtccgagtggatttatttctctttccttatttacttgaaaaaatattcatgtgttgcaacgggtaaatgctattttaattttattattgtttacggtttagttagataaaattcactgtgggaagtcgtttggatatttttttcaggaaatcatgagctacaattaggttcgtatttcatctcatgctagcatgcgagtttttttaaagatttcttatacgactcctattatacttccaaaaggaaaacaatcttaaaatctaactcaaacacgcatctgtatttccaaaaacgaacgaacttaaaacctgactcagatacggatgacgtaccaaaataccagtaaaaacatctttaagttttaatttttataatagtagatatttctctttctttatccaggatttttgctatatgtatgagacttgatttcgtatttgatgtattaagtattgggtatcccatattcagggcattaacagcatgcatcatataagttaattttagggcattaacagtatgcatcttagtataagttaattttttttttttggtcttgcttaaaaaatagtaaatactatctttattccataaaatcaactactgactatgtatttaggttaagatatacaatcaaaaattggtttttatgggatggaagaagcatgttttagacttcagatggaggaagtactccctccattccaaaatatgcaggttcttgaatggatggaacacatcacaatagtacaaatctggatgtcttaagaatttaaatgtctattcaaatttacagtagtaagatgcgtcacatccattctaaaaccctttattttgggatgaaggaagtattacttaacatattactaactgtattacgatggaccatgctactctgcattagagacgttgtaaggcagaggatcaacatgattactataaattatgggagttggcagccatccgatcaagggcataaggcctatatatctcaggccgagtttagctctaaatttaattttttcttcaaacttctaacttttccatcacatcaaaactttcctacacatataaacttctaacttttctatcacatcattccaatttcaaccaaacttccaattttgacgtgaactaaacacatcattactacactaaataaaagtgtgctacaattttcatgttattgtagataccataaatcgacggtattcattacattgatccactgttatactcacatacttcctctatctcataaaaaaccaatttagtactggatgtccagatttgtagataggatgtgtcacatccaatatgttagttttttatggacggagggagtactccctccattaaaaaaaatcaatcttaactataaatatagacacacgtgttcaaattcatagttggaccataattttcatggagaaaatgaacatttggccacgttcaaaacacggtttcgctagaatgccaccccaaaaacacggttcgataaaatgccaatacgaagcgtgcatctgttgtcactttgccattttcaccattttattcatttccaaaaagattttggctcctccgctgggtaataagacggaactgccccttatcaccctacggcgttgatattcttccccatcccctttcttcccccactctctctctccccttcggcatggcggtggtggcagtgcgagcggtgtgtttcgacaaagggagtggcgcagggacgaagcagcttcgagcagagacgcggagctcgctgaagatacatgcgcggggatgagctagagcgccatgaccactgcgagcttggcgcaccctttagcgagctcgagctcgagctctactcgtgtggaggtggaggtcatgggcgatgtttttgtcagtagcgacgacatcgcacggaacctcatcattgactatggctctggcaagatcgcgctcaccgccgcgtgcatccacttccgtatccctagcgctgccctcaactcccccttccaccactgcgtcgcttcggtcctcccaacaattgctttgctgtcactaccaccgaagaagaagccacttccgccgctgtcaccgacggcggttgctaagaggagcccacaaccccctcagcctttcgtgcttcggccagtgcggcggtgtggcccctcctagccaacggagggaggcgcaagaagcagccggcggcggtgagggcgtgaggcctttttttttttttttagaaatgctcgatcccctttcacttgcgagatgaagaaaaggcaagccggaggggtattttcgtctgatcaccacgtgaacagcaaaaaaaacatttcggaaatcatgaaaaggcgaaaatggcaatgcgacgagtagcgcgcgctcgagattagtattatatcgaattacgttttgaggatgacataatagcgaaatccagttttaaagatagctaaacgtttattttctcatttttcatgggacggaaggcgtaaacaataaacctctacaataatgcccaggattcggatctcattggatgtgagaagagagagacagcgagcaaagcgaagtgaactgactgtgaagtgaccgcacttcggctgcattaactgcatcgtctcggctaggctagggctaaacacgtccagagaccaaaacgagtcgactcgtcgtcgtcgtcgacactcgagaggcacctgcactactccactcagctcacacgcaaaacgtccgcttcgtctcgtctccctcctctcaaaccgcctcgtctctcgcgccctcctcctctcctctcctcctctcctctcactcgctcactcgctcgccgacgctgcccgaggcggaggcggcggcggcggcggcgaagaggccgtagcccgcttcgctcggcggatcgcgcgcgcgaaccgggcggtggaggaagggggagggggagggagaggggcggagagcgccatcgccgaccaggtgagcgctttgattcccctccttttccccctctatttctgaccctccggctcgcacgtgtctccccctcccacccaccatctccggtgtggccggccggcagatggtcggcggcgacgacgacggtagtgtagtgctgcgggtacctacgcttccccgaatttaaattttgtaacctaattttggtgttgattttagggttctcaccatagtttatttccaacggttttccctgaggagaaaggagaagacttggaatatacagtacgtaaaacaagctgaacgcctgaactagtacatgattaattagatattaactattttaaatttgaaaaatatattaatataatttcttaaagcaacttttctatagtaaatatttttcaaacacgcactgtttagcagctcgggaaatgcgcgcgcgaaaaacgaaggaacccttctccctatctgccactcttacaaaagaacacagcaaaacatttcattgctaagaacagatataaaagttttacccacaaattattttgagtctattcaacacgctgcattcatttcattagctgcatatatatttgtgtactattgctacaatgatcaacagaattagcagtgctatacgttttgccccctttcgaagtccaaaatttggcgctcttctgcctcccaggaacccctcctcgcttgattgcttcgacaactttaagcagtgatcattggaatataactccactgtgaatggtgcgagatggttactagttttttgtcagtaagagatgcatgattactcctgtcctgcccctgaatcagggttgcattgtaacaacggacatataaacgcaaattgaatttcctagtaaagtgctaaaggcagggatgtgtttgccaatgaattttctttgcaaatggtctagagtttggattttaataatgcgacgagttttgtaattccaacttgaattgatctcgtttttacaaacaagactattgaaaaagttagggatatgctacttatgatttgattaatcaattaatctgggggagctatttaaataatgatgggactaatattgtccagctgtgctctcagcttcaccctactctcatgctgccttgtagatcatgagcacaatggctgacagcgtatttggagaaagggacagcagtaatctcgagattcttcaacgaagtcatatgaacagcaattagttgactaggcaaagcatctttctgagtaaatcacgtcttgttagggtacttcagttgtctttcccagatctcttgtaaaattctttcctcaagtcctgcagatttgcatgctcaaggacaaggacctacacattatgtggtggttcatgcaaaaaagaaaaatcaagtttttctataatatctacacatatactcaacagtttgactgtatacattttttctattatagaataagacagcattggctgcagagggttcaaatgagaaagctgcggtagatgcaaatgaagtttcattgcctctttctaatctaagcaacactcgacaacattctgatagagaaaacaacatgcctggaaaacatggcaacgatggcatgtcaaaagacatgggacgtgctactagattgaagagactgcaaacgccaatcaacttatttgaagatgaatgcgttttctgccattcatttagaacacctcctcaggtgaaccatgatctattaaccagaggttatgttttgaggtcttcttaaccatttctgacactaaaggtcctcacttttcctatttcagtttcatggtccaatggcgcattatcaaaagggaaagcttgtgtccagtgacaatggcagtccatgcccaacagatatcatttatgttcataagaaatgcctggagtggtaagttcctaaatatatttcaactcttgatgcttattcaccacaatttagatttatcatcatgcgcttccaatgcaggtttaagatacaaggatgctggacaatttttatttttatttgttgagatctggacccttgtataattttttagtttaataccttattggtttgctttataagacaaccattccatttgtttaattatgtccaaatattagtcagtatgatatatagttttagtggcatgcaagaattaccattttgattcctatttcaaagtaaattcacatgatatttttttttagccattaaacagcctattcaatgtttgagacgtgctaagtctaaccatacctaataaaaataaccagtggctggagtggtattaaagtgggtagttgaggggtgatggtgcgttctacatccccctccctccatcccccatcataattttgttgtttgcatgatatattcttctgcaaaaagttgatttgtttgcacatgtgtatgtgtagatggttgattgatctcatgtagtaatttttcaattttctagatttggagacaattcttatttttagtatatttagctttacattataaactatatttacttcttccagtgcaacagttggcactagctagttactctcaaaggactatttcttgggtaaattgtttgtctttccctacttttttcttttgcgaagggccccgcaagtattttacgaaggtgataccattgtgaacttggagttggaaataaaacgtgccgcgaaattgaagtgcaaaagatgcaagcttcctggagcagctcttgggtgttattatacaaagtgcaataggagctatcatgttccatgtgcaatgatgactttgaattgccgctgggatgttgtaagctcttgagaatattgtgtaatcgatccttttgtttgtgatattcgtcaccactctaatagtctaatgttctaagctccgagatgctaattttcattttgcaggataacggttgtgttatgtgccctgaacatgcaacgatgccactaccatgtgataagataagctcgccaagaaatgagagtggcaattcttcttccttccctcagaggtttttccatgaataagaaattgttattcaatcttattgctttcttggaaggttatacaaaggctctggtatttgattaatcattgatccttcatttgtatttttctccttgattctgtgttccagccaatcgtcaattgaacaaagcgattccgctgattgcgaatgggaatatcctataatagatcaatggaacacatcaagttctttgtctcaagggtatatgacctttattcacctgccttttgagttactttgtaatcattttatgaattaactaatacggagtaaatacctacaacattctcttttgccttttgttgttccagacaaagttcacccaaagaaggaatttctgctgttcctaaaagggaaatagatcaacttaacacttcatgttctttcttttctgaggggtacacaatcttttctaacctttcttgttagatgtctttaaggttcctgattctttgatcaattgtagtcttgcattccataaatttgtgttgtatttaatcattgcagccaatacttggacaaagaaggaatttccactgacgaatacaggaaagaaaagcaaacagatcacctttacacagaaagagattgcccctcggatctgtgggttttgcttggttcagctttaagtgaatccgagaaggtaggataagtgagaagtagcaaacattactctttttttgtggtgaacaagtatacggacaaacaatgctgaatcctacttcatggataattcaacatagtggatgatttgctacatttatgaagttaactcttccattccagcttttgtggtaaacatgatttatgtttttcaagcaggattccttgcaagagtttgcgtcttggacagatgcaactgtggtcaacgagtggactgaaaatgtgacccatgttatcgttggaaaaagtgctggtagtgcatggagccgatcttatgaggtcctgatggctcgactgtttggaaaatgggttgtcacggttggatgtcagtattgagctatcttctctacagttctctatttcttttaggaccccaatttgagtattctttcctttacgnttatattgttggatataccctaagatccctaaggccattcaaggtttatcataaatctgcagagtattatctattcctaagctgaagtgcttcgccttgctctttttgggattatggattgcttggtaaagtttattccaagtccagaagcttcctttgagttaagatttagccatgactcacgtgcatcaattggtggaaacaagaaaagaagaaatcaagcttctgaaggggtacatatacatcgctggctataagattagacttattttatgtagtgaaaactatcgtaggctgtcacttgtataagcttaggaatttgatttgcaaatctttcccagtaatattttcttacaggcctagctacaactgggtacaacaatgcataaaaatactttttacatatcgctgttcaaagtcaaggtgtatatatctagtgcataactccatatattccacctgctttgtgttgcaacttacgacatttcattctttagagcaaattttctgccgcaacaatctccatgatgataatgcgatgctttcaggcacagaagttgttctcgggactgaacttttgcctcagtgcctacataaaccctgacgacagacaacacatacagagcctgattgcagctgctggagggcagatactggagacaaacggcggctcgcatttgctgcgtgaaaacctggagaaagttgctgtgaagccatgctacttcgtctacgacgggggcgctccaagggatttcacccaaggattgcttgatgatctccctaaggagatggaagagggcagagagtatgctgcctgtggagctcaggtgatcagccatttgagggtgtttgatgccattgcggcttatgatgcacagattctcagccacaaggatcacttcaccccggatgtgtaatggcgcaagctgtgactgtacatggtaaagcatatatccatggctagttgttggcaatttgtaggtgcttttggagcagtgcccttcagatcaaatctttggcactgtaggacagtaatgctgttgtatatatataaaccattcgatgtttactgacacatctggttagcctgatattcacctactaagagcaggtacaatagtggattattagccggttgtaaacattttaatgagataaaagatgagagaagagcagcgggctacagatctgtagccagctgcagcgcgaactctaagacgcaatgtgtgtatgacaggtgggaccatatattaatagtatagcaagcaactattgtataaattggctattagattggctataaatgaattggagttaggtcctctttgtttaggcttataagccagcttataagtcgaaaagtctaagtcaaaacaaacaagtagcttttttttatttggcttttttgaagccataagccactctaacactattaagccaaaagataggttggagaagcttttttggcttttatgagatagatgtatgactccaccactaaacttaggacattaaa

SEQ ID NO: 4252 - DNA, 11168 bp, Oryza sativa
agtgcgatggaataagaattaactttaattaaattcaagtaatttatataaaaataaaatatgtgtaatgttaatctagggcgaatcttttggttagagcaacacaaatattgagtaaacttgatttgtgcaaaagttagaatttatagggcgagatttaaatgaaaatagactaaattagggttaataaggatctagccctattcattgcctacaaggtgcttgatgtaatcctagcctagccggccccgagccccgcgccgccgacgccgtcgcgtcgccatcgccgcgcgctgtcccatcgccgcctgccgccgcgcgccgtcgccatcgccgctgccgcgccgcgcgccgtcccgtcgcgccgtcgcgtcatgtaacatactgaaaatttgctattttctaaatatgcatcatgccgattcttatgttcttaataacttcctaaacctaagaaattataattagagggacctcctaaaactaacctgtataaaatccctctttggtatttaaaatctttcgtggttttattctaaaaattgatcttgttaaatcgaggtattctctttgatttgattttgtatcttaaaccttctttcgaccaaaatttcctttctttaaatttagtttaaaaatcctttttacttttatgaatcatggtccaagaaatcctccaactatacctttgaacctaaacccaagcaattccaatttcattggaattaattgtcgacccatcctttaaaattctcgatccaaattatttctttaaatctagcgcgccatttaatttccgtggcttgatctctttttcagcgcgagaataatattattatgaacaattgctcctgtgttaagagaataaactttatccctccacccggaatgcaaaacctcatttagcccatatctaattctttaaattccatgccatatattttgggctaaaattgtatttactatactcccgtcgcctcgcgccacgcgcttgccggctcgcgccccgcgccgctgccgcgccgagtagacgtcgcgtcgcctgtcgccgtcacgtcacctgttgccgtcgcgccgagccccgtgccaagccgtgccgagccccgcgccgagccacccacccgtagagtcactgctgccgtctgccgcgccgcgcgcccgtcgtcgtagccgtctcaagccccacgcgccgcgcccacgcgtcgccattagggccggccacctctccccgcgccctataaatcccctccccggacggcattttaccccgcaccaccccaccttctttttccccattttcccctctttcctctccaccgcgccgccgtcttcgtgccgccgcaccaccgccctcggtgccgccgcaccgcgtggagtgccgcgccgtgcgtcgcccgccttgcgccgccgccgcccctccccttgttcggtcgccgccgccgccccgggtaggcagtgagccgagagagagaggaagggagaagccgggagggagagaaaaagaaagaaagaaagaaaagaaaaaaaagaattgaaaagaagaaaaaggaaaaataaatagaaaattagggagagattaaggaggtttggaaaattaaataattggggttagttgtaggtttcttttagttgtagaatcacaaaattttatataattatagaatattttggtaatctctatacaaaatcaattcgtggtagaaatttagatttatttaagagctaaataattatgttgaattattaggaatgtacttctaaatcacaaaaaaaaagacttaggatgaatgaacttaaaattggaatgaagtggttttgcaaactttgtagtcgatatagaaagatcgattcgcgttcgacttttatttaagtttatttggatttcatttgaattctaattgaattcaaatcaattcttcgcacgtacttttagacccgagggagttgcggatccgagcgaggatcaagacccgcaggactacgagcaatgcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttagaaatgctattctagaatcatgcatactcatatttatcaaatgctatattcttgggcaattatctttgggaaggtaattgagatgcggcatgtggagacatgagcgccacattgccatgatgttgatgacatgatttgtgaaaggagaaataaaattaaacaactgttttcgactggggcggacggaggatttgggtggtgtccggaaaaggctagtgccgtccccggtcaattaagaaccgagccatgaagttaagcatgaaacgaccccccgtacaactgcatttctcatatgggtatagacctagcgaatagatagctgagcggaggcgacgtgcgggtgcggtgcctcgccgtggcgaagctgagcgtcaccgttagctcgccggccgacggcacggcgaccaccgtcgccaccgcggcggcctgagcagtagcggtatcggcggccagcatcagcttcggaggaagcgggatggactcctcgtggatgacaatcccgtcgccgccgccgtcaccgtcgccggcgatggcgcggtagacggcagccacgctctggaagcagctcgcgcaggagtcgcccaggaacacctcgacggcggcctcgacgccgctcttgatgaacatgtagtccatgtccagcgagcagattgggccctcgatgcgtgacctcagcaatctgccggcgctgcaggtgatcgtcctgtcgacgaactctttgcacgcgtcgaccagcacgtcgtcggcgtcagcgtcggcgccgtcgccggcggtgttcttcagcttcaggtcgaactcgagcaacacatgctcgaacgcggagatgccgcgcagtggagatgacagctccagtgcaggagagctctgaattattccaaacaaatcaatttttttaaaaaaatcgaacgtgtttgaatttcctaaaatttgttcaaattcagccaagatagatcctgttcaaactcaaaatttaacattgtcactcaccagtgtcacttcctgggcgttgtcccgtgtccggttgaacacaaagttgggcagcccctccatgtcgtcgcgggcggcgacgatcccatagacgagcagccgccgcccatcaccgccgctgccggcgccggcggcgaggctgagcgagcagagctgcagcatgttgtcggcttcgtagtcccagcgggggtgaggggtggtgaacctggagcggggcagcgatgtcggcgccgtctcgtgcatccggtactcggagtgccacgagaggccgaagaagccgtcgcggtgggaggagccctcgaggacgaaggtcggggtgtagcgccgctcgccggccggcagctcggcgttcagcttctcggtgagctcgtagccatctgtgtaagggtatcgttttatcgtggctcctcctgcaagacaagaaatgttcatatactccatttgtcctaaaatataagtatttttggactctggtacagtctccgagatgctactttgactaacaatatctataaaagttattttaaattaaaagagttgcacattatgatagtatgtttaataataaatctagtaacatcaattttacatgattgatctttttttattattttactattaatggtcaaagttaaaaatgcttatatgttggaaacggagggagtatgtggcaagtgttttaaatttgagggaatataatcttgtttgtttaaacatcatataaatagttggtaaatctttttataaaaaaacgacaacattaataatgtatatataaaatactctatataaaatcaagttaaaacttaaatcacccatctaggaataaaagaatcaaatcaaagtgctctggatttatctttttttaattctcaatatgtaaatcgaatttgaattatatttttttggtggtgataaaagttactataatgtacattgctaacaatttttacagctagaggcctcggttgttggtcgttctccaatgccattgtgtaagggctggcatgggttcaagggctttcttgacctgcgtgagaaggttttattctacacaggatgtacagggtctattttgtctttggtgggtcaagttttttttttaaaaaaaatacaaacattcacattgaatttgaaaaaaaagaaaaagttacacgaggagatatccttcgagggtttagaatcctgtcccaatatttgacttgcatattatgaacaagaaatttatactttggtgctgcttgcaatggaggcacttacgaatctcatattgaccaatccgatattcagctaagtgtttattcaggccttgcagctgattatcttcttcctcctcttctgctgattcttcgtggtgatcatcgtcgtcgtcgtcggatcggaatagccaggccgggatgagagccttgttggacggcttcttcttcgtcgtcacattgcagcagtcgcaggtgcagcttgagcggccggggacggtcagccatggctgcctcgtccggtccagcttcatcaccggcaccatccggtcgatctccgccatgtcgaactcggcgtcgcggttgcgccgccgtcgccgacgacccatcgatcggcgcctcggtgatcgatcggaaagcaagcagaagcgaaaggcgaataatatgggattaattcggatccggccttccaaaggcgatcgatcgcttcttccgtttgcctaaaaccgagagggactccgattctttgcaattctggttgcgaattcctaagaagccacggctcatgattagttgtagacttaaacttgtaataactacagtacacttgctagttactagtagttactacaccgcaatatttgtacattagttacttcatttatatcgtacaaaaagaaacacaaacagctcaggatcaatatacaggcattcctatacaccataggagactttgtagctcggagtgaaagtaggtgattgaatggcttgagaaacggctggcaaattggaaggcaaacttttattacttagagggcgactgacactaatcaatttagtgattatcagcctatcaatatatatgatgttcttttttgaaatacataaaggagtgatcaataaaattgattattttcaatcaaggttcttttggcaagaggatggacacaaaaggaaataccgactagcaaggtgagacatcatcgtaaagatcaagggggttgggaattcaagatcttgaaattaagaacaagattctctttagtaagtagttgtataagctactcactatagatggtgtgtggcaataaatgctaaggaaaaaatatttggagtcacagccttctcattggaaaacaagagagtcacacttttgggctagtctaatgaaggctaagcctgattttcacatatttgactctttcaacatcaaagatggctctcaagtacggttttgagaagataaatagttagggaatgcctatttaatagaacaatacccatgtctttataatgttgttaggcataaacatgcaactatttcagaaattttccatactagtctgctaagcttttcttagcgcagggaccttactggctctaagttagtggcgtgtaatcaccttctctcacacatcgctaatattatatttctcacaaccaagatgagtttaaatggaatctaaccactgatgacagattttcggttaaatctctatatcttgtgttggtgcataccgatgttcccaatataaattaaagaatttggaagattaaagccccataaagattaaagattaagatcttcttatggtacttatatcagggagtagttttaataaaagataatctgattaaaaggaatgggagaggaacttgttctttttgtcgtaaagatgaaactattaatcatttattctttgattatcttgcgcggtttggtctttaatccaatctgcttcgaatattagtttacctaatagtataactcatatgtttgggcatttcataagaagacaactacacaatttgaggcatttggtcttatttggggcaactgccactatttgatctatttggctttgcaaaaatgatgtgggttttgaaatgaaaaacatatcttctctgttataggttatattttttttactacatataggctctactcatgggctattctccagaaggtcaatttgttgggtaccatcactgcggcttgccaataattggagttagtggccatggagttttctaccctagcacatgggtggagttctaggctacggttagagagttcctaaagtttttcggttgtcttggatgatgatattatcttttgtttctttcttgttggctgggtgcactctttgggtgcatacgccagagatgctctcggaataattttatattatttactgagataataaaacttccattataaaaaacaatatacaatggcgaatagtgacagctaccgagagccacacctctccgcggaaaccacatgggtggcttctcattggatcatcctaagatgttggaagacattagcaggcaaggcaaccgattgatgaatgatatgggagcggtgagagagtagccccgacagcagaactctcctgctgtgcatgtcaatcctgcaaacgtgatatagttgggggtcattttatgtcctgagcggcttaggctgttcactttagtgccattttcaaccttaccaaatttcggtaaagttgccaaaaaatggctacatttagtttgctgccaaattttgataactatataagaaatcctgccaaaattttggcatagttaataaaattttggcattgccaaaatgacattgccaaaattttgtaaggttttttttggcaacaaagtaaacaggccctaagaagtagagaacaacaccatcttcccgcagcctcacgaagggccacgtgagcaccatccggggcaaccgtgacgtcttgtagtcctcctacgcccataagctcctcatgtcgagcgtgtctcaagtctcatcagctgatttgtccagagtccatatggccaccgtcgcgttggctgcttcggtggcggcgtggcacggtgacgatggcatgtcttcttcttctttcgttgtggcagcggcaacagcgatgcgggcggtgttaacggaaacgagtttgatgaagttgtccaagatgcctaggtgtggtgcatctccatacatccaagcttctcggatttgaaggtgtggagaagtaggtactacggggcagacgcggatctgacatagggccccgctaagggatctcagccctcactactggcgttaggaatgtgggagccccacctgagctcttctacaactatttgctccacatatatagaaaatggaggtttaaattttatctaatttattcagccccacctgcttttttttttttggatccgctactgtccgggtggaggctgacgtacctgagatcgacgggtggtggtgagccgcctccgtcgccggtgaagacgatggcggtgtcgcagcacatgaagccctgcgagagatccgcccagaatgtgttgccgtcgaacgagaagatggtgtccgtgcagaagaatcctcttgtgtgtccactgttcgctccgccacaggcatccgcggcgtgcagcttgcaggagaaggtgatcaccttggtccagcggcggccggcatgacatgatggtgttcatcttgatcctcagcagagcctcgtcggccgcgccgaaggcgaggccggagaggaggtcgtcgccggcgccggcgccgaggcgcgcgtagagcgtcaggccatccacaaccaccagcgcctggccgatcgagctcgccgcagccgaaggcgtccatgcgcgagcactcgattcataccactagcacgcgagccaaacccaatacggcaacttttacctgaccaccaccatcggcatcggcgatgtgtcgtccttgtcagatcgttaccactagccagttgtctgttgcttgaatcatactttcttcgtccaaaaaaactcaacctaaaaaggatgtagaaggaaatggctagattcatgcccagattgagtttttttttggacggagagagtaagttcacaacatggcaaaattttacctgaccaaaaattatcaaagtaataataaaaaaaaaaacaggacaggagctgattcaagatccaaaatgtcggtgcctgataagtttaaacgacatatctggtacggtacaggtaaaaacaggtttaaacattcaaaacattcagtcatcacaagaccgaaacataattaaaacggggttcaactttgtttcaaaacttaaaaatgggtttaactgattgcagccaacgaattatgaaccgcggtatttcgcagctaccacaaacgccggccatcgcaggagctccgatccccagaaccagcatgcataccctgttcagaggaaattaatgtagtttaggccaccaagtaagttaatctgaacttactatagaactaaacaagttcttgcagaatcattttgtgagagttaactgtaccttaataataccaacaattgatccaagccatgaaactctaatcttcaacacggagaacctactgcaatggctgcaaatgcaaacttacatcagaaaagggaattatggcactttttttaatcataattatgacactattttgacattgtgcacaaaaaaaacgtctattgggactcccaaatctgaccttgtttattcttacactaccattttgggtggcaggattttgggtggcaggaagaaggggaggaagggcaggtatcttctcgatatcgtcataacggagaataaagttgtcctgcaaccaactttcagatatattttcttctgctatcggaaaaagctgaaaatatctgtcagaatttctttcggacgtttaccttaggaattgcatcccaaatgttggcatcaaaaagatagcagagtccttgttcataagttgtagttttgacgagaggggtcgtattaggagctcttttaacccactgacgcagctctttgtggtaaacccacccgtatttgcatctgaagaaatggaagcaacaatctgagctatctggcataccaggccatcgttttactgaaaatgacaggcaaatgagaaaacaatatagaactgtggttttgtgcttacatttcattcgcggcatataactgagctgcatcctgtggcatactgcacaaaagacagtcaaataatgcatagcctactaacacaggaattcactgttgattgaactaagtacctgtagaagatgtagaatagtgtcatgaggtgaaacctcagaaaatgcaacgcctgcagaggaagataaatcgtaatgtcagatacaacaagattaatgctaacctaaacattccctcacaaaaagaaaaaagaaggtaactcgaaaattgagggccttacttgcaggggtggaggctgcatagaagagtagcaatccggaatttcataagaatactcttctttaactggctcacttgaccaaggagagccaaatgtcttgtaaagattatctgaagagttcatatccaaccctagtgttgtcaaatcaatccctaaagcaagagatgccggtccctcctctttcaacttcattaccctcagtagtccatgtaagccatatggatcatatggatccggtgcggtatcagttctctgagaagacttgggactctgaaccttgtgagactctggtgcggtatcggttctctgagaaggcttgggactctgaaccttgtaagactctggtgtggtatcagttctctgagaagacttgggactctgaaccttgtgagactctgggccggaagatgactgcagcctaactgacttctgagcctgtggttcatgattttgctggataacttgttcacgaggcctcggatttaaaggcaaccttggagaatttactggctttggtccaacattttcaggcccagtattttgaacctaataaacacaatcagtatggtcagtccatatttgaaaagctcagcaggcacctgctaccaattattttgtaggattcttacttactattccccataaagaaaaggtacatgaacaaaaaagagtcgtgttcaccaatggtggtgttttcaatcttgactatctggtcatgaggtaaaagaaatcataatacaggtaacttaccgaattagctgtctgcttatgttgtttacggggtggacaactgctgcccgtgttaaagccagatgatttgcccatctgtagaatcacatgtaacggaaatttaaggaaaaggagataaaactgttgttggaattacaatttttatttttttagaaaaaaactcacaggataatgttgtgcttgcataatatttgcattcttaggaagatgatccttgcgatgcaactccataccttacattcagagcatgaggtaatgttcaaacaaagtaccaagacataataaaaacctatagcatgaggtacttggcaaggaactgtctgaataacatatagaattaaataatgaaacaaaaagtagagtaagagtaccttccaatcttggtaaagctgggaagtcctcattatggattctaaattcctggttttgctgaacagcattaataccaaatgcttgttgtcttagaggtccttcatttgttataaaggagaaaagttagttaactaatattatcattcagaatatttagtttgcatgtcagcattaccatataacccctgaatatttccagcagaattaggtcgcccaactaattgaggaaaatcattgatgtcaaatagagaattttcaccaaagttaccatcatgtcgcattcctggagaaccagacgaactgcttcctgcctgcaattggttcttagatagtgttcctccaggtgctgaactagagcttccaagcatattcatagccgccaatcctggtaaataaacaatttgaaacaaaactgcccttttatatataagaaatgagaacgttcacattctt

SEQ ID NO: 4253 - DNA, 16131 bp, Oryza sativa
ttttcaccaaagttaccatcatgtcgcattcctggagaaccagacgaactgcttcctgcctgcaattggttcttagatagtgttcctccaggtgctgaactagagcttccaagcatattcatagccggcaatcctggtaaataaacaatttgaaacaaaactgcccttttatatataagaaatgagaacgttcacattcttactaaacacagtaagttctgcacacgttttagttgcttcgtttgattgataaatgtaatagaataagcacattaacaagatggatgagatgtcagtacagaataaataacagctagcagaactatggcaaattgcctcaacagaatggtgtacttctttaataatggacccaattaacacttccattccccagatcaggtaccggtcaaatatgtgcttccttattcttttttgctccagatgactagtgtacttcataggcttaatactcagtccttttttttatatggcgttggctagttcaaaattgaaccaaccaatgtcatataaaaaaatagggagtatgtgatttttaatattatttattttagatcatttcattatcaaatcagaaagaaagacaaattgagaacatatgcgcgtgcatttatacaaggggtttatatgtttagtatataccttgttgatgagtaccacccatttggtttgatcctcggatattaagagccccacttccagacaaattcacaggggatgcaacagtaggcatagacattccggcagagcttatggttctcccaatgttgcccccacccgcaacgctagccacataagttattcgcgggccaaaattcccacaaactggagcagctgccaatccaagagcagaattgtggttaccatctttagtcaagtacgaggaggaagcttgtattgaaccatcaattgcactcatgttaccagtaaaaacaggacttcccccaacatgcatacctcctcggttgctgagagcaggatacccgacctacaaaaaggatgaaagaaaatgtgagctggattagaagagcttcataaacagactcgagcttaggagaggaaaaaagaacctgataaatggatgcttgaagactatttggaggaaaccaagcaccagaaatactacccctaggtggttgaaccccaagggatgaactaccagtcattgaggaaccccttggtgctagtgaacctgacatgtttctaagattgagattcccatatacaacccttccaagtttttcgtgagagttagttttagaaaaacatcactttctaacatgcacaaacggactagcaaaataaacaactgtaatgtcactaaccaggatgacgaaaacctgaaactgatccagattgaccagaaaaggtcggtgtcaacggctttcctgttgagactggaaggtttgatctggcaccactactgcttgactgaaaaagtaacaagacataagttaacctataattgtgacattttaatatgcatttgtgccaaaacaaaataataggatcaaattttaattataatatagacttaaataataaatcatagctagtattcaaagctgcttttcactactctaaagagcactaataacaacaagaaaaaagtgtccttcaacagcatgattcataacactttgttttgatttcagacatagtttaaggtccttgtgaaatagaggaactaaacaaagagaaggtaagttacaagaatacagtatccagaaggatacacaaaccaccaataaagtataaacaggctcgtgagtctgctaatctggactgcaatgatttattgaaataagatataaacacgtaaaaaaattatgatagtaaggatgagggccttctgaaaacaactaaacaaggatgagagcacacattcagcgatcctgacattttgatgatgatcaaagaacaaacaggccaagagcaagtcaacaatattctaccaattccataacaccatttatcagatctagagttcaagataagacaataccctgtataggcaatcctccaaaatgcaggctatttttcaaggaacaaaagggaaaggattgatgtattattgaacagacgatgtgcaatggatgcaatgcaggatccaaaacctgtttaaaacataatcataagaagatgtaaccactctacttgggatctcatgccgcagaggcttgttttgcttcgcctgtttacctatctcatccaactgccatgtaagcttggcctgtaatatttcctccaaggtatatatataaatctctctagggttcttccaaatcccctcaaccaaattacccacaaccgccgctgccgcggacagtgtctccatgctcaactattccaagattccattgtttgccgcctgctcaagccaccctagcgcacgacacccagccggtccctcaacgcactgcctgctagctctgcccttggttccttcctcccaggcgtcggcaggtagcagctatccatggcatcagcggacggtgcagcatgcgctgactatggaggcaaccagacaaccaagcaaggtgtgaccaaccaccaggactccatccgcgcatcctttaatcctcccgatgatgattgtctctctcatattctctcgattccccttttgccttttcagattaggaccatcatgttgtcagatctagaaatctaaaatggagtattggttttcgttcatgtttaccagtaactaggcctctagttgcatgtgcttgccagtaattgttcagcttgtacatcaagcgattagcatcctcatgctaacatgtgggatttttttttgttctatttcaatgttctctttccaatccgctgaacttttgaaaccatatcgttaagctatctggcggacacataggcatgcctgcgagcacacagcgtccacaagctacagttatgggctgagttcttcacccctcatagagtaacgggcacgcctgtggacaacaaactcgcgggcgtgggcatgggtagccaatacccgtgcccgtcacacccaattgccatccctaaccctaaccctagatctatgcgttttaccgctagattagtattcaattgcttttccacggggaatcctaaatacttgtcaacgtagaccactcccgaataaatggaaaattgaggtcttacctagtatagtacatacttgccgactatctctacctaccaaacctcatgcgtaccaaccaaatcacaacaacaattaccaaaatcagtcgttgaggagttggcggaaagggaggattacctgtgtcgactttgatggagatttgcggccgcccatccttgagcgtttactttggtgagaaggttgagaggtgaaaagaccaagaattgcggctaggcataggggttcaaccccttttatggaacaaaaccgcatctatcccttgttgccataggcacataagttcaatcccatatttaccccctaatctctttgacatgtgggcccataacccacatgccattgtgagattaaggggcaaataagaggatatgcaaacttttaggggtgaataaggaatttatcgaaaggggctaagcatacaaaattgagtaaattccttatttgcccttgaaagttgatttcgtccctttttgcccttgcaaaattgccctccaatccattgaccacctttctcaacttcccttctttatttgcctattgatacatcaaaatacatttttgctctagtgaatgcccttctttctcatctttattgttccttttgccaccatggcaacacttaatcctcattttcattatcagttcaccggtgatatcttgtatcccgtcatgtcaaaaaaaatatcttgtatcccacctcttggttggttgtaccctcatcaattggcacctcctcctcacctcctcaatcctgacctaccactccactattggcaacatcttcctccattctcacgcagtcacacagtcacagtttttctgattttctcattaggaaaaatattcttcagcatattcgcagaatgaatgagactcttaaagatatagtcttagctggttacgaactttgtaaggattgtggttttagtaatccttgttgcctcttaatctctactacttagaggtggagtcgtccgtctgccctccccctcatgacgcacagcacgagtcactacctccccaagaaaaccataaaaaacaaatggtaaaaaataccagttgtatcccatgctttaggttagacccacaccccaccatcgtatggtcagttgcaatgaacggacatattactagttaaaagcgactattggctgtcacctggcagtattctcctaaaaaatgcactatctacatgtgtttttaggtatttggttgatttagatggttgtgtatacaacttataaaactgtggatagttatatgttggttttttaactatagatctttagtatatttgtttgacatatgttggaacatgtgatcacattgctcgttatattgcaaataggcactatgtcatgcatggcaaactaatgaactgttgatggaaaaattctagaaaaagtaatagagatccataatgagagtaggtgaattacaaccagtccgaaaacccaaatgagggtgagtgcaagcaagtttaaaagtggtactttagaatatgtgactaaaattcaacctaatttgacaggcgaaaattatacttagtagttgatcactagaaggcaaaacaaaagtgctaatgcttacaaaataatttgaaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacacaggcctactataactggagactagaactcacaacccatggaagtctaggattaacattttgtgagtagctttataataagctggtgttccaactagcctcaagaggccacgtatttatggaccttccatgtataatcctgaatagtagaattagctatgtgatactaaaccaataacatgtttggatgagcttgagatgcaaactcgaaatttccaaaagtgacttccaaaattaggtggtgggtcagcaagaaacaatgaaatttcatcagaataacacatgctcttttttcactcataggtattgcaacatactgaacaaaaataaggaaaagggactggaaattaccatattaaacgtaagcattcaaacattactctggtggatcaaattttatcaacaataagccacttgtaatttgtagtctcttgtatagatatacacaaatgggtacaaagctcattctttggctatatttagaatgcacattccaaatcctataatgacttgtatcatgtgaaaatcctacaaaactcagttgtcaggcccttactatagttagcacctttatgaaggtaagccacagatataaagttttctttggttagtttgaacaaatcctaccctatattcacactacgaactgagaagaaaatttccacccaataaaaatattttaggttcttctccctcattcaactatacaatgggtctgtttggcacagctccagctccagctccacctcttctggagctggagctcagccaaacagtttcagctccaacaaaaatgggagcggagctgggtggagctctctctcacaaaatgaactagagaggtggagctgggtttaggcagctccataactccactccagacccaactcctggagctaaatttaggagttggagctctaccaaactggcccaatatcagcacatcatctcatgcacacctataatctctcccattgatttcttgatcagatgcattgaccaaatatgaaggctacttgaggaagcaaatctatggtaggtcaccattcttttgtaaccaatttctaacatcaccttggttgcttagttttggggttgatttatttaagtcaaccaagtaaagaaagattttctatgtaattgcttctcccacaggcaccaattttgagcagtaagaacaaaagcatgaccatccatgtgcagataggttttagtttagtgtagttcaaatctcattcattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaggtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttggtttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagttaaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatgcagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacgatgcacgactggaaactattcccctgggccgggacgaacacgccgtcggctgcgaatcgagatgacacaagatccatccgccggtgagcagcggcgcggccaccgacctaatctgagttttggcgatggcgagaccgagagttagcggcgggaggcgaggatctctctgtcgcggtggagacggggacgaggggtttgtgcttgtgcccttcgtccctgtgaacgaatcttgatgcactccgtgtaaggtggtaaggctctgtttgcgaagcttcaccttatctcgtaaaatctgaagctcttccaaataatcccactttttttttaattctaagaagttagttatagaatatggaaaatgaattagagagctgtttgggaagctttcatcacataatctcccactccctaaaccgtctatattttcacccatattctaagaatctttactcgtagaatctagaaaataaactagaaatctaaaactgaatctaaaaggctggctaccaaccagtagattttcagaatcttaaactactccaaacaaaacctagaaatcggatgctgagaaatctagcttttctaagccggctacatccagctatttcttacaatcttaaactccagacagatcctaaggctaagagaggtgcaaaaaaaaacaccaacctaccgtatgaatatttttgaaatattgagctaagattaacgaagttacgagctggtagctcgctattgataagtacttcctccgttctacaatgtaagtcatcctagcatttaccacattcatattgatattaatgaatctagatagatatatatgtctagatttattaacatcaatataaatatgggaaatgctaaaatgatttacaccgtgaaacggagggagtaccaaactgaaggaatgggctagtaaatcttgaaattaatgaagttaccatgtgactatcaattgataggtctcactaaaagagcgggttcgactagaaaaaacttgattagttaagttacgctcacttaaaaaaaccaaacattttcttgtaatgttaaatttaactagttctaatcatgaagtgtacgacctacatcttatttacggtattgttaaaacagattatttaaatatgttcctagaaaaatctccaactgtttgtaaggtcacttatttttttattttaaaaaatatttctatatagttacatagataatttataacaatactccacttaatataaatatatattaaacatttttttcattttacaagaaccagcccaacttcccaaatggccctcatcaattcgacctgggccactcggacgtttccgatggactcgtcaagcccacactccccccaccgatcagacagtgggcccttcatgggcccacgccacgccctcctccactccgtctgacctgaccatcttccacccagcgttggtctcgtctgcagcctcgccttcacctcggcgggtagatctcgcgggcgcatcgcgtcgcggggcaaattcatcaccttcgtgaggcgcaaaaccctactgcccttgacccctcccgctcccctcagatctccccagggtccaccgatccaaggtgaggcggcttcgtgctcggtcggtgtgtgcgtgacgtgaggtttcttgttcttgattttggtttcttgagttttgaccatggtggatccggcggtgtgtggtggtgtgtggttgcagatggcgagcacgggggggaggtcgatggcgctgtcgctgctgctgttcgcggtgacgctgtcgctgctcgagatgtaccgggggaggttcgcctcgtcggagctcatgaccatcgccggcggattcgtcagctccctcctcttcctcttccttctcacggtgcgttgaatcgtccgctcccaaccctcctcttacgatcttataccccttaataagtttttaagttttgctcgtgatgccgttgtttgtccctctttctttttagctaatttgaagtgatagaatcacatgagtggtaaaattttcgttttattattaatttagacaaaccccgtagcaaatggagttgccaagatgttgtctctcgtagcttttgtcacatttgagtgattcagtctgtaggggataaacaccatagaagaaaacatagttttgctctgtgcagaagtgggtagtaacattgtgcttctctgaattgtaatatccgactaggcgcataagcgagatttcggcttagaggacctggaactagtttattcaggttcagttttccagatatccacagaagaatagcttctgaaatatcatacaccatctaatattaagttcactctctacacaagaagtcaaggatggcttctgaaagagaatagaacatttaattttaagctcacttggtactatgtaggctaagctatctgctagtatttccatgatgctatcataattcttgcaaagggcatgttaagtatggaacctggagcttcgaacttttaaccttttgagccaagataatagaactaaagggggttttggccaaaagcatgctaagccccaagagcatccagcagaactagcagccccaatgtccatactactagtcttatctgatggtcaaagaaagtatccttgaaatggggtacttatcccagctttctgctctgtaacaagagaacagtgcaagcagacccttaggaaggcaacaaaacttagcaaaaacaagcacataagacatagtgagcaggtggtatccacatttgattttcaccttttatggttgtattaaaagatcagtgagttttgcacttttttaactgtttcctctcaacattaatattagtatatgataatttgatatacttttgcagtttattggcaactatcaggaagctaatggagttaaaactggatggggtgcaggtatgtatagtcatacgatctcattcttgctgcttccccctgatttttatttcgactttctttaactgtctctttctttgcagttgttgtcgcggaacttactgcacttattgttgccggcactgtccatcgtgtttgcatcacaacatggtatgttatctttaagacactttactatttctttctacggacatttagaatttttctatatggtcccattaacacatccatagatctgagtgtttgctgtttgctaaataagaaaattcttggattatccagagatggtaatctcagacatactagtggagtatttgcttatgaactgttgctctgtttagatgggaggaaatgaaactaacaatttaggcaaaaacaagatactccactcctttgtttgcaaggagttaaaacttttttcatcctgttgaatgtgatatcattcaagatagtaatgtgtatttcacacaagtattttttacctatcttaagttgtatattgttaacactaatgctattggtaaatatggatttgtcacatgttgtaaaagctgtatttatgcaacaatgtcactggaaacgctatgcaatttgcagattacgctattcagaattatggcatatagaatgggttactagtagttctgttgaacctgtctatataaaatatcaaatcaattgcccttttatagcctattatgcttgcggtctaagtcccgccgctacttggcatttttttaagcaacttgacacattgtggataccctcataaccatgactttggagagttctatgacagtgagaaattgatactttggagagttctttgacagtgataaattcatattattaacctttggtcagtctgtgcacccgttgctgcagtccttgcgaatgtgttaatcaatttttatcaactttggctgcagcttcctgttttctgctggatttctctacgaggttgataagctctctggaatgattctcgcgaagagcgagtctaaagcgaggcggcactaggcttttgtaccatgtcatattttgtagatcaaatcaaaaactaatgttcacacccttcatggaactttcaacccagctagctttttcccccaggcatacgtataccatttgaattatgaattcctctagtgtgtttgcactgatgtcacagttcggcttttatgagttttatctaatgagaatggtgttgactaggtgatttcgatgtctttttgacagtctcctggtgacatcagttcatattttttgcaaagcaatgacacattttggcattttagacgtgccctgttgcaaacgttgaaaacattgtgaagtggtagctgtggttaagatctgaatttgtcaagcatgttgcttaacgttttatctccatcaactctggggttttcttgtttgcaaagcgcggcacgacaatgggaaatgtcaactagggacctctggaattattctatgggacggggtcatgtagtctgctttgagattggtgttgaaatcttccccgtggattatttatttatttatttttaccttttttatttaaaattttagaaataaaccattcaaaacttattttcaaatctaaaactgttggtcacgtggcaagggttttatcaatccagctagattgatttggcgagacaacagcccactttatagccattatgggagacgtagcagagttgttttgtcaagcagtgcgagatgacgtggttagaccaaaaaatttagatttgaaataagttttaggagcatttattttaaaaactacaaaaggttcgaaaataataagaattcacgtccatgcagggcgatgaaagcattacaaagccaaagctgattttaagttttaaaacttttttttagaactaattccgtgtgtttcttcgccgctttcattgtccaacctttccgtgatttagtgcaaaattattcctgagaattaagtaatttttaagaattgaaaaatcagctaagcatgcactcgtttgccgctttttgcatgaatctagtgaaagatcgcgattgacatgaacgtgcggcaatttgaccaaggctctccctttcccagccactctctttcaggtccacaacagtagcacaatgcaaaaaatcacgagcaaatcaaaactcgagataaggcatgacgaccccaattggcaacttgcccttttctgcaaacttcacaccgcgagcctgacgcggttgaagaagtatttattaaccctatttaattagggttaattgtgtccggccgacctatgagcacatgtggagtattaatgaaggtgtttctatgtttcgatccggaagttatttctgctaattttagattgacctaattttaagaggatgaaaggtactcacaacaactaaggtacaaatttaccacaaggattctcgtcgtaatcaagaagacataagagatcctagaatcatatactctctctctctctctctctctctctctctctctctctctctctttctgttctttgtacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgtgccggcggtgttgtgccagaccaacgcccaggacggtgagtgctcttgcctcgccgccggcgatcacctccgtttcttccatagatgattctaaagtcaggcaggatcttcttgcccggagaagaatcgcttggtttttgttgctggtgttgatgatcttcttcttgggcatgcatgcgtgcagctgcggcgctcgaggggctgaagagccaatggacgaactacccgttgagctggaactccggcgacccctgcggcggcggatgggacggcatcatgtgcaccaacggcagggtgacgacgctgtaagttacagccatctccttctcctcctaccaccaatatcatgtgatgggccttcctctgaaatcgtgccatggatgtctctggtttttgcaggaggctgtcaagcgtcagcctgcagggaacactgagcagcagcatcggccagctcggccagctcacgtacctgtaagcaccttcttctatcatcagttcatcacccagcttagcaaaagttcaaaacagcatgattttgcaggctatgaacttgggattttcgaaattttgttcatgcttctgtagcagttcagattgtgaattcaggcaatcaggctaggaacttctgattgaaccagtcaaggggcagattgtcagaacagtttgcttctagtttatgaactctgcttttttttttcttgaggcttagttcagctgaccagttcatgtttaccaatcttaagctttgactatttcggcaatgtgacatggattaggttcatttcttaccaaatgaaagaaacaaagatatgatgccaagttacaatagtaaatagatctggatgaaatatctgaagctttgactattttcgcaatgtgacatggattaggctcatttcttaccaaaagaaagaaacaagatactacacttgaagttaaattatcaatagcaaacgtacctggatgaaatgatccgtgacaaagttctggagtacaactaatttgtctaagaagaaatagtctagtagtagtagctgataacagaaacacttgcagggatctttccttcaacatcaatctcggtggtccgctgccagctgagattgggaaccttggggagcttacgacactgtatgcgccgcactgcccattgttgtcaacactacttttttcaatcagaaataccaaactttcttactgatgtgcacaaatgctgtgtaattgtcaggatcttaactggttgcagcttcactggaaacattccaatagcaataggcaacctgcggaaacttgggttcttgtaagtggatatacctggtccacagtttcagatgataaaccctttttttcttttcttttgagtggattgacataatgaattcgtgccattcctctatagggccttgaattcaaacaagtttagtggtggaataccgtcttcgattggcgtactcacaaacctcttatggctagacctggctgataatcaactcactggatctgtccccatctcaacatcaacatcaccaggcctggaccaacttgtcaaaacgcagcacttgtaagtaattttaatcttactttatggtattatcaattgagaaatatcagaatatgtaagtacttacaattgattgttttgctccaaacttcaaattg

SEQ ID NO: 4254 - DNA, 16486 bp, Oryza sativa
agtggtggaataccgtcttcgattggcgtactcacaaacctcttatggctagacctggctgataatcaactcactggatctgtccccatctcaacatcaacatcaccaggcctggaccaacttgtcaaaacgcagcacttgtaagtaattttaatcttactttatggtattatcaattgagaaatatcagaatatgtaagtacttacaattgattgttttgctccaaacttcaaattgatgaacagccatttcaacaagaaccagttaactggaacgcttactggacttttcaactccaatatgactctcatacacatgtaagggatcgacaaattttcatgtctaatatgaataccgaatagatatatcttgctaacatctctccctatctcgtcagtttgtttgatagcaacaaattctcaggctcaatcccagctgaggttgggactgttagtacactcgaagttctgtaagtatcttgaaagttcacataggtggaactcatccttttattttctccaaaaaaaaaaatggtcatatctttgacttgcttttgtatctttgacagccgattggataggaatggttttacgggagcaatacctgctacaattggcagtttggtcaaactgaatgagctgtaagtgacatctgatcttaaaggaagagttatgacacttgaggcacctctcttgaaaatgttatcttctgcaggaacttagcaaacaacaagctaactggatcagtgccagatctcagcaacatgaccaacttgaatgttgtgtaagaaactaaccacccccatgcctcatcatccaatcatataatttgtctgcataactaaagattccactcttgaattgccagggatttgagcaacaacacatttgatccttcagtggcccccagctggttcacatctttaacatctcttgcttctgtgtgagttatccaaaacttttggaattttaaattttgtgtcgtcttgtgatgacaatttcatactcatctctatatgttttgatcactcagttcaatagtttctggaagtctttctggccaggtcccaaaggggctcttcacattgcccacactgcagcaagtgtaattttctggtaacttacaactcaacatataagctttaaaaaaaagtgtcttatctctgcctattttgtggccaatcggacagtgtgctgagcaacaaccaattcaacgggacacttgaaattacaggcaacatcagcagctcactgcagacagtaaatctcatggacaaccgaatagtttctaccgatactgcaagctacaagaaaactctactgtaagaacctgcaaactcaataagaaccaagaacaccatacaatcttcgtcttctctcctacctttcaccaacattgcctcacttctcatgccatatcctgtctgcagcctggcaggtaatccgttttgcgccgagcaagatcccaacaacagagccttctgcagcaggcagctacagaacgcgagcccatacagtaccagtatggaaaaatgcggctcagctcagtgcagtgatggtcagaacgtgaaccctgcaagctgcggctgtgctttctcatacaacggcaagatggttttcagggcacccttcttcgtcgacttggtgagcagtacgccggtccagctgctggagtcgaccatggcggcaaagctgaacctgctccctggctcggtcgctctctcagacatccactttaacagtgacaactacctccaagttcaagtgaaagctgttccaacatccggggtgaccttcaacctgtcagaattgacaaggattggttcttctctcagtaaccagatttacaaaccaccagcaaattttggaccttatttcttcattgcagacccatatgcccccttggcaggtacttggatttcactgtgtcgagactcccactttatttgcactgaagtagttttagttttccctttgagaatgcagaggtatcaaaattacagcttaggaaataccacatttcgttatctgagggttggtatcttgaaagttttaattttttacttctaaattgcaattaatgagatgctaaaaggactctgctattttatgtcggagagtttagtatttgcacaaaagtactagtatatagtggtgtgaggattgctcactctgattttgtgtgtgccagttgctcttggtggcaaaaaatccaagatgagcacaggtgccatagctggaattgcagtagccggtggggtccttgttatcgccctcattttcatgtcattgtttgctctccgacagaagagaagggctaaggaactcaaggaaagagcagacccttttggtaaggatctaaaagctcataggtatcatgtcactgcaatgccaccaagcaatttgtcagggacacattaacagctacaagcagcagcatcctactgcatgctactactggaataaactgacaagatcaagaagttctgaaacaactgaacctgttttctgatccaaaattttcagcttcatgggctgctggccagaaggacagtggaggggctccacagctgaagggagcaaggttcttctcctttgacgagctcaagatctgcaccaacaacttctctgacaaccacgagatcgggtcaggaggctacgggaaggtgtacagagggattctcggtgacggaacccgtgtcgccatcaagcgtgcagaccgcaactcaatgcagggcgctgtggagttcaagaacgagatcgagctgctgtccagggtgcaccaccgcaacctggtcagcctcattggcttctgctacgagcaaggtgaacagatgctcgtctacgagtacatctccaatggcacactcagagagaacttgacgggtaaatccacatcccataattaacattgccatgaatctgattacacattttatttcgccatttcgtttgcattgctaaaatgattcttttatcaaatgttaactgaaaaggttttgatttgcaggaagtgggatgtacttggactggaagaagaggctgaggatcgcgcttggctcggccagagggcttgcctacctgcacgagctcgctgacccaccgatcatccaccgcgacatcaagtccaccaacatcctcctcgacaacaacctcaaggccaaggttgccgacttcgggctctccaagctcgtggccgacactgagaagggccatgtctccacccaagtcaagggaacactggtaaattcccctcactatccgctcatgccaatctcctgacagaactgaattttgagcctcacttcagtactcactaataaaaatctactaacatcttgagaaccaatcaaaatcgatatgcttaatttgaaatcaaacttgaagtaaatatggtaactaagcatgtacccattgcacttcaccttactaaccacttctcccaatctcaaaataaatcgataaaattcaccttactaaccacttcttccaatctcatgacaaattgataaaattcaccctactaaccacttctgcaagtctcctgacataactgaacttttaggttcgcttcagtaaaattcgacgaacatcttgaggaccaattgaaatagatatgcttaatttgatctgatagtataaagaaaacaatcaagattgaaacaaatggtaataaaatcgatgggatgtggctagggctacctggacccggagtactacatgacgcagcagctgtcggagaagagcgacgtgtacagcttcggggtggtgatgctggagctggtgagcgggaggcagccgatcgagaaggggcggtacgtggtgcgggaggtgcggctggccatcgacccggccgaccacgaccaccactacggcctccgcgggatcgtcgacccggccatccgcgacgccgcgcgcaccccggtgttccggcggttcgtgcagctggcgatgcggtgcgtcgacgagtcggcggcggcgcgcccggccatgggcgccgtggtgaaggagatcgaggccatgctgcagaacgagcccgacgacgccggcgccggggagggggacagctccgccgacccgtccgccaacgagttcgaccgccaccgcggcggtggcggcccgccggcgcacccctacagcgacgtggagatcagccggggatcgtacgccggcgatggcgcgtcggattacatgccctattttgaggtcaagcccaagtagtcatcattagattgtaaattgatgagggtgttgtttgtttcagtttttttttcctttgttctttctccttttcagcttgtgatgaattgtaaattttgtatgtgttgcgagttgcgacagattaatatatactgctacagattctttcaatttttcactgtaccaggtgcaattatacaaacagatcaattacgatacgaattttatatttggtgtttgaatctcgaagattaagatgaagataaaaattaagtgtttcacgtaaaacgaggtgattataatgtgtgattaattaagttttaattattataaacttgaaaaatagattaatctgatattttagaataactttcatatagaaagtttcagcataaaacgcacagtttagcagtttaaaaagcgtgttatttggattcgaacggcctcttagtaaagagtagattgtattagtagtacgagaacttgcaggtgggtacgatttagtgcaacaactcgaaaaatatgcagaccgatacatgaaattggcactcaagtgtattttggttaaaacgttgttacgtacatatgattcaacatattttgtttgttatattataatcataactactagattattggtcatgaatacaattgaatatgtttaactagtagaatcgctcggaaattatgttacaacaattcttatacacttagttttaacgatcattatatatttcggtttcaaatcgacaggatatttattattataagcaagcaaataaaatacatctagaccattattatttgataatcattatacttattagattattggcaacgactactgttttttttactatgtggcttaaaaggtgtggtgtctaatattattttttttagccagaatgcacatactagccaagttgttacacctaaatgatcattttttaagttgttacactagattgcacccacctatcaagtttatgtatcgtggacacaatttactctctagtaaatttcctaaaacccacctactatggttcaaatttcacaaaattccaactactatgatcctaaagtttcacaaataacactattgataatttgtattctaaagaaaaacattattgatcattttgattttaagctatcacaattattttgactttaagctatcatatattctggttttgtggttaaggaacataaaaaaaatctcactattaagttgagtgacctctgacgaacttattcttacatctatataggacgtcaaagggcccactaggcctcaccaagggtagtggcacgggcagaggacaaatttcataattaaaatgcccaatatggcaaattttgtggttagattaaggactccatcgaattattggcaatgttcaatcattcgaaaaccagcaattttcctcataaaataaagtaatactagtactaacctaatgaagccacgaaccttggttgcatcaatcaagctaacgacctaaatgattcgggcgccttccacacaagaaaaacacacatgtactgatgtacacaacatggagagggaaatggctacaacaacgcgcaagattaataaagcaacatattttgcctctgaaaggacggaaaagaattgaaaatattcattatttctaattttttttaactatatacacggttttagaagaattgtgaaaatatacgcgtcctgcgtgatgaaaacgtggaccgtgtgtttgacgtggcacgaaaatgcaagagcaacgatcgacgcgatcccgcggtgtgggcgcgtggaaccgcgtctgtcccgcatgccggttgagcggcaccgaatgcgggacggcatgcttgcatgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttgatagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggctccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcagtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtactgaagatcccggctgcaaatcctgcaggacaaggaccatcagtttcatacaggtatttaatagtattaataaaaagtaaagtaccgtgtgggcgatggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagctagcgatgatcgctcccgcgtctgtcttcgtgcacgcctcacagaggacatggtacgtggctgctagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttatcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacctagttgtacacctctgccaaattggttgtcattatgccataccgagatctatcggtgtcgaataatagagaccacttctccttacgctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcattgtcaactcatccaacttgtcccacaactcattaaatttcttctcttggctctgtgcacatagcctcttaaagagctccataagatgcttgttcttgaattgcttgtagaaatttgcacccatgtgacgcatgcactaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatagtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggtgatttttaaaaatcgccctcccagagggcggtaggcgactacttccgtcaattttcaaaatggaaaactatttttgtaaaacttttaataaaaaaaattaaaaataaaaaaaattcccaacacgcgcgtcccccgcggctggttggtgggccggcccagtatatacagcgtcgcgtgggctctcgcaagccgtgggctctctctctctctctagtccgcttcttccctgagttcttcgtcttccccaacctcacgcgctctagcgcgcaatggcgaggacggggcggcgcggggcggcgccgccgttgctgctggcggcgacaacgccgacggggttctgcgagaccaatggagtggacggtgagttgatctctcagcactcactaccggcgaaaagcaaaaactgcttggctctcggctaatccttggagaaatattcttggggcagttgacgcgctgcggggtctgatgcagcaatggaggaactacccgtcgagctggaactccggcgacccctgcggcggcgggtgggacggcgtcatgtgcagcaacgggagggtgacatcgctgtaagagcccagctccttctgctgctaatcaccatatcacgcgagatcattagagttccggtcacatcatgacgaaattttttttataagttagaccttttaaaaatataattttattaagagaccacccggaaaaatattttcaaaactaaaccttttgactatgccaatagcagtggcgtggccaaacagagtggcggcaccaatggtcatggcatggcaagagctgccccatggcgatcgttgctgttgaaatcgtcaaccgggcgccaatgtgacagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaaaatagtacttgacgaagcttggggctcctcaccgggagaccgcacaagcccccctttgccggttcggccgggggcgctaggtgagtttcttcaccctcgatctgtggaatgttcgcgagagagcaaaacgcacgagacacgggcgatgtagacaggttcgggccgctgagaagcgtaataccctactcctgtgttctggtggatctgtgtgtgaaggagttacagagagtcggagagcaagagagttcaggctctagaacccctcttcctctttctctcctctacgagctcaggtattctcagagtcgtctcagagtcctccctccctttttcgttctccatcatcccttttcggtgggcaaggtcctccttttatatctcaaggggataccacatgcaccacttctacctactcttcttttgggtggggacccaccctatcttgaccaaaaacttggctcgcgccttcgcctggaagctaaatcacagcttgtccttgagtgaggcccagcgccgtcactcgcctccacttcgccggaagtagatgcagcgtgggagcacggttgtctgccgatgacgtgaccggcgtcagaccagtcacagaccggtcattcttgtccaccacgcgtcagtttagcatgccgcacatctgcccttcttcatacaatgacttccttgtaatggttgcgatgaagcctggcatgaatctggccgggactgacgtgccaactccaggagttagcacgccggctccggctagggacgagtgcctggaggctctcatcattccgacgggacggggcgaggcgtgtgacaggccgcctgttgccacctaacccgcgatctgaccggtgtcacacactgcgaccggtcacggaccggacgagcgcgcgctgcgctgcattaaatgcggcgtggcgcgctcgtccaagccgcaataaatgcagttaggtgagccccgctgtgctcacctaacccatacacgtggcgccaaaatcacagggggtcggggcgcccctgccctcggggccgaaacgggagcggcccgacccctcggggagacagagggaggggtggccatgtcaccctcgggcccgacccccccgagggggtcaggccacgtgggtgaccgcggctgcccaagcttctagtcacgatacccccggtcccatgtcaccgacagtactaaatgggtaaagattggataaagtatatggggtatttgtgaggtattattagaaaacttcgtgtggttttgatggacctgttttatgtgttgaaaatatgaatggttatagggtgtgtttgcaagtgcaggatgggaactcatccctcctgcacgcaaaacggagcggctttttaacacatgattaattaaatattagctaatttttttaaaaaaaatggattaatttgatttttttaagcaactttcatatagaaattttttgcaaaaaacacaccgtttaatagtttaaaaacgtgcgcgcgaaaaacgagggagaggggttgggaacatgggtttgcaaacacaaccatagtattggcgattccttttcgtttgagtaaattttacaaaactacaggtattttgaccaaattatcacaaaactacagattt

SEQ ID NO: 4255 - DNA, 2089 bp, Oryza sativa
tttgatgaacctgttttatgtgttaaaatatgatggttatagggtgtgttgcaagtgcaggatgggaactcatccctcctgcacgcaaacggaagcggctttttaacacatgattaattaaatattagctaatttttttaaaaaaaatggattaatttgatttttttaagcaactttcatatagaaattttttgcaaaaaacacaccgtttaatagtttaaaaacgtgcgcgcgaaaaacgagggagaggggttgggaacatgggtttgcaaacacaaccatagtattggcgattccttttcgtttgagtaaattttacaaaactacaggtattttgaccaaattatcacaaaactacagatttaaggagttgtatcataaaactacacatttagcatcaaatttatcacaaaactgcagattttaggttaagtatcacaaaaatacatatttaatattgaacttatcacaaaactataacttttggagtttaaatccctagcaccattgttatggtggagctataaacattattactttgtgattaaattggttctaaacctttagttttatgataatttagtaactaaacgtgtagttttgtaacacttcatctttaatatgtagttttgtgctaaatttggtgctaaatgtgtaattttgtgatataattccttaaatatgtagttttgtgatagtttggttataatatctgtagttttatgaaatttactcttttcgttttcactgcaatttggaatgatggaattgactagatccggcattaccgatgggctgccgaacgctgtgatgcggttgatcttgagcgatccgggacgccacaagcaccgatgggttctgggagttcatacggctggtgcagcagtgtgtcaatagcagccgggatgtgcgcccaaccatggtcgccgtcgagaggaggatcgaagacatcctgaactcggttgtcaggtcatccaccaccgggttcatgactgccggaggcgacacacccagcaacgagccaaatcgtgaagataacggaaacgagccaaatcccagcaacgagatcgccagggactagtagtacgtacagcagtggtgatttgtcatataggtgtatatcggctgttttcgcatctcaaggcctcaagcagtgtgtgcaatctggagtagtatataaatatgtaaaatgttcatttcgatatactgtcaaatgcgtgtaaattaaccaatgctaaaacaacacactgtgactaaatttactgagttggatgatgaggatgattatgttgcgtgcacacctgatcaggaggacatataatataggccatttgggccgtcttggacaccaccgtttgatttgtatgaagttgggccgaactatgcaagcccagaggcgctgcctctgtgccacggcccacgggcatcgctggatggtcaagcaggtgatcggtggagcgccaatggcggcggcgagacacacagcgcggcgcgcgcgcgaacgtgcggacgcgcgcgccccggccacggccgccgcgctcgtttcctggcctcccgcgcccgctacaaatggcggccccggcgtcccctcctcactccgaagcttcccggttgacgacctctccggtctcccccctcaccccaccggaacccgggacgtatttcatggtcgacggcgacggcgccccccgctactaaaccaccctacccaccccctccaaactcccacacattacatccttcaaagagagcatcacacacacacacacaccagcctagcgatcacattttcacgatgacgacgacgacgcgagtggcggccgccgccgccggcgtgctgctggtggcggcggcgctggccggcgtggcgcgcggcgaggacccgtacgtgttcttcgagtggaaggtgacgtacggcaccaagaccctcctggacgcgccgcagaaggtgatcctgatcaacggcgagttccacggcccgcggatcaactgctcgtccaacaacaacatcgtggtgaacgtgttcaaccagctggactagccgctgctcttcacctggaacgggatgcagcaccgcaagaactcgtgg

SEQ ID NO: 4256 - DNA, 6135 bp, Oryza sativa
agcccaaggaccagatcggcagcttcttctacttcccgtcgctggggatgcaccgcgccgccggcggctacggcgggatcagcgtcgtcagccgcctgctcatcccggtcccgttcgacccgccggccgacgaccacatggtgctcatcggcgactggtacaccaagaaccacgccgccatggccaagatgctcgacgccggcaagagcttcggccgcccgcacggggtggtcatcaacggcaagtccggcaaggccgccgccgacccgcccatgttcaccgtcgaggccggcaagacgtaccggctccgcgtctgcaacgtcggcatcaaggcgtcgctcaacttccgcatccagggccacgacatgaagctggtggagatggagggctcccacacggtgcaggacatgtacgactccctcgacgtccacgtcggccactgcctctccgtcctcgtcgacgccgaccagaagcccggcgactactacgcggtggcgtccacgcggttcatccacgaggccaagtcggtgtcagccgtcatccgctacgccggctcgagcacgccgccgtcgccggccgtgccggagccgccggcgggatgggcgtggtcgatcaaccagtggaggtcgttccggtggaacctgacggcgagcgccgcccgccccaacccgcaggggtcctaccactacggccagatcaacatcacgcgcaccatcaggctcatggtctcccggggccacatcgacggcaagctcaagtacggcttcaatggcgtctcccacgtcgacgccgagacgccgctcaagctcgccgagtacttcaacgtcaccgacggcgtcttcaggtacaaccagatgaccgacgtgccgcccgccgtcaatggccccctccacgtcgtccccaacgtcatcaccgccgagttccgcaccttcatcgagatcatcttcgagaaccccgagaagagcatggactccgtccacctcgacggctacgccttcttcgccgtcgggtacgtacatacatcgccccccattactactacctccattaaccttttattaaagataggcttggccattcattttatttttaaaaaattatataagtatcatctattttattgtaatttgatttatcgtcaagtgtgctttaaacataatttgattttttttatatttgcataaaaaattgaatattatgaatgatgtatatgatctgatactactgttaactaacttactgatgcgcataataataaaattttttaataagacgaatgatataaaaaaagttttttaaattacctccatttataatatacgatgttttttttacttttaacattcgtttataatatatgttttttcacaaacgtttgagttttgaccatttattttatttaaaaataattatgcagttatcatctattttattgtaattttattgtaatttgattattgtcgagtgtactttaaatacgatttgatttttctatatttacataaaatttttaaataagataaatgatggatacgatctgatgctaccgttgactgactgactgatggcgcaagatggggccggggaagtggtcggcggaggagaggaagacgtacaacctgctggacggggtgagccggcactcggtccaggtgtacccgaggtcgtggacggcgatcatgctgacgttcgacaacgccgggatgtggaacgtgaggtccaacatctgggagaggcactacctcggcgagcagctctacatcagcgtcgtctcgccggcgaggtcgctccgggacgagtacaacatgccggagaacgccctccgctgcggcaaggtcgtcggcctgccgctgccgccgtcctacctcccggcctaattcatcgatcgatgcatatatgtactgaacccgatgacattcttctcttgttcttgacattttttgtgatcttttgcttaatctggcgaaataatcaacttaatttgggctcgtgcttattgcatgtccccgcgaaaagaagaacaaaagaggagtggaaactgaaacgtacgtcctatgaagaagctgagcgccgtcgtcgtcagctggatgtaatttcgatatgccctctaaaaaccattgtaatggtggagttatattatacatatgatttcatcgctcacatatatatatatatatatatatatatatactagctactgatgagttaaaaaaaccccatttttttttcaagtgtgattaatttatcattatttgtcagtcgatgtttttttcaatcttacgaattacgtttgaaatcgaatgacctgtagctcaagccctacccatctacacgatgggagtgtttaagatgccggaacatttctgtaatgattagtaaatgatattcgctttatccaaaaagtgttaagcatatttcatatttatagttttgatgtgctaaatttattgtcaacgagaacctaagcaaccatcttaatatataatttattggtttgttacattggggacgagttaattacttcttgattttggtgacaaaaagaaatgtgccttatatttttgttaacaaccaaatttggtaatatcggcatcggaaaagaagattagatcgaagtggagtcgaaggcggagatcgatttgagaacagagcaagaatcggctggagtccagatcggctacgattaggatcggctgggtctgagtcggactaggtaagccgatgcagccgattccgacaatacgacttggtgtatgacatcgggttgaattgaggtgcttcaagataattgccgcacatggatagagtcctgagaaggcaattgtatctattaattaaaatattttatgtaatttccttaaagatatgtttgggtaaaagtctgtcgcaaagacttatggtatcttagattttgttagagataagagtcgtgtccgatatggacatagtttgtaattttcgggtataaatagaccccgaaccccatgtaatcaattaacacacacgttcaatacaatttcggcgcatcgccacccttttgcttttgttttatttcgacgagttcttactttcgggttgagctgcatcggtttcgatcttcaacaagaggtaaaacttgttatgacggcttgcgttctcgggattagtgcttacatctttatgatactctaatcttgtttatgtaattcatcgagttatcatatatcttacataatctctagcaatatcaccatctaacccacaatcggctaacatctgttaacagagggtagccgattaggttagatatcgacgttggtttagattatataagatatctaccactctatgaaacttcagcggcttgattgtctagatattgttcttcttttcatacttaatgctgtatcagttgagtttgatctattaagtcatgcttagaatatcaatctctagcctgccttctggttaccgattagggtagtatcggagtttcagccgatcttatctaatttaactatatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctttgtatctatttcttgttgattgcaggatcaaatcaactggcacgctaacacacccgaaggcgagctttggacctgcactggagttaagcagatctcccaggcctcgtgtttttcgtcaacacgcttttggcacgcccggtgggacagattaggagtcagataagcaattttcttcatggccgagaaactaccgccatcaccgtcctcggctagcccaggatttgttaaagaaaaaatccaaaagttatgtttcacggacgttgatgaagggaacattgtgaccatcaatccagaaaagttcacacctgatcaaaagaaagattttgacgcgatgatgcagcaaggtgttcgcaaataaaaccgtagcctccttgttagaccgacatgtcattcttttccccggcttgctgagtacgttaagtactcacccttgccccttataataatctatagagtttgaagatgaagacgtcgacctgacagctgaggagtatctccaggagcaagttgagtatgaagacttctagatgttttgtgcctagccccaagcctcgcctgtggaataagttagttgcctaagttctttgcctagtgcgtagtcgcttagttctccgcgctgttcgcttctgtgccgtcgattttatggttctctgtaatgctgtgttgctcatatgtgggcctgtccatgatggcaacgtttgtaaggactactacccagtgatgtaataaagcaatttactttgattccacatttattctgtgtataccagctagtgtatcctgggactggtactatatcacaggtaatgcataacaccccggtgtgagtttgctgtgtttatggctaacaaatgtcggggcgttacagtgaaatgaaaatttttttatgtcacatcggacgtttgactggatgtcgaaaggggttttcggacacgaatgaaaaaactaatttcataactcgcctggaaaccgcgagatgaatcttttgagcctaattaatccgtcattagtacatgtgaattactgtagcacttatgcctaatcatggtctaattaggttcaaagattcgtctcgcgatttgcatgcaaactgtgcaattattttttctttttatctatatttaatgctccatatatatgtccaaagattcgatatgatgtttttacgaaaagtttttttggaactaaacaggcccaaagaaaacacatgcgatgatagtgagggaaatatatataccttcctcactgcctcgctgacattcgtcgtcgcatctggatcgcgaaagtaggtccacccacgagcagccatagtgttgagttcatcgatgtatctctcccagtcaatggcagaacaatggcaatgcatacgcttgaactcttcatcagtaaagtctgcatatccgttagggccataagggatcgtccttggctctagtgcgttaaccttgtctgcccacagggtggcctccttgaatacttcgtagcggcgagccttctcctcctcagtgctgtatgaacggccatactccttcatcaagtcatggaacctggccttcatggtcgcctcatcgaccttcacctcctgcttcttaatggcttcttggtagtctctcgcctccttagcaaatgcctcatcgtccgggagagtcttcccatgttcgacgtaattgagatagctagaccacaggatcttgccatctttgtccacgaaccctgcctcgattgctgcttccttgctcaggtaaggctccttgccggcgtcctgggcagctggtaacttcttcgtgacttcctccttatcctcctccctagctacaggttatgtacagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatactttaaatatttctaaatttttctataaactttatcaaacttgttaagtttgactaggaaaaaattactaacaaacaatgagaaatcttggccttttcaggattcagattggatgacatatggtaggcatgtcacaaggtgacatagctcagatctcagccctccaaaacaaatt

SEQ ID NO: 4257 - DNA, 3991 bp, Oryza sativa
gaatctcagctgttggatttattttggagggctgagatctacgctatatcacctttaacatgcttatcctatgtcaccatctgaatccgctttttcaattcatacctcctgacttgtcagtgttttgcttgaaacacagaattgtggccgccaatccaaccaatgaagccgtggctacaacaacagagccaccaccaacggcgaaacccatctgtatcgcgtaacgagatgagagacatatgagctgcgagtgaacaaaagaaaagattttcgatttgagaaccgggtgagatgagagacgaacggagtggaaagagtgagctgctggcctccccgcccgagtgaggatacccagcgaggactccgcctgcgcacgggggatcccgcgtggcgagaaccccctccggcttcgggtgagaaggtaaccgatggcccggagcgacatggccgcgaccggagaagctccccttcttcctcctcctccgcccgcctccaatctcgcctagtcgccgagattcgattctagggttttctctctcgtgacttcccttcccgatcgacgtacgcacactacagttacggcccagtttgtaaggcccgcatatagatcccagcccaatagggctcaactataatgggcccgttccaatcgaacgagtaccacgcgtgcgtgtgggccctgtcgtcgagaaccaccgtcactacctgcacctgcacgggcccgataataataataaaaaagaaaaaggaaaaaaaaaagagaaaaatccaactaggcggagccattcgccccgcacgaactccgaggcgcacgaccaaatgcgcgccgccgccgccggccgcagcgtccgcctcctctaggagcgacggccaccaccgccgtatgagcctgtagcccggcgccgaggtccgcgagcttttgctttggggggtgggagctaagctttgctcccccctgtgcgtgcgggcgggggggagcggggatgaagggccagggtggcggcgcgggggccccggcgaagaggcggtggaggagcgtggcggccgcggccgccgcgctggcgctgctgttcctctccgtcggcgtgccgctcgccgtgctgctcggcctccaccagcgcttcccgtccagtccgtaaccacccacccctctctcccctgccaaaaccctacttttctcttcagcctctccgctcccagatctgggcttcccgtccggctcgccggctcgcgctcgatctaggggctcatcaactctctctctatgctcccctgactcgattttgtttgtatttgttttgtcttttgatatcacagtgtatttggccgacgagagcgccgtgtcggtgagtgtcaattgagattgaaactaactagtagctcatgcttaagccatttgatttgtttaatccattgctgttaagatttttgcctcatgtttctgttgcacaggtgtttggcggcagcgagggtggtggttgggagccaaatacatcgcaggtagggggtgtgctcatgattgccatttctgggatatttttgttctattacctgaaatgttccaatcacatgggggtgtggttaggtgtatttatcctaattaggtttggtcaatgatgactgatggggtactactgcgggaagagaatttaatctttagatcagtgatgcatttttttttcgcaggaaaatgacaggctgccagtcaacgacacgaacaaatttccgccatcgattgaaaaggtttgcatttgagcccatcggccgcagctgtttcttctctttgttcatgcgtgaaattttatccaagtagagtgcttgttgtgagttgctatcgtgccgattgtggtctcatgggtagtgtttgagtggaattgccttttaatacatggtccatggccccatttttttggaaatgtcagtctgcttttgccatatcatggatcttgtttcacatggccctcttttgcatttctactgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcaggccttcctatcaaacaaatcgtgatctttgatgatatatcattactgagtgtaagagctaatatgctttacagttatttttaacatgcccttgtctgttcgtgcagtaaatatatatgctgctttcgcatgaatttctgagcagggcatgtgatatgcaccttgcttttgcaatattttaaagaaacatttcaataatcctttgtaacttgtttgcggacttgcagaattatcatatattacatactttttatttttcacctaatgttgcagaatactgatgctgatcctaaggacaattttgaacaaggtttacctggtgatgagagtataaaatcgtgccaactagaatttggaagctattgtgtttggtctgttgaacacaaggaagtgatgaaagattctgtagtgaagagacttaaagaccagctctttgttgcaagagcttactatccaagcatagcaaaacttgaggggatggaaaaactttcacatgaaatgaagcaaagtatccaagagcatgagcacatgctcagcgaagccatatgtgatgctgatcttcctgcattgtaagtaatcttccagaaatactttctttagttctcatttttaagctatcatctttaatccataaggcactgctaacttcagaaattgatattttaccatacatgaaactgttgggtatttaagcagcctgactttgcaccaaaaatggtctacctactaactgttgtgcttcactgtttgttttttattttcacagattttgatatccactgtcgtctaatatgcacgtatacaagataacttatgcataattgacagcctacagttgattgagcattacctgaatgattccttaggattatctctttcatcacctagcatgttcgtagtccttattattttgtgaaatgtattaacactctgtagtttgatcgaataacattgtattaagctaaaagtgtgatattgggatgaataatttaccaataattgtagcagtaagttctaaatgatgagtggactgatgatctgatggctcaatgtgttatacagattcactttggaacagaaaatttccccataggtttagagtttgctataatgattatttgttttgttatagtgattatttgttatttttgaagccatggagccaatatggcaaagatggagaagacaatagctgcagcaaaatcatgtctgatagaatgcactaattttgagaaaaaactgaggcaattgcttgatatgactgaggatgaagctcattttcatgcaagacaaggtgcatatctttaccggcttggagttcagacattacctaagagcctccactgcctttcaatgagattgacagtagactactttaaatcctttgctgacatggagtactccaatgtgcaaaagcttgaaaatccagttctccggcactatgttattttctctaccaaccttcttgcatcttccatgactgtcaactcgactgtgataaattctgaggtatgatattacttttgttgtgtagaccatgtggtctcttgaaatttctgcatcatgacactcaccagttcttttcagtgtttcaggaatcagcaaatgtggtttttcatcttgttactgatgcaca

SEQ ID NO: 4258 - DNA, 10788 bp, Oryza sativa
  unsure (1)..(10788): unsure at all n locations
aaggaaaagtgattggtgctgtacagtcttgtcgagttatattaaggcatctcagaccatacttggttgacttcccatatgatgctagttcatgtatctggatgtctggagtgagtgttattgatctcaataaatggagggagcatgatgtgactgcagttcgtaatcgagtactccaaaaggttagtattgaatagtgatgcttagcagctgtcttttcttctctctttcaagaattgtttttaagaaactactttcgatgttatatttgacataaggcatattcctcatggctatactcttgattttctgtttgtgttcaactgaacttaccctactgtaccgtgatcttcactaataagataaacttgcttgaagccttgaagtttatttaagatatgtattttttttcttgcacgtttggcctgttaagcgaagagctgcaaattcttaactgatacggttgtgcctatgtctcacttttgacagctgcaacatggccctgaagcgtcatggagagctgcggtgttacctgcaggcctgcttgcttttcaaaatctggtccatcctattgaagcacagtggatccagtctggtcttggtcatgactatggagtcaatcatggtgctataaagaaagctggcatattgcactacaacggcaacatgaaaccgtggttagaactcggcatacggcgatacaggaaatattggagaaggtacctgccaagggatgatccattcttgatagattgcaatgtgaatccatgttcaaggctattttgttagtcctggagtccggaagtccatgttcgacgaacagcaccaccttgtgcgatagcgagagttcactgtatgcggaaatttgatgagaggagaggggcttcagtgagcaccgcccaaactactgaggatctttcaggatgctgctgagatatgaagtaaaattgatttttttttgcaaactggtcgtctaccgtggtatgttgagtagtagttccatttgttcattgatcaatgtacagtgaggattggacagatgctgattcgtacaccagcatcacaaaatgggtgagggtgttgtagtttaggagagccttttggggcttgtagattcagtagattaggatcatggggcattaacccaaaaaaaatactgcatatattctgtgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatgtatagtttgattcgggatgatgattggcagtagagtagggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggcgtgcccttccaccccagccgcaccgtgccgtcgtggtctcccgccaccgtgtagcccagcccgcccggacacgccgcggccaccagctgcgcgcgcccgccgccgccgccgccggcgtgcgcgaacccgtgccgggcgagcacctcccgccagctcccgggcccctcccggccgctgctccgcgccggcccgccgacggcgagcacgttcgcgatctccctgccgagcacgccgtgctccgccagatgcctgctcgcgtcctccccgtccggccgcgacgcgcccatggcgtcgaacaccgccgagtagtggtgcagcgcggagacgaacctgtccaggaagcgcccgtggccgccgccgccgccgtgtgctctctcctgctccacgagcgtccccccgccggctccagccaccgcaccagccgcatggaggcgccgtcgtcgccggccgcgtcgtacatggcgtggcgcagccagtgcacggccaccgcctcccccggcctccttccgggcatgtcggcgaccgcgtcggcgtctcccggtcgcttcgcgacggcgtagaactcgaaaaacatgcacagcttcctcgccagcccggcgagctggttgccggtgtcgtgcagcaccgacgccgacatgccgaagccggtgacgcggatcaccggcgggcctcccggccgcgccgccagtgccgggaggagcgagagccactgcagcgcgccgccggggacgacgtcgaggtcgacaatgtggacgaggcgcttgccgtggaacgcctcgaggatggcctggttgcacgccaggtaggcgagccgcgcgaacggcgcgacgttgtacagcgcccggaacgcggcgttgatggccccgcacgacggcggcggcgccatgggcgccacgacgccgacccacgaccccaccaaccgcgccgccatggccctggcgaagtaggccacgagccgctcgccgcacgacgccgcgtacggcgaggccatatgcgacagctcgagcagcgccccgttggcgcccgcgaggttgcccacggacatcgccgccgcgcactccatcagcagcgcgatcatccgcacgccgtgagcctcctcctcatcctccaccgccacctgttcgacgtcggcccccgccatcgccacgcccgtcctctcctccgccgcgccgccttcctcggagtacacctccttgcacgctcctaactccggccgttgctcgaacgtcccggccgccgccgccgccgccggcggctcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggatgttaactcctaagaggtttcagagtactgacatttgacgattgcgatgcgtaattttctttgcttttctcaaggaaaaccgaaaccgagctactagaacccctaagaattaatcgaagtcatcacatttcatgattgtgatgtgtaattgagaaatgagtaagaaaatagctttgaagcagtagcttcttcctaatggcgagctgatagatcacttggtgatcatcgctagttgaggacgagtcgacgaggagctaggctgcgcttgcaggcagcgaatcaatggctggcgatatcatcaaccaatttggccagttagcttgcttaattcttcagctactaattgagtaattggccggactaattggcatcaagcagcagaattccagcatcaatctgccggtgcctccacatgtcaaactcatcgtttcctatgtgctattacacactgaactcatagtagtttgctacatgtttaattgtggtctgttaatttgacctggtattgttacaaggccatgcgaacatatttatatatgtatatatcctgctaattaattcaggctgacaaggccatgcgtagatgtaccgtgctaattaattcaggatatatgcatcatcgatcgatgacaatgtaattaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatacaagaacaagaagatcagtatcacttggagtataagtgaattgttagttttttttcatcattttaatatttgggttgaattggtagttatatgcaactcaataaggtatcgttagtttaaaaaaaaaaactcaataaggtatcggagctacaagtctcaagttcaaatcttgtcggacgcacacttaaataaataattgcagcttccattccatgtctgagcactcaaaaaaattcaggcatgttttgtttttgttgttatttactatcggcttagtcttttatatgaaaattcaattctgttttttttgttgtttacttattggcagtcctttagatgaaaattcaggcgtgttttttgatgaacaaaagatgaattggttggtgcatggaaacatttacaaagagaaattataccagccatccagcaaacagtgccaccccgttgtacaggtaaagcttggagtccttccggcctgcaagatcaaggtacctgcattttcagaaagaatgcatgaataattgtgatctcagacatgaacaagcaagatgattaatgagcaatttgggaaaactgaatgagtattaccatctgaggttcacgaagggtgtggttgcttcagtgatgaggaccatgaggatgtacacgtgtcctttgccactcaacagagcaagagagattgcatacatggacaatccatgatgcaagagctgaacatatcaatacaatcagaatagattgttaacttgtgtcacctcaaattgtagtaaaagaaaaagggacaactcagaacattaacacttacatattcctttcctcctagagaagggaaatgccagaggatcatcaacaaatctgtcaagaagtagcccagggatacctgccaataattaaaatttcagacattttgggacagatatctttctctcttttctccatggtttcctggatgcgtagggctgcaaacttacaccaaacatggcatcagacatccatgattttcgatcaattatgatggcaccatggacgtccttactgaagaggtcagatatcaccagcagataaaaagagactacagcagcaactaatgcgtggaaggtagagaatcccctaaaacatggataaacgagttgtaattactagcatgaagagaagtgaatatgcatcgctactgttagttgatttttagataatactgcaattagtcgataataagaacctgtcaaagatttattgaaaaagacctgtcaaagaaaaagaaagagaaaaacaagcaagctccaattaatcacctgttgttccactcaagtttgtgcaattcattcagtccattataacccttgtagcaccgggagctaacttcacgagttatatcatatacctataagaatggagtagaagctagtcagtgcctcagtggcataatacaaaatataatgcagaatgaattcatcatgtaggctcaggaacaattgatccctcctctttttttccctatgttttcttgttaccatttaccatgcatgtacttctcaagctacctacctagccttttgacaagtaaaaaaaaaatgaaaaaggtaatctggtatatctcttcacatactaatccgtattggtgatggaggaattcacaaattataaaggtaatctggtccttaagcattattgacggcacgattccgttggctacctcctcgactgtgtggtactaaatgctgacataagtagtcttcaaaattgaaaaggagtagtgattcataattcactcatattcagtaaaaaaaagtaataattcattcatatttttaacaccatgtatcacccaagtagcaactccttccattcccgaatattttaaaaaatgttagattctcttatgatggaaaattgtgtgattatatttttcacataaggtaatttgataatataatatattttgaattgttttataaattaattaacggaaaaagattagtcaaagtttgattgtgaatagtgtttggtgacaagtttttgggaacggagggagtatcaaggctagattgcattcaacaaacgtctacgagtccaactaagctgtcactattagttgctttgctctctgcagaagttaggttcagtacttgtaatggctggtctgcatacattgcaagagtttttacagtcgaataatactattcttcctacattaaaaaaagaagaagaagaaaaggtgggacgttccaagcagaaagactgagctatggaagtcaagtgcagattgatggtgatactttgccctttttggatctcaaaagttggatgatagaaatgcataaattaatatcagtactgaggaacatttcacaaattttctttttataacgaaaaaccgaaacctgatttagtagttcgacctctaaaaaggtaaatacaagatgggattgctcatctcactagagaaaatacactttaggcagtttagctttaccgtgaagatgcaaatttgtagcaaaattttagggctattttgtaacgcacgattaaaaaaaaggagaaatagaaaaaacacacatgattgcaaaacaggttgtttgattaggcagtaggagataaaagaaatatagtcaaaggaaattttcaaaaaagttggagctctttttaatttttctaaatctctataatattgtccatttcgtaggatttttttttttaaaaaagattgatttcaaaggccttcataggaatttcttcaatttcttttgtacaatattgaaatcctctaagtatcttatgtttcctctacaaatcaaagtaggacttactgggaatgcactctcgtatctagctaagcaatggaagagatcgatggaacaacttaccgctgcgcacatgaggatcccagcaagaacagaagccggccacacgatctgctcctcgggcccaaacctcacatccatgtccaccgctgccaaatcactctgcccttcgatctcctccttcctcgatctcggcggctggccgttcggtcgagacgatgaaaagctccccaaatcaacagaagccagaggatccaatccttgcagcaagcgtttgcaagtcctcgaagagaggcgccccgggcttaaatgggcagagctcgatcgccatggatgggagtcgtgcgcggcgacggtgaccgagggagacggtggacgacgaagcgagctaaccgattgagtcgtccgcgtacaacaccctctcttcgtttttttttctccttccttcaaaaaatcttctcgcgtcagccgccgtcgcgccggaccgatcgacaacttagacctgactccactgggtcccttgactggtctataatactgttttttttttttttaccaacggctacaacgaatgtcaatgggaaaatatatagtgcaaaccatacacacacacacacacatatatatatatatatatatatatatatatatatatatatatatatatatattcgaaatctagaaaactgcctttgaatttaaatatgaacgtctaagatttattcatgtcaccaaacaataaaaattttactcgcaaattcaatcatgagtaaaaatgttgggagtaaaatttttacccttgatgatatggacaaatatcgggccttcattttttaatccaacgatagtttctaggttttcaccacatatataatttgtacttcctccatttcaagttataagtcgttttgactttggttaaagtcaaaatgtttcaagttttatcaaatttgtagaaaaaaagagtaacattttcaacccgaaacaaatttattttgaaaatataatcaattattgatttgatgaaactaatttggtattgtaaatattattatatttatctataaacttagtcaaacttaaagtagtttgactttgaccaaagttaaacgacttatctatactaatataaaaaggaggagttgtacccctccaatcctacatgccaaatcacccggatcaatccctaccgtccgtccgtcatctaatctaatctcatccatccatccggtgaaatcacccagaccgcatctaatccatccatcgtccatcgcccgcgcaatccccgccaccacatcctccccacgctaacagaggcaccgcgcgaacaacacatctgccctatgcgctcactatgctgtcacaccctaatccggcaccgccgtacaacggcacctgacaggagcgtgtcgtaggaataacggcgcgaaccacttcctacgaaaccgcgatctcagtaccagtcccaggacatagtgctggtacccacggtgacaaatatgaatcattgcaaatccttaaaataaatagaggacttatttaccttaacttaggttgcagctcaagacagcctgagaatacaaccgaagacacagacgaggaaacaccagcaacagcagcagcagcggaaccaacggtctaacacccaacaccacaggcgacagctgggaaccaggacgaaaccctaatcttcacttcacttcatctttacttcaaggcggaggaactatatatatttatatagagcaaggtgagtactttcatactcagcaagtcacggggacttaggtgtttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4259 - DNA, 711 bp, Oryza sativa
tcctcaattccccatcccaatcccaccaaaattcccatgtctcccaaccaaacaaaatacttaatagcctcatccctctaatcccaattcctcttaaaaactccctccaaccaaacgggccgtaaaatcaatcccgtgagtttgtcgccgccgccaccaatctctattctcgttccagtagttttgacttttgacgctatcccacaaatcacgcaacacatcacacgccgcacgccgctttggcgcttcctcacctccacaaatcacgcctcgcgagttggtcccgcaccatcaagtagcggcggtcggcgctcttccacgctgcccgtatcgttgctctcacggacgccgtctccccatcctgccatccgccgacgccccatgtcgttctcctacctctccagctgccggcgcctgtgctgttctcctccttctccgaccgttcctctccctccgggtgctgcaggttccccacatcattattcccttcctccacccggctgctgcaagtttcccagaccattctttccttccttcggctgctagcagtcgccgcttgtatctgggtgcggggacccggaaatggtgcggggccccggagggaccgggggcggggattgatttagccccgttcctcactccggggccggggccgggtgaaccctcaagaatgcggaggcggggccgttcctatccaagccgcacccgccc

SEQ ID NO: 4260 - DNA, 416 bp, Oryza sativa
tacccggacttcgtgttcgagtttgaccgtctccagccgagcgacgtcatctgggagccgtacacagaagaggccgtcgctgcgagagcaccgtggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgtta

SEQ ID NO: 4261 - DNA, 659 bp, Oryza sativa
ctgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaact

SEQ ID NO: 4262 - DNA, 599 bp, Oryza sativa
gacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacaagtgcgcaagtgtggccgtggccggccgtcgacggcgacgcttcatattgaagactactagcaccgtggatgctcgtcgggcgtattgcccctcagcttgtctgctggcaaagtcgtagactaaacagatggagtagtaaacttaatcacgtctactatttattttttctctacttaaatattaattaaaattttaaagtttgatcgaatctataaaaatgaaatgagcatagcttcactagattacttgtgatggaaacagctcatctgagcctaaatcatagaattgacatatatccttggaattaccgcttattata

SEQ ID NO: 4263 - DNA, 4996 bp, Oryza sativa
  unsure (1)..(4996): unsure at all n locations
acattatagagtgctccatttgatctgtttatcattttctggcctcagtgcccatgacatgtattttggtgttacttaatccattgctttttccctgcatttgtttgctgtcttttttttttctgttattgggtttcattcgctaagcaaccccccaaaatcattaggctatttaccacgtgactacacatgctttcaaatgaatgcagagtcaatttttggtgcactagttcttgactcttggtttggcatatgaaacttctaaagcagacacttgcatcatgttactttatttagcaaacaattggttctgttactacttctgagtttcagtcatctgaatattggttgattactcaatcactgtgcagtaatacctatacattaaaaacacaaatactccagcagtatgtagattattttcgtgcactgaattctctggcatagtaggcaaagggaagagcaatagtcacttgtgttagtcatactgtttttaagtccttgtttaggtgttttagcatccgctcccctcctctcttttgctctattaacagaaagaaaggggaaaaagttccaggtctgaaattttcagtacatctctgtactatcccaactctcttatgcctttggacagagcattttcattactatggaacatggtggatatattttctccttcttgatcttgctaataatgttatgggttaggtatttccttttgaatggtaaaggtgaaaaaattgaggagcagactggcactatcaggacaaattgtgtcgattgcttagatcgcaccaatgtaactcaggtatatactgtcaagtatagtttttgttgcacgtcaaatttaattgtagatattgtgaacacttatggttactggataatttacctaccatgttgcactgtantacctaattcttgatagtttctcttccttcttttgagatctgtgtggaagacaatgtttttttaaataagtggcattgctctttttttagactattacaaacctagatgtgctgccagatagatctacaacctgaattaacttgtcattttgcagaggcttgtctcattggatttatctaaatcaaatccaaactgttggacttaatatatattgatgtacccttaaagactggcttgagttactttgatttgctggatgatgtattctagaacagaacctattgactgatgtagtaagatcacatgcctcaaagggaaaagccacttcagttactcctaagtatctaattgcagtcaagtagactaggttaacttcaaagtataatacttaatacttatccatcggttatttatgtcttaatttcccctctttccgggaggtttcactttaccagaattctgattatcaatatgatgactaaacagagcatgattggaggaaagatactcttaaaaccaccttcgcggataaggggttttggtggttatggttccaataggcacccttccggtttttgtggcaaaatacaaagtttgtgagttgttcatgttcactaaccctggttcttcttgtttgtattcctcatgcttgtttgtatctcctatgcttcttcttgatgcaaaatactcttgttcagtatgggccaaccatggagattcaataagcactcagtactctggaactccggcattgaagggcgattttgttcggtaattcctaaatagaaaaactgccttttcttcatttccaaagtgcagcacatttactggaacagtgttactggaagttcatggtgaacagtattactggaagttccttctttgttatcaagagaaagaactacttccagcttacatcagaaaaggaaaatcatagtgattgttatcaccttgagtctgttcacatctgagccacttatgttttgtgtggaacttggaagttttaagagtttcaatgggctatcatgaagttgatgtccttttactattcttgctgaaatgtctccatacttgtgggcaaccaaataccctatgggttgtaactgatttccagcatgctaataaccatcagtgaaaaaaggcctaagatagttccagatcccatgacgggctaacattactaagtagtatacatgctcttttggggcactcataagtttgtgctgctaaatttatgctcgtttttctttcatattctgatattgacaaataaaatgcggcagcataatttattacttgtttgtttgttcccatatttaacaattgtttttgttttattaggtatgggaagagaagtacccacggaattctgaatgatctgtggaattcacttgctagatactacttgaataactttgcagatggcactaaacaggtaaatgactgactttgcatgaaaatcaataaatcagaatgaccaaaacaatgaaccccattcaccgctaatatgccagcttattttcttgtgaatttctcacttaatcgggatagaccattagtcatgcaaacatcctcaagcaatagtaagcattgcttttggatattggtagtgcattggaatgttttacgtggtcactcatttgccatttcaccagccctagaaaaatttaaaccaagctagagcattgccttattattattctgttggtttttataggatgccatggatctacttcaaggacattacattatatctgctagccgcgacaaggcaggtcccagctaaacaagacttctagagaattatgctgagggtacatttttgctgtaacggataatagctcttttatactgacacaagaattgctactgggaaagccttctttgttaccctgtcaaacacttacgactaggcacatgtgcgtaggaacttactctatggtctgtatgtatgagaaactgttggatcagttatggactgtattttgtatctttctccaatgggataaagctcttaattgcacaattcttattttgcagtccttccgccttgcttttgcattggttatgggagctcttatgttcatgatgatgtcactaagacaaggtaagatttctgtgactgttgaagcagacacagtggagtatatttaacaattgttttcttaacagatatttttcttaggtttatttgcaccgtgtcaggcagcatttcctctgctctctgtgcatattacattacacaaagaactctctcttacaattcttggttcctttaggttcacccatctgcaaaataattttgctatatattgttgccagttttttagtatgcaaccttttcttcgctctgatgtcatgcccagtgcgatttgcaaggcatagttgtgcacgaaagatgggagactttgtccaggtcctgactcctgacaaggagtgacattgctggtaatcaagaagtaacagaaaaaaagcaagtacaaagagagatgcacttaggcagttaggaatggaggaggacaagtgacaaggatatacatatttcttccttaatttattgatggtcactgatccttgtttaggatcacacttccaagcccaaacatggatacctaacacaagtcccatttctggtcgtaactcacctaatatatcccactttcctatatctcaaaaactcaaactcagtaaacaagatagctagtcataaaattcaaatccaagttacttggatttctgctgatatgatgctatgctacgcttgtaaaactgaaaaaaagtaaagttgcataggctaatactgctgggtgctgactattttttcttcttttgcatgttgcaaaacatgagaggtaaggtggtttagaacgttggggcttatttacattggttttgatagcatgactgaaatttgaaccgctcttataattgaggatggcattggacatgtatcacagttgagtaaaataaatttgtttcaagttataaccatccgaatacatatgtactttctcaaagaagattttggagtcacattctatttttactatataatgggaatatatgtgcagctaattaactgcttcaatatctctgcagccaggaatgatgttcgccatttagtgttgtcacttctatgggctggtctttgcattggcatcacacattttgtcagagccaatggtcgggtgttcaccaacagacctcgtttttatcagtcgcgccattgaagcaaaacaaccactttacacggacactgagctgcctcataggttatcatttttcatcagacagtcagcaccttgtttcatatgaagatatattggtcgcattttttgctgggaatttgaccctcccctatattgtaatgagttttattttccatttttgtaacaagtttttttttccttttccttctcattgttttgatttccagccatcttttggggcatcacgttcacgattctgtttgacttagcagtatataattcaatacacctcctgtacactgtttcatcgacaacaactatatttgacatatttttcttgcaaggattaattatgttcaaattccagaatggattactgatcagtaaaaaatatgttggcacagtttttcaagatccagagattttgtggtatctgcacctgtgcccccctttttacataattcgctatgtatccagagctatcagtcagttccatttcaagcttatgtctggaatacttgtaaatacttcaagcttatgttccatcgttatctcatttgtgccttagctgtagatatctcatttgtaactgaggcatgctaatctgacttgaaactcaattccaacgaccatttgtgcactgcacaaccttcaatcaatgagccatttatttttttcattgccttgtgcctaacagctgaagcattgcatccttttcccttctttgtgacactaggcattgcaagattgtgtcagtactcacttagtaacttcattcttgcatgtgactaggtaggtatgtatatgttgtttttgcaccttttgcacacaaattttgacaatttgaccctttgcaaaaactatttttacaaatg

SEQ ID NO: 4264 - DNA, 32362 bp, Oryza sativa
  unsure (1)..(32362): unsure at all n locations
catccgccgtggcacggcattcagcgccagctgacgtggcgttgaggtgtctaagttcagcgccaaatgatttggcgttgagcaaaagagtcagatttgaaataagttttggcgacggttcatttgtaaaaatagtttttgcaaagggtcagattgttaaaatttgtgccttttgcaggtatcagctgtgccgacttcttcagaatctgccctgcggcctccacttgatgtctgctgccttgggtggcaagtacccttctcctgttctaccggttagttttccttggccttgacacaatgcctgtattccactgtcatgccactctcccctcctgtcctgcactgcacggtggtctggttgtggttgctggtttggctggtgactttagtttctgataactctgaactctgaagtagaagcaaagacagacaggacaaggacaagatatgcctacttcagttcgccattgctgtcctctcacatcgtcgcattcttttcttcccatcacctcagcctcctcctcgccggcatcggcattgtcctcttgatcttgtcgatcgatggagatcgcggcggcggcgagccgtgccgtggtggacacctaccggccgttccaatccgtcagggaggccgtcgaggtgttcggcgaaaggtgcctcagctccaccagccgggcgagcaacgagtcccccgncggcgncgcggagnnnccgtcnccgccggcggtgctgggctgcctgaggaagctggaggcggagctggccaaggcgaagggcaagctggagcggctgcggcagaggcagtcgcacatggagacggccgtgtccagcgtccccgcgcagctaagcaccggcctcgccatcttttcggccggcgccgcccgcggcaagggcaaggagctcgccgtcgtcgacatcgacgtcgacctcggcggcggcggcggcagggtccgcagcgaccggtgggacgagagccgcgccgaggagtggatggcggcgagcctggagtacctgcccagcctgtcggaggcgctggccatcaagatggtcgacgacgatcgccacctcggagagaggaggcaggggaatgcgaggaagaagaacaccaagaacgccatgaacagcaagaagaagcagcagcagaagaagaatggcgtctcatttgttggaagaatcttctcatcaaggaaagataaatccaggtgatgaatgcgattatcatccatatatgctactgtgctttgtccatatatatatattagtttcctcactttgtgtgtcttgttttgaatagttcataagctgcatgctgcagtagctgcaaagagtgcgaggacttctttgggaaagcaggaattttgcattaattagttcaaatgctatgaaatttctctagaagtttgtatgttacaaatgagccctaaatgtccctgttggaatgcaggaattctgtagaaatttttcgaaacggaaacacggattaaacagtttatactgtgttcagtttcccaacaaaatttcttcggaaatcccgcgttccaatcggaattgtgagttttgactctttcatctaattggagtgagctttgtgactctttggtgtgttctttctatgagcaaagctcatgtttggtttctgaacaagttggttggcaggaggtatgccaatttttaaagaaatattatggtttttgtcagcccaggcaaccaaatttgtgggagtatcacagctactgatgaaatgccaaacaaattaagctaaaatatcacagataattcatacataacatagcttagtttgcaatgccaagcagaataataaactgactgatttttttcccatggtgatacctatgacagtccatagttactcatactgtcatacatgaccaacctcactgtgaataatatcactgattattttaagaaatgaaaaggcaacacactaattaaagactgggcagcatatgtcataagatggtagaggataaatgctgccccaaggttattatatgtatatatgatgctaattctaaggttaactaatagaggatatcaagtggaagaagagcactggatcgtatatgttgctgaatcagacgcgcatcctcttcacatctccttggggcacatgagtctctgttccattgccagcagggatgccttttccagcctaagaacaggaaattgcagaatgatatatccatcagtctgaatgttgttgattgcaaagaattaatgttcagtccattggtgtggcggtggagtcgtgaggtatatgactccatccaacagggttcaaatcgtggtgtcaagaaatacggttgcgtgcatggtgcagaggccggaagttatacttcctttatccaacaagaatgttcagcccaatgtgagagtgttttttttttaatttatttttcttctttttgaaagcaaaacatgaactcaccttctcatccggcacgaaggcatatagctctgatggcgagacccaaactttaactggaaaacaggattatatgatgtaagttctctgaatgaatgactgaagaattgcatgagcagagagacctgccagtagaagctgaaaaaaggcatgatgtgatgcattgcatatatttacctgacattgggacggcttttgatgattccagctgcttgcaagctgatccatccgagctcaaggcatcgatcatcttgggtatgttccttcaccaacagaaatattttcttgattcagttaccgcgcattaaacctggattttttttttttgcaaatgcgcaaatccttcgggtgcgagaaattacctatcaactatttcaccatggccaagctgtccactggtgccccttccccatgagaaaacatttttggcttctgtcagggcaagagtgtgcctccatccacaagcaacttgaacaactttctgcagttgagtggcatatgatacaaatgagactgaaactgaaaatgcgaaacttataacgtcaactgagaggaatccttcttcagatggagcggtgaaatagccttggtgatgatcacaagcattgcggttatcgttgcggaaagatcataaccattgtgtttagaaccacatgacgcaattaaaagttaacagagcaaaagggtgagaacaagtactccaagacaacaccgtttacctgttcgtttggaaaattgacctgcaccggggagcagtgatcttcattatcgccaacaccgacttgtccaaactacacatgacaaaaaaaaaactaaagattagcataagtgatgataaaatgcaaggataatggtggtaaattggtgctcagaggataaacatgtcagagaacacaagtacagacgattctcatgtagtacaccttactcgagactcaaaattgtcggagtatcgacgtggtttcacaaactcttatttcgccagaggcatgtcgttttcaagatatttatgccaatagaggcatccaaattgaacatacatgttgaattgaactgcatatactaatcaattcactgaaatatgaattactatagagtggtcacatatcattcatactccgaaaatcaagctgacaagtggggtttggtagtggtgtttggtggattggtgaaacacttggtacctaaaagtggaggttgtagtggtagtatggtgccctggaggaacagggaaaacggttgctatctgctgctgtgagatttttctttttccagatcaagacacttggctcttctagttccattgtgtcttaaagaacactgaatgtcattcttcagaaatgttttaagatttagtattcatcaacatataagaacatgttcagagcaagattggtgccttgttcccatcagcaattaatcaaacaaggggagtaggcaattcaccaatcaccttgttccatccccatccatagagtttcccatctgctgcaagtgccattgtatgcctccacccacctgaaatcttcatcacccaaaaaaaaaaagatcaactctacagcttcttcctattgaaaaaaacagtgtcacaaatagaatttcgacagattgctatattacaaaattcatagcaaaaggctatccatttatacttgagatattttttagataatatttatacttgagatatagtagtatccttcaatgcttccaacttgtgtggaaccaggtgatcctcaaaatcaccatgccctagctgaccatacttgctccatccatatgtgtagatgctaccggaggaggacacggtgatggtatggcgccacccgcacgctacaagcaccatcttttgaccctggaaaatcaacgaaaagggtagttttatcatccttgagaatgtaccgcaatgtatcccatcttctagtgtaaacttgatactttcagttgctatgcttcgaggtatcaaaatttttagtgtaaatttttcacacctacttgtactttctttgagtaccgtaaaatttctccatgaaaaaaatgatgatgtagaacataaatgataactgcaataagagtcagagacaaccaagagtaagattactgacattcacagaagaaactttttctgggattaagcggtcatcgcgatcgcctagtcccaagttgccataccgaccccagccccaaccgtagagatcaccatcttctgttacagcagcggtgtgctcggcaccagcagcaatcatttttacacggacaccctgaatccacacagtcttgttgttaattagagcaagtattgttcctaacagcctcaatgtgctgtttctgaattttagaggtgtcattctagatatttgaagaattttgcccatcaatgttgctattgtcacaaagcaaaaatgtttcctttattattattttattctttggtgatctcatgcgcaaatcgtgaagtacattgaaggcttgattgcgaccactcactgctcaacttctgatggtatagcttaattattttgcgtgatttcgaaattgtggcatcagttcatgaatacttcgtggtccatggttggggggctcatggatgttattattggcactcatagcctcggccaagaaaatcgtcaggtggaatacatttgtactccctcggtccctccctttatttttagatataaggcgtattttgactataaaattaagtctgcaagactaaactctgaccattaatttctcgtaatatatttttttaataggaacaaaaccaatattacgtggaagctctttgaaatacaaaatctataggtataactttaaacactaaaaaatatatttgtatgcttaataatgcgctcgtcaaaatcttcaaagtttgtccgtttcgaaatcaaaataagccttatagaagtgaatggagggagtagagtacataaagatatttcccgcggatgctgctatcattttcacttattcttttggtctattttgccttaccctgttccaacaaacagagctagatgaagacgttttgatacctcaaaagcttgaatcttttgtgggagcaaggagtcctcggtgtttccgaggccaagctgaccattttgattgcgtccccagctgaaatcaatcaaccagcacacaagaacactttgattatagggatagattaaatataattagaaacaaaattagcaaatagctcaaaaaataaatggtctaaggaatacaatacagtagaagaaagtttattaagaaaacgtatttttcgagacgcgtactaaataatcgtcggtaataatccaataaagttgctgaaaagaaatagcgatttctacgtaacatcactacctttcctctactccgagaaaccctatcttttctcaaaaggtagttttcctctcttaataaaagactagacatttcgctactcaaaaaaaagaatggtatttgggctcgcctgttcgaggggactccgctcaagggataacatcgctctggtctcacctactgtagagcagtagcgatcctataaagtcttaccaagatcacagaaccctgggtagatgattcaatcctagtttaatttacgcgatgttaattaagtatatcactcaataattagatatcactgataatttttatgataggtttgtcactgccgtcgttgagtccgatatcctcgggtaaacgcttgggcaagtcgtaatacatgaaagagttattttcattttaaactcagcaaggtgtatttgtattaaaggagagggaaacaatgtacaatagtcttaagactaggagattacatcaaacaaaagaaaaagaaagcgggtttgggagggtgtcgtaatacatgaaagagtagaggtacctgtggacatggccggcgacggtgacggcgaggcagtggctgtcgccgcaggcgatctgggtgatccggacgccctggagcgcctggatgggctgcgggttgaacacgtcgctggagttgccgtgacccagcctcccgaagtcgcccctgcaacggcggcggatcgaattctcagttcgcttcacggcggcggcggcgagatgatcgatcgatcaagcgcaagtgcgtaccatccccagctgtagagctgcagctcctcgtcggagtaggcggtggtgtggtcggccccgcagatgacgacggaggcgacgccccccggcgcgtcgtcgaacgccgccgtcagcaccgtcggcaccggccggtcctccgcgtcgccgtgccccagctgcccgtcctcgccgcgcccccacgagcacaccaccccgccgcctacacgccatgtcaatccgtcaagtcagataattaaccaccgcctaggcgctatctctctctcgcgcggcttactgagcagggcgacggagtggctggcgccggcggagatgaggacgacggaccgctccggcgcctccgggaccgcctcgtcgtcgccggcgacctccacctccatctccatgccggtcgaatgcatggtagtagcagacagaagagaacgagagcagagtgagcaagtgtgtagatacggctggtttaagtagccgtagactagcagcggctgatgggatgggcaacccgccaaaataatggcgccaattattcacactaagctactattttcgttttatattataagtcgtttgacttttttaagttaaagttctttatatttgaacaagttaaaaaatagcaatatttacaatatcaaattagtttaattaatttagcattaaatatgttttgatataatgtttgtttcgtattacaaatattactatgttttactgtaaacttgattaaactttaaactttaagaagtttgactaataagaaaaaatcaaacaacttaaaatatgaaacggagagaatatttctgactagctataccttaattaaaagaacagattttataattcaatacctacaagatctagcgtcagtgacgaacccagagattttatggagtatggacggaacaaaccatggctgctagactttggcatcgtcaatcatcgctgggatgaaatacttttttttattttttttttacttatggcatgacatacttgcaaattgcaattctactatgagttggcgagcttggagcttggacggctgcctagagttgttgcccttatgcatgtttcttcccgtgtatgatgtgtagggggtatttgtatggttagatttattctgcagcagtttaattgttagttttaaattgtactcccataatatatgtataatttgacaatgtctcgtctttttttttcccgaagcccatagctccatcctttggcctttgctatacagcttaatagcaaaggagttgattttgatttttttttttactttattttttatattggttattaatttgctaaaaacacatcaaattctttttgtcaataaaaatactacagcttataattagcagtagacgaaacgatgggactgtcatgtttgaagcgtgtgcgatgaagtggattatttaaatttatctaaacccttaccacacaacatctccccgcgttcaattagcatgcatattttctatgcttgaacatgggtactactgttcactttatgttgatgatgtaacaaatctatttataaattagatgaatatgtttaattcgtccattaattcgagcttgtgttgaaaaaggatatgtcacctattcaatcacgactgcaacaacattcatcagttaccgatggcagaggaggcaaaataagatgggaaagtgactggtgtacaaatcaatcaaactcatttttcgataattacttgaaaaatgctaaaagaaatggaaatggttctaggtaggaggaaggaacaagctccataaattgtagaggatagctagtgcagcggggcccggcgtatgtacgcgcgacggagacgccgcctgcatcactgcgcctgcatgatcactgcatctgcatcatataagaagagattaatgcttgattgtaacccgtcctagtgattaagatgcttggaactttgtatagttgaaggcacgcgcaacaccaataaatgagaggcgcgttgagaaataccggtggtgcgatggtaatgtagttggttctgtttagttcgcgaaaaaaaaattagtatgacatcagatgattgaccgaatgtcggaaggagtttttgacacgaataaaaaaactaactcgcttggaaaccgcgagacgaacatgttaaggatgtactcgtgactgtgtataaaaccgcgagacgaacatgttaaggatgtactcgtgactgtgtatggtggtgtgcacgtgtacatgtcttttatgtaacagaaaaacaaataaatagggaatctttcacaagaaacatttttcatttgattgcaaataactaatggaatttcaaagggaaaaaaatcagctaaacactcagaaagaatagttatcctttatatcctagaagttctgccaaattcccattaaatttatgcgttctagaaactaataacgctgccccggaagtaaaacagcgactgcaagtacatggtgagccccctgcgtcaaaactttcatgtgtttagaaaatggattagaaagggtgggattgaaaaatggaaatggacgaaaggatatgatgaaatgagaagagaagaatgaatggctaagattgaaacttacccttttaagatggaaaaacatattccaaacctatttttcaaacatgatcttactacattttagtagtagctttcttgatgaacttgtactgctattaatactgccgtccagtcaattaaacaggctgggacagaggatttattattggccacgcatccggcgtgtaaggccaggccagtagtactactcgagtactacagtaccgagtacactcactggtgatgttgcgatctatcgatcggtgatgatcacttgatcgggattcaggagtggttggcagctcgtgtcattctccctagagccaacgccatttcttccacattccagttccaagtcagaatttttttttatgtttgacaaagtttataaaaaaaatatattttcaacacaaaataagcatattatcaaaatatattcaatgttagatttaataaaactaatttgatgttttaggagtagctaaatttttctatgaacttgatcaaacttgatacttcctccgtttgtaaatatttgacaccgttgactttttagcaaatgtttgacctttcgtcttattcaaaaaaatttataaaatacgtaaaactatatatatatatatatatatatatatatatatatatatatatatatatatatatatatatacatagaagtatatttaataatgaatcaaatgataggaaaaaaaataataattacttaaattttttaaaataagacgaacgatcaaacatatttaaaaaaatcaacggcgtcaaatatttagaaacaaagggggtaaaatttgactaggaaaaaagtttatttgtcaaccatggaacagcataattataatgattaaacagtgatcctgatctgtaatctggctacttataccggctcctgcttacaaattcatatgctagtaggagtaccgtttactttaaatgccaatgtactgcactctctatctttgtagtatattcaataatactagtaacatgtgtcaataagtttgagagccgctctacttgctcaacaacttgcccatagatgcattcatttctctccactgtcttcgttttctccgtcggcgacatggcaaggcacattcacatacattttgaagtaaaacaatggactaaccaggcattgcattgaatagaagggaacactgtgaattatacaaaggaaaagagatatgaaaaaggctgtttaggaacttttcacatcccatgtatctttcttgacatgatggagaaagattgaaaccaattagccattttgcctgtaaaacgatttgaatcaaatcaattattcctatcgggattacacatagcgcagagggagccaatgggcaaattaattagtaaaagaaccgcaaaggcaatgacctatttgcagaatatgtttctacctctaataaactgacagtaacatctgctcctattaaatagaattacgggcgcacgcaattctgatacacctctggggctctgataaacaggaactacaatgtataaaccactatttgaggttcaaaaaccaggacttgggtcactccctgcctctaggtcctggatcaccctgctcctgagacgttggaggcagcaggcaactttcaaaatctttgattattgttaggaaatccccgtccttgatgattgtatggaaattttgttctcgccccatttctccaattcctatgtattctcccgtctctatttgcagccctgccacaatgtcccaaactgttgtgttcatgctgagacatctgagtggaaggacaaggactccctcttggatagggcggcaatggtggaaagggctggaaaggcacaccaggtgcgactttccagtttttgcgacatggccctccttcaacttctggggttccaaaatgctcaacaaaagcgattggaatcccgtatgaaatagtcaagttatgttgatacctctccaagtataatcctggagaaacccccgattctaaacaagcttgtccaggccgactttcctgctgagactcaaatccaggaggtgcttcatcatctgcaccatcggctgaacttcccaccacaggaacatcattgtgggagctgttcgttccccaattaccatgcaacttatttcccaccgagccagtccgaaactcactttgtacaggacaaactttctgaattttcaggccacccattttatagtggtcatctggttggtaatcccaacggctcttgcgttttcttctgatggatttccaatccatagtgttggctgaagttggaaaagatccaccagctgttgaaatgacatgaatatcgtgtgcagatatggatgcacgtgaatattctgttggctcatttcttgaaatatttcgaggggcccattggatccatctatcacgaaagttccgagcaatctgttgaacctgttaaaatcattatatgaatcaaacaggtcatatcctcacatcagagaatcactaagcctataaatgcaggtaataacaaacaatattcttattgcaaaacctatattaaagaccaacagatatcaagccagctaagagagaatataaattgtactccctccgtttcaggttataagactttttgactttggtcaaagtcaaactgctttaaatttaaccaagtttgtagaaaaaagtagtaacatttccaatccaagacaaatttattatgaaaatatattcaattattgatttgatgaaactaatttagtattataaatattactatatttgtctataaacttagttcaatttgaaacagtttgactttgccgaaagtcaaaacgtcttataacctgaaacggagggagtatttaactaagttccagcagtttccgggaaggctcaaagaatacagctgttcataagtaaacatgatgatgctaatgcataatccgtttacagcgaagtactcacactaatacatttgctaacttatttacaaacaaaaaaactatatgaattttcaaactatattggaaatttggattggttatccattaacgaaaataaagaaaacttgattttggttccattttttgctctaagcaaaaagacttgtcctatgtccatggataaactaagcatttacaatacagaaacaatcaatatcaaaccatgtatatgcatgacaagttcagaaacatgcactagtattaccaattatgttgtattgctttcttttaaagtgacatttccctcccaaaataattaatttgctgattgcatttgcaaacttgcaatctttctatactatgttcatggcctgaattgtatactatctaaacaaagagtcaatgcacaaacaaatacctaaaaaacaagataaaaatcatacacgttgggattagtatatttattacctgcatatcattatgccttaacaagcccaacatcgactccctgaagctgcaatgcgaatttcagagaataaaaggtaaggaaaaattgtagaattgatgcttcaaaatgaaaacttcaacagcaaaagaagctatatttagagcattaaaatactgtccatagcatgttatttgcacggctaaagcttagtaatacaattaatggtaaacctgcaactgcaattagatatacataaaacaagtgtcttgaattcaaaattgtcacctccaaatatactgttcactcagggcagcattaggaaatattctttaatatgggacttgtaatataataaattgcaatgctacaaacacatttcacaagtggttgcttgatggattacaaaaggccatacagaagatgtactagcaaaatttgaaaatttgaaagcttgaaatatcaaacatacaaaaataacaagcaagaattgcatttatttcctcggaagaccatgttttggcataaaaaatatgttgctacacaaagcaaatatacagaaaactataatgaaacctaagaatgaaaaataccaaatgaataaataccaaggttgaataatcaaacctttctgtcccagcacatcgaggaccaccatttatatgttcagatgtcagaatgcccttggaagctagaaactcaagtacctgaagaaagattactcataaggaaaaaatagggtcccataatgatataattctgtgatagaaatattattctcttttttggtatacagaaaataagaacagtggtgcaggcattgcactcattacaaattaaaagcatgtccatccctatctgttaagaaggtactagagcacgggtatgtagttagcacctgtgctatgggccatgggtttaggtgttacagcaaaaatgcttcgcccatgctaaacgtggtaagtggctcatgctaaatctctccctcgtacatttcacaaatgtttaatgataaaatctccaaaatattataacgttagcaccaaaaaataggtggcatataataattaatggtaccaaaggtctagggaaaaaaaacacccctacaattccaaatgcaatacgttttagcctactcaactctttcctaaatgtaagttgctttggaatttctatgcatttttacatcttttctttcttgtttgcccttgccaaataaatgccaccatctcacaaaatacattatcatcttttccagtgcagcataaatgaaggacaatagtcattttgagtttttttttcttgatttttgtgcacaagtcataaaagaatcagagggagtagataacaaggatcttgtgggggttgatatgtccactgtagcacctagatcagttgttaagggatgtacttgctctaatgtgatatattaattggaaactaatgtaataagacataacataaaaaagaaatgcaaaccttcacaagctttcttattataggtatcctatggaaatcgcttttattctgctttaatatattgtgaagcatttgcagtcctgtcagaaaatagtacaaatagtttattagtcagtaattctagatgattgtatttcacgtaaaaagctgcagaatgcaagaaaatgtaccattcttattgatgatatccaacaggacagaattggatcttgttttcagaagtgcatcaagaattaacgaaagatcccttacactgaaagatataacagaagcatatttagactgggcaaatgtaacttgctggatgttattaggtaatcaaaccttttagacgtgcccccagcattgtcaccttccgctgcagtcacaaggagaagcttcaagtatccatttgttgcgtccttttggaaaaaaaaattatcagtagttagaataatatccaatgacagaaaaggtagaatggagagatatttggactgcttgacgcccaattgatgcaacacagaacacatgcaaatattgcctagcctttcaagttcaaaccacaccgtgtaccaaaaaggatgaccaagaaacaatttaaacctaaagaagtctaataaaggtagaagttcaatcaatcgaaagtcgttcatacactatgttcttgagattgatactaataaatgtgagaaatactaatccatatttcatacactgtcttttagcatttgcgctcaagaaatgtggaataccactatataagtttccctaatccccaacgcggtgcaaactccgtaagagaatgcctcataaaaaaactgggttgatttttagccatttagcatatgacaacatatcctaattaagagttgatgccaaaaaatcagtaaaatatattcagtcctagtctataattgaagtatatatataatgcaaaggacaagaggatacatacttttcgtttgctaatacctccatttacatcaagcaagctgttcaatcttccttcaactgtgcatgtcaggtagcgatcattaacagtcatatgtaaccctagacagaaagagagatacacttggaagaacagtattacctcccaaaatgtgctcactgtcaataggagctgatgatggattcagaatcaaatgatgttttacattggttttcttattagcgtggaaacctggtacccagtggctccccaaatcggaactaggcggaattccatttgttgtgcttggaacctttggtccatccagtgtgcatggagccctttgcaaaatttctgatgaccgagtaccatattctggaaactgccgcgacgtactctcaactgtccgggacacatggacaggtgtgcggacgacatcttcatcatcctgtgggctcaatgcttctaaggaattttctggctcacttgtgtcaaataaggttcctgaagtttgttgctcagattctaactctggtgggttcacagatgggcaatcatttgaatcttctgttttagtggaagcttcatggtcgacaatatctagatgtgtgccatgagaggacaaaccatttgcaccaagtacttcctcagcatcctcctgaacagccataggttcgaaagtccctgcttcagcatcatcttgagtaatcatatcagcacctgatatgtcaccaccgatgtaaccccggcatttgccagtaccgcaaaagcatttttgaggagcagcaccagatacacgaacatagttgtaatcaaacgtcaattcttcaccctgtgaggaaataaatatccattaagtgcagcacatataatacagatataggttatactgaaggatacgtttcatttgcacaaattatctctacaataagaaaggtggtggtggtagtcagtgtatcagataaccacttgaattggggtcttttgcatgtggctaggctattttatatgacttttttttgcaaattaatatgtttttcccaaaaaaatatacaacattttaagttggtatttaaatttagctagtataaagcaaactctcagtttctcaggacctgcatcatgttcattgatgatttcaagtttctagccttaccttcttgatgttcctcatagcaaatattccaatgcagacttcaccattgaccatccactgctcacaaggaaaaagtaatttaatggactcaaaataagaatataactaattacacaattttatgcaccaatcattatttatttatttatttgtaaatataacatatgacttgtattggacattatcaggatattttaagtaacaaaggcaagggatctggtcagctattcaaatataaagatcaaataaaacggttttaccttctctgtacggcaattaggactgcagctatgattgatgaaccggcccaagtttcctttagtacaagcatctatcacctagaagagttcaaagcaaaatgccaaaagtggtattaactattaactgatttaattttaagtgttagcatcatgaaggttgacataagaaaaacagataccacactgggttgtttgtatcatctattgatattataggaaatgatataaatgaactaatctgataatttctaatcgaaggcatatctaagaagtggcagggattgagaaagacgtgaagttagaaatgagggagtacatctatgcaatatgactggttaagaataaataaagacatacctcaccaccattaagtgccatgaaatagaaatgcttctggcctttagaggcataatacctttggcgggattcataagccgttatatcaaggacctgaaacaacaatgaagtaagcaaatcaacaaactcattagacatgaggtcattcataatagtagaagagaaattgagttagagagcagattgcataaatacacagaatttctgtaccagagggttgtacagttttggataaaaatggaatttgtatatactagtatatttttaatacataagtcggaaacacgacgaagtaatatcagagttacagttgtttaaaaatatatctatataaaatagatgcatggaatgaaggatgctactaatggaatcattatctcttcattctttttgcttttttaccaatatccatgtgaaaagaatgagataagtatcctggctatgtcagaacaaggtattcattacaacgaatgtgaaaccaacataatcaacatttaaacagagcatgtttccctgcaaaaaaaaaaaaagaaaacagagcatgttggcaacacatgcatgcatgcacaaatggctcagtgcaatcaacagatacaaggtattatttagtgacatgccaacataaaacattgctcccatgggcaagttgcactaacagaaatataacgccaccacaaacccggaataaacagaggaggggggacgataggcagcatgaagcactacctctccaacatattcaatgaggaatcgtccttcagatacatcttccttcaattgcaatccatagccctttttaccagtatggaacttaccaagttttgcataggtgcgcctttggaactgttccaagaactttataagttcaaacccagcatagtaaggaaacaagaacaaggatatgaaagaatctaacctgctgattggaacagtgctccccacatggacatgtacgtttggtgcattcaatgttgagtatcctgttcaagcaaccatctctacaacccattcggtcatcgtgaggcggcttacaattgcataccatgctcttgcattattgaataaaaaaaatagaaatatcaggtttgtctgctggaatttcaacccccaaaagaaccaagaacaaagaaataataagttgtctacaacagttcaagacagtttagcctgtactccatccaggcacataaacatgttctttcggacatgttgtcaaactttcaaaaaattgaatatcgataaatttttaaataattagattggaggcatgaaaaaatataatcatgtgtgtagatttgtctcgaaaattacttaaaaatatatcacaatagaaattagtggtcaaaattgtattttgaagactggatatgtccaaaatgattttcagggctgtagggagtactgatagaaaataaaaaggagataatataaattcaagaggttgagggagcagaaacataaataatatgagagagagagagagagagagagagagaggccatggggagcattttacttgtcctgaacaacagtttccaccttccactaatcatgctgtagcagaagggagaaatggaaatgtgcgcaagtgaaactgactgtgaatttttgctgtaactgaaaacttgtgaaccatggccatccttgatttggagtggctatgatacaactgtctgcctttacataggcacttcagtaacagttttttccagcttatcctacacgcggcatgggaagtgaaactatgaggtaagtggagaaactaaagctctgtttggtattgcggtgccttatgataatctcgttttcagaaagaacttttgaattttggtgttgagcaaactgcctttattttgatcttggtattgcggtgccttatgataatctcgttttcagatagagcttttgaattttggtgttgagcaaactgcctttattttgatccatgtggcaaacgataatattataatgtaaaatatgaaaattgggaaaacatgacagatggataacatattttatctaactgtgattcgatttgtagaataagctacaataattataagttcatttccacgggaacttaaaaaacaagtgcgcgcagcacagcaaccacaaactgagcctaacaatgtgtagcatgctcaccccccataagatttattgcaataccatgttctgagtacaatacacataaactacaaaactctatatgaatcttaactgctccttgcacataaaaagcaatatggtcggaaaaaaataatgctaggtaaatttaacaaacagaaaacaaaagaatgtcaattaagaaataaaaagtgagtagatcaacccatacctcatcaatggattgtgtcctgcggttacgatgtagaaacaagtttgacctgagaagtgcaaagtttggttctccagaagctgcaacacagcaatatgaaaaagtttgtcacaaatcagatatgatagagagcaacaaaagaaaattttgcattttctgaccagaatgtatagagtcaaaaattcaaacctttcgagtttgatccatcgccattagcttcatcagcagaagcatctgaaagcccaagctctgcattgatctcatcatctgtcttctcttgtggtatagagcaattggcaaatgtcttatcttcgttttccttacaagtcctttgtataaacaagaaaggaaaatgagttgtaatttattaaccattcaacagataaagaaaaaattcaaaatgagtaggcaaacacatctgaaatgacatctacatcaaaaagatcaataatattaaaccaaatggaagaattaaaatatatattttcaatgtagcggagccacatgttggtaataaggttaatctttgccctctcaaacttcacaaacacaggtcatttttcacttttcagtctccaatgcaatattgcccatgtttttcattacaatatagtacatggaaactgtctgttatgaaagtattatgcaagacaaatcccatgacatcacctctcaagtcaaacgatatgcttctacatatatacattaatagtctacatgaatcccgtggaaagtatgagcataaatgaaaaaggcccatgaaatacgaatattttaaggaatggaatgcaatagatatctgtagttacactgtagaattgaacagcctctgtttgcacaggaaatactaatatgaaatattgaacatgggcacatctaacatgcaagaagcacctttcttcctctgggtaactggctggctgctagccaactgccaaaatgatagagcacaaacaaatgcaaaatgtaagatttactctacagattatctaaatatagtgtcagaagtctttcttcctttagaaagaaatatgttttccattttaccaaacttttctatttcacataggtgattgtggactagcatagcaaaacaaaaggaaatccaaacaaaaaggatttcaaatgagttattttccagtggaacaatgcagtaatagatttcagcgtatgattactcaattaggttagaggactggtgcaaccaagaaaattgatcaaatagggatggcaggatggaaatcaataccatctgagattttcttttgagattttatctgccagttcagttggtatgcagcgccatttttcgcaatcatcacaacaaacccaagcaggtgctggtggtacagatgcaccatcagttttgcaagcaacaactgcaggtaattcaacagatacggcagaagagttcttgaatacaagttcagcagcaggaataagatcacctgtataaataagatagttagcaccaacagaagctacttgataaatgatagtaaaggaggatcaaatgatagaagtcaaagatgaaaatatatactctgtttattcatgcgaggttctgacaggtcagttaactgagccggcaaaccgtaggtgttatcagctatatttttcttcttgcttctgcccttcccatgtggatcccgcaccttacccttctttcctccatgactatcctttttcttgcgccttagtgatttcacattgtcaaatgcactcccttcgtcatcattgtcaattccaaaaggacgcatattgtcatatccatgcataccaacatcatgtatggcagaagttacgaccttagaacaagaaccaaactttggaggtctcgtatgaagcagcaactcagatggatcaagtgaaggtgaatcattagaaaaggacacgagttttgaagcttcactagatgaaattttggtggaacttctatttttgtttatgttttttcccttctttccatctttctttcggcattcctgctttcccacatttctacctttcctcatcgtattggacttcgctaaagtttgctttccttcaccaatatcattgtacatcatggcatgtgatggaatgacatcttcctctcccatgtcgttctccctcacagttttgacctgctgctccaaatccatcaatgatgaagcatgatgattttcacagtgagaagtagataaagcagatgcacgaagaccacctccaatcaatccaccaggacaagatgggttttcatgcactataacatcaagggttgcagaagtgttgctttcacatgtaacagaagctatatccaaaacagagtctggtgaaaacccaactatattatttagagaacgttcagaagttgaagtaccacactctccatggatgtacccagggcatgtttcttgagtaacattctccaagccaaactgttgtgtgtcagtcaggctagatgttaattttagagtatgattaccttcaacacactgtgcagctttgtgagcaccattcggagaattgaacaatgcatcagaagaaacattagtatcaatcctcactgaacaggtcggttggccattcaattcacctgctaaatatccaatatcagaaagtgatgtgtttttatattttgaacatcttgaagttcgaattttccgaatagatagctgttttttctcgctagatcctctatttgatatttcttttcccaaacaagtttgatgagaacgagaagttgaaggaccacagttctgattgaaaccatccattagcttttgtaggctgccccaagcagaagagttcaatggcctattgatgccacttcttccctttgtggttttgtttgggaacttaatcatggtgcttttaagtaatgagcttacactgtcaaccttcttagatttgcgtgtactattacctgatttgtttatctggtcacacttctcaaaattagaatttcttgaagaggcagctcttactggattcctccgcctgaagaaaatcaccggcacttccttttggttatgagaaccattaccattctcaacaaaatcaacagagcaagctttgtcatcagtggaagtacacgtattgagctcttgtaccaaacagtctgaagattccagtccaagaccagcagaatcttgatggcctaggcagaaggcgggtgtttccctgccactataacaaggttcattttcacaaggtaggttatgggacgaactagtcagatctctctctgggggggattcagagatcacatgcttttcacgactttgttggagtggaaactctatttcagcacagggatcacaagatcttctagtgcctgtattttctacttcacaaacagatgcagttgaaccctttggaacatccatccagaagtgttgattctcatctccagaagcctcagtctgaggcctgctgtcaaatgaaagcataacttctccgagcaaatcatgagccaatttctccacaccaattctattttcagatatctcaccaactaaaccatcctctttgtataaaagaacatcaatggggctattatagttagagggaatcgatgcctcatccactggacaggagaccactacatcactttttggatgaaaatcatcctttaccagctcatggttagcaccagtcatcgatctcagaccgtcaccaccacgtggtaatatgtcggtgccatacttccctgaatccgacaaagctacgatgctgtggcatggttccacttgacctgtctgtaagccctcttcacatgtcttagcctccaatgtggaactctgattctcatctgcatgagactcctttaaagacctactctcacaggaaagtacacctcctcgctgtgaaccatgcgacactttctccatgattgctctatgctcagatgttttaccaatctgaccagcattgccatcaaaagtaaaatcaacagagctcacagaaattgaaggaactgaatcctcatggatagaactagagaactctcctctagtatttgtcaacaattcatccttttccagctgatggttaggatctgtcttcgaacatatgacattcatgccatatgatggctgctggacaccaaattctgtcaaatatggaaagcccttgttatcacattgtggttccttggaacacatctgtaaatcatctagacttttctctacatctaccccacctcgcaaaacaattccatcacacgccaaatcaccctgcccgcattgactcccctgtgtcaccttgttccccatgactgctatgtgtcgagcatccttggactggcatccttcactaagaggggcatataaaacattgcaccacaaatcaccattggccatatgagacatccccatatcattgagagtttcacacgcacaacctgccttgcgtaaagaatcatcaataccaccagaaaaagaagggattgaatcatcctccaccgacctagagacttcagcttcaatttttggtatcaaatcaacttgtttcagctcattattaccctttatcgtaaatcccaccccatcaaccacttgtggccatcgctcactgtcattatgcaaatccgacaaaccctcgctatcacaatgtggtttcgtgcaaaccatctgtaaatcttctgtgtttgtctttacgtccgttgcgccacccaaatcatctttactgtccgccaaatcaccatgctcacaaatgctcccctctgtcgctttgtccagcaagtaacgcatatggctgttatcactggagaaaacttcgctgaagggagcaaataatgtcttattcgataccccgccattgggcgcatgacacgtctgcaaattgctgggttcagcagattccacatgataactgccatgcttctctcccgccatgttcatagacccctcctgcatactagactccttctcaccaccaatctgaccccttccttcaaaaggggtagaaacattcacagcagattccaccaattctgcagcggagccacctccattatctcggactccatcttcctctgtgggcaggcgcctctcctgaccaccgcagaccttcccaccatcaccgagctcaccgccaatctcaggaacagcgagcaaagccaggccaccgccgccaacagcaccctcctctcctcccaaccgcccaaccgcagcatgatcctcccgcccacgcgcttccccgtcaggctcctccatcgaagcagcgtgtcagcggggagccgcacggatcgagaccatccaatgcacgcccccccacctcccctccccccgggtcctagccgcttctccccacctccgatcacacccaaaaaaaaaccctagaattcgcgagcccctgcaacctccaccgcaaacgaacgcccaatcagaattccgcccaaaccctaccgagaccaaaaataaaaaacaacgagagagagagaacaccaacctcaaacgaagccacactacggcggcggcggcgaatgcctgcggaccccggcgcccggcgaggaggggcccgccgcccgtccgtacgcgcgccgcggcggcggggggcgaggaggcggcgagtcgggtcgtcgtagtccccgcgtcgttgcggggaggaggcggcggagaagaaggcggatagggaggaagagagagagaaggggggaagaggaggaggaggagtataatatgaggaagcgaaagaaaaaaataaataaataaagcggaaaaaatagaaaaaaaagagggtggaggtgtgttgtgcttgtgcgtctctgtgggtcggtttttgttcttctttgcggtgcgcgtgtttttttccgtgcggccgttgggatgtggagttgtagggaacaggcgaattttgtgggtgttttgttgttagattttcttttttttttactgcagcatgtgtgtttcaagtacagtaatagttttgttgggagtaaaagggtggcacatggtggtgattggtgaatatatttgcttcgtttgcttctttttaagatgtactttattatatatttggtttcgtaaaaattactgttgtgtatattttaactatctatacttgcgcagcacggcaatttgtttgtttatctggtcgtttcaaatattactaaacttcaaatgtttaaaattacgaatatatctctataagcatggatatgaaacagcatgccgagtatagtgcgggcacttgctggctttatttcttttttgaaaaataacttattacatctatagctatgtagaaaaaaaactatttgtagcatgcagttaactgtgtatgagataataaattatttccttgcccgataacttacaacataggcaatatcaaagtgtccaaaaaatattagaggcgatagctttatatgcatgaaatagtttccttcatagaagtaccgtcaacatgcacaaccctacatagacacgtgtgtgtatcatttaaacataatatgagaaattatatagtcttaagctcttgtaaggaaacacacaatttcaccaaaacgtgtgcatacgtttattactgagatggtgtgatttagtataaattaaccctagagcacgggtttattcctcactgtgagatctaattggtgtgaaatttaagtaatgcttatggaacacggcaatgtgttttcttatcggatcattttgaacatagggaatatttaagagtctaaaaattgtaaccaccgatacagctccataagcataaattagaaacaagaggctggtacatgacgcaacacatatgcttaccttaaaaaaaattacacctatagctacgtaaaatagacaattgtagcatgcatttaaccatgaatggttatgcaagatagcattttatttcctcatatgttaaactataatatagaagttttcaaaatcgttatcgaggctacaactccataaacacgattttgtttcttaataaaagaccaccaacgtgcacaaatgcacgattctgatttaaacgaatcccgagatacactcatgctcttataagaaaacacacaaagttaataaatgtatgtatccattggaacccatagtataatgctatgatttatcaaccctagaaaaaatggaactcctttgatatgaaatatagttggtgtgaaaaagaagttggaaaggagtgcacacccgtggcagttggtggctggtgccaaagactttcaccgccctgtgaggttttgacttcaacccatgactgtaggagtgaactcagctccatggcagaatctttttcacaggggcctaaatgcttaacgtggcgccagaaggaaaaatatccaggatcaacaggaaaaaggggctgaaaaggtcaactaactaatcatagggacgccactatactcgcatcacatcggtcgacgtgcacaaaaaaaaataattgagcaggagatgattatataattccactccaaccacagtactagtgtactactactactcctaactttaacttggggaggccatatcgcaaatatgtggataaccggaggggccaaaccgcaaaagagccagccaagccgcgcaggcatcctgatccgctcgctctgctacgcgcacaagtcacgcagcgcgcgatcccgatgacacgtggggcccacatgtcgagtggggtcggggagtcaggcacggccaagctgcgggggggggaagggaaacgctgggatggcgtaagcctcgtggggcggtccacccggtggtgggggcccacctgacagcctgcgtgaggggcggcccgtgcgggccccacctcggtgcgtgcgtggctgcgtacccccgcttcttgtgatcttttgtccgtcgcgtggcgtggcgtgggcgtgccgtggctgcgtgtgtttcggtgcgtctcgccgtttttttttgtttttttgacgtgggattttgtgttttttttttctcttttcgtttcataaacgaggagcggtggggggtaaaccggtaaatgaaccccaacccaagctgcggagctgggacgctggttctgaaatcattgaattttgtagccttgtagtagtagacaacgtcgcaacgatccaacgacggtgagagctgaggagcccagatcagttatcagatgtatagccaattattggttctaaatcatctgtaatcaattcatataatagttatttataatcatatactttctctgtcccataaaaaataaatctagaatcagatgtgacatattctcgtacaataaatctggacggatgtatatccagattcgtagtactaggatatatgtgtcacatccagtactaggttagttttttatgggacggagggattactacacaattaatacacagtcccatctatcatatacacatgcatcttgtagtccatgctacagctggctataaatctgtagtccgttactcttctctctcatcttttatctccttgaaatgttgcagtgacctgagtagcactcgaaggtcctgagttcaaatctccattggagcaaattttagattgggttatttgagagctaagttccctgttcgataggctaagttcctaattttaaaaaagctgcatatatccacttggatgcaaaggccgggtaaaaaaatacccttctctaaaaaaacttcttgaaatgtgtttatagctgatttatagtctgctattgtacctgctcttagtgaccaaaacaacgatggtttattcgaaggtttgggcttatattttgtctcgaaatttgattgtattattagagacggtcaccgagtcatgagtacaatgagatgtggtacttttttttgaaaaaaaaaaaacagagctatggtggctagtaacaaggattgcgacggaactctctaagggcaagtataatagactacaagacagttattagcttgggtacgtcatgcaggggatagtaattaggagagagaatggagccaattcgaccacatagtcaacggtcatgcacggggcaccgaagctcatgcatcctgcactttggatcatcattggacccatcgaaaatatagcgaatcgaatataaaagttgaactcagattgatagataaaataatagtattttagagtataaatgattattataaatgttgcctgcagtgcttgctatagttgagttgctaatgtttagagcccgcaacgggctgtgttattgcccttgctctaagggttcgaggttggtgtatcatgatcctctctaattttgcatttttattctcacccgtctaaactttcttgcgttttgcatgatgacacgttttccttcaaatgaactaacgtttcttctcttttaagaaaatggattataaccccaatacagtctctatatctaaacctacattgtcaataactaacatttcttgagatagataatgggcaatcatcccactttttttttcatacaataattaacccaaaaaaagaacaaaatcaaccatgaactctgccaacatacacagtagatacaaaaataaaattggtgcaccggagtatattgtgctatatatattatgcatttacattataaccctaatattttgcttggcggtttgttaacccacaaaccatataaccatatttaaaatctaaggcattgtttagcatgtttccagatactcaatccacgttagttttggacttttatccaattaaattggttgcaaatatttcttttaaaatagaaaaaaatacactcatatgttatcaatatgatcatatattaacctagaattaatcatcatttatttttagtcttagcttctaaaccacaaaattaaagtaggaatataaacctataatttaaattgcttcgatcatgtgtcgctgcttataagccctactgctctgtccctcccctccccccccccaaaaaaaaaaaactggatttgaatgtggatacatatatgtccagattcatactcggtaaaaaaaaattaaacctcgggtttgaatctgaacacattgtgtgtccaggttcaacccaaggttttttttttacggaagggggtagaaaataaaactcagcaaaataggttctaatttttcagctcaataaaatccagagacatgggctgtgctctttggacaactttcctaacatcattctcgtttttcgcacacaagcttttcaaactattaaacaatgcttttttttaaaaaaaattccatagaaaaattgttttaaaaatcatatcaatccatttttatgtttttttgctaatacgcaattaatcctatgctaataaggtatcttgttttccgtgtgaaaggaattactccatccattctaaaatataggacacaactactttttaaaggtgtttcataatataatgtgtgcatgcatgcatggtaattaattagcatatcttctcttctaaattattattttttaaatcatacactcacatgatgtttaattctattgggtgcatgtattgtattaattggattgattcaaacaaagagatgataataattgtttcttggttattagattataggtggttatgccttatattttggaatggagggagtagttcccaatacaaggaaacgaacacagcctaagtggagtaggcaagcaagttttttttttatgtccgcttatcatcattcctgttaacttttttttataattttgtagtaatatttactaatcagatttattatccacttacatgagtattcatacggccaaaaaagagcaactgaaaactaagtccttgtttagttcccaaataattttgcccaaaaaggttacatcgaatctttggacacatgtatggagtattaaatatagataaaaaaaactaattgcacagtttgcatggaaatcgcgagacgaatattttgagcctaattagtttatgattagtcataagtactacagtaacccacatgcgctaataatagattaattatgctcaaaagattcatctcgcggttcacaggcgagttatgaaattagttttttcgttcgtgtccgaaaacctcttccgatatctggttaaacatccgatgtaacacctaaaaattttcatttcgtgaactaaacaggcccttagtgcgatgcgcttatctgagacagagggaatattacaattttacgtactccctccgtcccataatatagcaacctagtaccagacgagacacttcatactacaataaatccggacatacttcctgtccagattcattgtaatataaaatgttccatccagttctaggttactataatatgagacacagagggagtacttgcttacagtaacatatcaagagccatactactccacagtttacactcgctgtcatgcgatgaagggggttccacctaagcctgccaatgggtctaaatccaatccaaaaccaatccaacccaacacctgccgaggcagcccaccaaaccaatccacaccattttcccatttataagatccaacccaaaccaacccccaagcacttccaggccaaactaacccaaaccattccagcctaatgggttcaacccattttatatccatgggttcagtccacgtacagtccaatcttcatcaatcgtcaccactcaccatcgggaggaaaggtccaggacgccgccgcgttcgtaaagatcgagcagctcgttcccctttccctccctctcccttcgctttctctcttccttcctagggcttcccctcctcggcggcgcttcaatcgaggaggagttggtcgtccacgacgtggtggtcggtgtcgggctgagcggcagcagcagcggcggcggtgacgggacggcggcggggaggcggcggaggcgcggcttggcctcgtcgtcgtcgtcaacaacggcgacggcggcgtggtggtgtagcggcattgggcagttctagaaggttttagaagggggagggcgctgctacgactacgagctctgatatgaatctgcgtctcttaagtgtgctttctagcttgtgtgtgtgtgtctaagcttgctttgggcttaagctttggttaagcctcacacacacttcgctggttgctgctgctgggtttggctttgtactgatcactatattcagaggccattagtgcaatccactcgtatccatgggttgaatccatggttacaatccattttggacccgaaagaattttaaccacatccaaaccaacccacaccgtttttcaatgaatccaaaccgctccagtccattatgagtattgccccatttgaatccaaccaaagccagtccatttagaaatccaacccattccacccatttacatccagtccattagcaggcttagttccacccccagtcaaaaccaggtgggccagcccagtcaaaaccaggtgggccagccagcgaagtcaccctcattgtagatcgttgacccaagtgtcagtcagtcaattcacccgacgggtgaaagaacacttcctcttttcccccccgggatgtgacgtgcactcctcctcctactagtagtagaagtggtactagcagtaggttctgaaatggtcaaagcgaaggaccgagtaataaaagagaaaagcgaacaggaatcatcccccggttgaccacgccacccacggcgccacgcacggccagcatgaaagccccagtcaggggtcaagtccccaccaacctcacctcattttccattttccattttcctttgtgtttggacggttttttgtttattaagggaaaactactcctaacatgggcatttgtgattctaatattttctgctaaactagtacggagtagtacgcatatgcatttcaatggacctttgattcatgggttcatgggcttatacgactgggaatgggcttcaagtttgacagtggggaattatattttggaataagttcactggaggtccctcaacttaacaacgagattttttgtggtcccttaaccacaaaaccaagaatgtgtacccataaactatacaaaaccgtttaaaagaggtcccaaggcagtataacagcatggtttcgctgacgtggcattctagtcagcaaaaataactaaaataaatatgtggggcccacatgtaagcgataaaatgacgtgggtcccgctttttgtctcttcttctctcgcgcgggaggaggcaggcggagcggcggtgtcggtgagtgagcgaggctgtggcggcaagcggtaggcgagcgacagctccaggcgtgggcgaagcaggggacgcggaggggcgagcggcggtgggcgagcatatgggggagagaaggccggtggcgggagagggggagagaggccaccgacgcgacggtggcgacgggagaggaggcggttggcactatggcgagctccgccggcgcgacggggcgagtggcgacgggggagggggaga

SEQ ID NO: 4265 - DNA, 6914 bp, Oryza sativa
tcccaccgccccgtcgcgccagccgcctctttccccctatgtcgctcgagagaagagaggagaggagaaaaagaaaagaaaggagatatgtggggcacacatcattttctctcacttacatgtgggccccacatatttattttaactagttttgctgactaggatgccacatcagtgaaatcaggcctctatactgccttgggacctcttttgaacggttttgtatagtttaagggtacacatttctgattttgtggttaagggaccttaaaaaatctcgctgttaagttgagggacctccggtgaacttattccttatattttaggctctatctgattcgcatgatagaataaaacatataaaaaaaatacttgaaacgataatatgagctcttctgatggtgttataggaaaaataaaggtaagtttacaggtcatatcttttggtaattttcctatatattattttgtataaatcaaaggaaaatttaggggaaaaagtctataggatttaaatcctattaatcaaaggggctcttactcattatgtttttctattttccagaggttttcgaggttagacagtgagaaaacacgttacctaggttttgtttagaagaatttttagcagtggtaacttctcatagaatcagaaactcccccaaataaactagctttttttttatctaggttataagttgtagttacagaatccaaaaatgaattcgaagtcaaaagttgagtgattaccatccagctgcttattagataagctatatcttagttatttttctataggtgtttacaggaaggatggtcccaatctagtacttggatgtgatataatcctgtccagatttattgtactatattatatctcatttaagcaatccatttgtttcacaatgtaagactttctagcattgtccacatatatatagatattaatgaatttaaacacacacacacacatatatatatatatatatatatatatatatatatatattaatgaatttaaacacatatatatatctagattcattaatatctactagaaagtcttacattgtaaaacgaatgacaacgaatgaagtattagatatgtctagatttattatactaaattatgtcccatctaaatactgagttttttttttggcagaaagagtagggtgtatggagcgtgctccgtgcaacgagggtggggaagcgagtggacaaatgcctatgctattataaataaagatgcattaatagattcccctctccttctcccgtagctcaacacgtccctatactttgggtaaataacagtcaaatccaatattttatcctcggttactcttgtaggccatctctaataatatagatatatgttccgtaataatgtacgagtatattaatagtataacaaataatttagtcatttgtatcctcttcacaaatggaaaggaagccactggaaaaaaaaggttggttagggctttgagcgtgtccacacactaggctaggctatgcagtctgaatatcaccttacgcattaccttcttcaaggcccgttcgaacctgacgcattccactaaaaatagtgaaattcccaccgacatggcaaaatttcacaagcaaatacaaagcggcattagagatttaaagtaaaacataagtacacgcagaaaccaaccaaccattaacagatggacctccttacccaacgtacaaaatgaggagagcacattaggcacatagctgcttctttggcacaataccagacaaggccacattttccgcgcatgaccaaactaaaacattacttgatattactagacagggtaatgaagattaccataccaaaagtgcaatattcctcggagtcataaaagacagacgtaggcttagtctacttgcatcacaagagaatgggctccgatcacgcattctccttgatggcctcatctatagctttgatattgtccctcagtatcttccactgcacatgttaaaaagaaggtgagtgtttattgggaggaactgataacttgctagtacagtaaccaagatcacaatggttaccacagtagttatgaactagattgcgatgtaaaaagttatggctagcaataagaattgttacaggtataagttatttgtgtttcagtgcagctagaggccagaatttaacagtatgcatatcatatctggcatataatatacttgagatcattctcgtaaattagataggtagttctcaccaatcttgcatagcactatctcctgatgagttcaggatatctaagcatgtgaagcttgttaggaaatttttcataagcggtacttgctatccacaatgcagcattcaaacagataatgatataggagtatcttttaagggaatcaagtttcgtgagcgtgtataggacaaataaaaacactgacctgatccatcgggagctgtatacctgaaaagaagggaaaaggcacaatattagtaatcagggaaactattgcttatcttgagcacattaccgctggtgctggagatatggaattaaattacacaaccactgttttttactatgcatccacacttttatgttataccatgccatctgtgttatctaccatatggaatcaattttagaattggaacccatgttctgggcttagaaaaagcatatgaaagccccggaatatttgtttgcaaacttatcattacactctttggaatctaataccagactaaaactcattcatagctatcaacttgggtgactgtgaataggagtattatcgataaccccccaaagtagatggtctcaaattacaggtgatgagatgagagaaacccatattgttgagggcatatgcaattgaacagggtaaattctccctcaacaattttctacctaaaattgtgaatcagtgatgggttcttcagactttcacgttcatttatacttgcaaatgaccaccagctcaagcttcgaacttcgaacacaatacattaaggaatcattatgtcgacaaacacaaaaatggaaagcaaccatttcgccgataatcatacacggtcctaaaggccagcgggcatggggtatctaagctaacgaagccgctcgtctcaccagcgtcccgcatttagttcaagaaacgaacctcaccctttttttcttgcagcctagattatctcccatgtaaatcattcgttcaaacaggacaccaacaattcaacatcatcattcacaagacatgaacacatggtgtggtactatctagtatctactcaaaaagctagaggtggcatgcctctagcaacatttaacgaatcttggccaatccaatcccgtgctattcacatccataggggaccaaccaacgggaagacagagaagaggaagatttcactgtgatattacctttgcggccggggagggtcttgccgtccttctcgtagaactcgcggatgtcgacgacgaccttgccgttccaggtccgcaccgccaccctcctgttcttcgatatctatggccaaaccaaccccccccccccccccaaaaaaaaaaatgaaaatgaagatccccgccgcgctagggttttagtgaggtttgagtgcggggattagggaagcacctgggcgacgacgatatcgtcgtcggcgctctcggagggcccgtcgtccccggcggcacggcgcttggccgccggctcgccgccgccgccgaaccgcttgttccccttccgccacattcttctcacactttctccctctggacttgtggagtcttggaggaggaatgttcgaatggaatcgacctaaattggaggttttaattcccaaatcagaatagtagtagtagtagtactgaattagtgatggttcagttgggccttccaggccattttagtgtgtggaaaagatgtccaaggccattttaggcccagtatcagtaatcctcctcagcataacgggaaggaattaagggtgaaaacggtacggaaattttccggtcattaccgatactgttttcataaaattaatataatagtaatttgcagataactgcaaatgtagtcactaaattatttatttgctacaacattagcgacctaacagtttgatgtaatgataacggagaaaattatcacaaaaccataactttgaaggcatcccaatgttactgacatttggggcccacatgtcatagaggtggtacccagcataggcgagggacggagggacatgtcagcatgatacgtcggcttgtgcattgcagcgacaccgctgtgtcggcagactgctaagtccgccactttgatttggacgccttgtaatgatctaatccgattgaaatgccactcgtacttaatcagtgcaccaagtcaaaacccgtcaagcttcaaaagagtagagtgtaagacaaaagtaccattgccgtaacctagaatgggttttgacccgattacgtcgacctagcggattcctctgccgacatggcatgatgctacaacgtactgctccgtcccataaaaaactaactcctaactacaaatctggacacatgtatgtctagattcatagctaagattaaactctttttggaacggagggggtatgtgctaatgtgctatgctaacaagtcgtctgggctctatgtgtcactagcttatggtgctcttggacttggagcaaactataaaatatattagtaatgttgtagcaagctgatattttagtcattaaatttacggttatctaaaatttattcttaatataataataataatatctctaccgcctgttaccgtttctaaaatttagtttttctattttttatcatcgttgcattaaagttgacaataaatacctaagttcaaaattttactaccatttctgtaataataaaagataataataataaaatgaccgaacatttccatccctaccagtaatagaaagcggcaaacagacccccactccctagtaaaatcagtaattctagccgtccatctttactttaccctctcccctgttattttctacttatggatgaatgcgcacaatttccaaacttctaaaccattcgatttgtgcagaactttgaatttcttaaaaactgcttttaatccatttttcaactttataatggttagttcattcatttgtactctcaaataattatcacaaattagtactacctccgtctcaaaatataataacttttagctataaatctgattaagcaccttttcatattcataactagaaatgataaattttgagacaggagtaacatatagctatttagtcattagcacaataaaacgcaaacatcgagtctccatccatatctcaatgcatatgacatttttatcccaaaacccaaagaactggattaaactggaggatcagcacattttcattgtttctgtccgtctacatatatatacatctagacctgtcttaatgtaggaatttaaagttttcctacgaaatttctacttcagacaatgcctcgatctaacaaattaggccgagagccccgatctgacttaaatcacttctctacattctccagttgtgaatcatctctctccttttcttcatcctctttacacttctctacatcctccatctgtgaatcgtctttctccttttcgctatcctctccaactgtgaatcgtcttttgttggcactcagacctgatgaatgtagctgccctcgtttcttaacaagacgtgctgcagtttcacgatcagactttgcttcattgttgtcaggctgtggaaacaaataggaaaagtaagatacttatataattttttttgaggggaataagatacttatatatgatagcttgttgttttagaaatatatatcgcagctaacggatgcatggatggtaatcagaacaggcagttggttgcaaagcaaaatggatacctcgattgctaacgccttgtcaaaagataatatagctgaatctggctccccaaaatttaactgtgctctgccaagtgtaacccaaccctgcaagtcaatatatatgaacatatctcattcatgccgctgataaatataagggctgagaactgataggattcacgcattaagtaatactccaggagtagtgtttctgccctggggatgcctactaacctcaggccataatggatccaattctgttgcccctgcatacccgacatagagtaattaatataccagaagtggagaaatggaaatgacacaaatatgctgctgggatcatatactaatatagacttcacatgtgaccaaaataggcaactgcgcagtaattcattcacaaattaaaattattcttcatttttatgtatggaatgcagtaattcttctttgttcttgattgaggccctactatttatagatgttttatgcattttgcaatgacctgttaaaagtaccaccaaaacacacttttgacgggaaaaaagaacatggattgagtaaatcctagataccgcaaatcggtgctaaaatgataatccaattaggaaggatggtactgttcccaactcatggcatcctagtaggtcgttatcattagaatccttaaaagggcaagtaaactgaacaagagcatacatactggttgctgctgtcagtgcacgccatgcatctcccagctcaagtagaatctgagctttctgttcatgaagtattgcattattgggcatcaaggtaagtgcagcctcccacttaccaagtgcttcatggtacttcccttcctaaaacaataacaataagataaccattatctgccttttaaattatcgtttagcgtgtgctgaatgttaggtaaccctgcaggtgcaggccccaactgcaaataaaatctagtacatactgtcaaaaggaatttgatgtaaaaaatga

SEQ ID NO: 4266 - DNA, 19861 bp, Oryza sativa
gagcttggtttggttgtagggacagtgaaaacaatgaatacttgagtccttcaatattaagtaaataaataagtttgtccatgtaacatagataaggagagtagaggataccttggctgattattaaaagaaaagaaaagaaaataaaagaaaataaaagaaaagaaagatacctcagctagcctgttcccctggtgcttgagggactcagcattatcagatggctttgttccaggacagtccgtggtaaccactcttgtttcctccttttctgtctcatcattgtcactgtccaccccaaaaggtaggcctggcttagatggtgccactgagggctgcctattcgtcttagcattcttaccccaagttattttcatcttggaactgttacatgagatgggctgacaggagtcagtttctttaactagaaaagcaacattcctttcacgtactcaaccattgaaggaaaaaaaacacccatatttctacaaaaacatagcaaattaagtagggaaacataaaaacaccagaaaaaacagtcctacagattccatgtagtgctcatactaaagtgacacactaccatactgatctataaataatatacacatcaatactttcaacatctccgaccagtgggcatctgttgaagcattggacttaggttcttgatattagtagaaaacaagtttgaatagaacacctgtcttatctgtaggctgcagcacaaccaaaaaaggactgctaaagacctgagacaagctcaagcagtcaagctgattataaaattcgtcccatttgcgtatggatatcgcataggcctccattcatgaagacaacttcaaactactaacttctaaagtcagaagatgaaccagtgttagcctcttagagcatctccaacaggtacccaaaccaaattccctatagtcaattttttgggaattcatttagattggcaagtgatcaattctttcagattgctatatatttgttctcatacgtcgtgaaaaagaaatatatgcatgtgatctttgtggaaaaacattggcagcaatggttaatctttgtagaaaaacacatgaagcacagaaggaaaatgtgatttttgccgttagctgataggtgtgaaaaagaatatgcctgcaatctgttagctctgggatacagtcatacgtaatttgattttcgcacgagctgttagcttttgtttagagaatgtaatttttccttttaaaaaggggataagtttaagaacctgcaattttctgtgaaatgtgttcaagaggagtgattggaagttgctatgttgtgtgccattgtgaaggcttgtggaaccagtgatttttggtactatgttataaggtatctatatacatgtatgcagagaacaagtcattttaaacttgccaatagaagaagaatgaaccaatggaaacgagcaacaacaaatgcgaataaaacaaatgtcctgaacacaaacctgcgtacagaaccaccacggcgccgtggtgcattgtcaatgtcatattgatgttgtgctatgagtgctgctgccagaatgagttcatcatcatcatctgatgatgacgaatccaagagttgatgcataagaaagcctctcattgtgatgtgctagaggaagaaaaccatcatgaagagcaaatatgtagagataagaaaaatagccactcggaataaataatttgaagagtagattgcagagaaccccattttttgtggttaaagttccggaaaaccgcacatacttgcacacaaccacggatttttttaatggtacaaaggtttcatgaaaaacccaaatttattcaaatcacaattactactccattagcatatctgaaacaattatattgaaaggagtgaagaattaaaccaaacacacataggccccgttcgaaccaagatgaacttaagggcacacaaaacaagaaaaccattagtgtataattaattaagttttaattattacaaacttgagaaatatatatatttaatattttagagcaacttgaaactgcatcttaattagaaaaagaacgggttatagaggcaagcacgaccaatgaggacatagggaatggttctctttttgggaatctgttgattggagatgctcttgtgcatgcaagcatatcatcaaacaagttgtgcgcggtgcggccaccgactcactcaagcctacagaggcgagcagcactgcactgaccaaagatcgctaggcaaaacagcgggacaagccgcgcgcgcgcctggaacaacaagaatccgctcgccggccgagagacagaccgccctcgcggcggctgcaacatcatatcacaacatggggttgagggagggtgccgcgggtggctggcggaggactcaccgatcaagcctggaagcgctgctcgctgctgctgcaggaggagaagggctggagcttccggcgaggagaaggaggaggcaagcggcgagcagagagacgacgacggcggcggggttgtttccgctgctccgggagaagtggaggagattccggcggagtggctgggctgacgtctccaatgggccttttggaagaagtattcgggcccagatattgggccatccgggcatcactgcggcccatccaagataagcataagagggtttaccttttttcgattttttttgctatgcatatccattgacaaatttctcaaaaaatactctctactacttaatccgtaggtgaggaatgcgcgatcccatcgcgctcctcctccggatcgcgacccgcagttagcgagaaaataacggcgccccccaatccccggttgttgcgtccccttcctccgcatccaacctcgcgccgcccccacatcgccgcgccccatcctcctcgccgcaccatgcctccactgccggcgcccccttcctccgcattcaacctcgcgcgctccccatctcgtgcgcactcccagagattaaaggagtgtaggaggatctgataaaaagtggagctattttcattgcgacgaagttggtcagctccaattatttatctttctatatctctctattttttttacaaagttaggaaggagaaggatgcactgcagtatcagttatcgtatgatgtaactctctgtttgtactgctatgcttatttagtacttcctccgtttcacgatgcaaggctttctagcattgcttatattcatttagatgataatgaatctaaacatataaatgtgttatattaacatctgggcaatgttagaaagtcttatattatgaaacggagggagtagtaacatttatcagatatcgtctctatttagttctgccttctcaatctaaaataataagatacgctattaatatctaggctgaatttgatcatcgtgtgttacgaatggaatgtggtagacctgtttgcgaagttacagtgtcaacagccagtttacttgcatattagattgtcctaaatacatacatttctttactaaatgtagttcttgtcacaactaaaatatgtgatgtttgcaatcatatgtaagttgtctgatgaatttcaagaagatgcaggtaaaaggaagcctggcaagatcaaatcaaatgggaaaggacgaagggcgaaggctgtcgcaatttcccccaagctcgcaaacttgagctggtcagaaaccagtactgagaattcagcttttcatttatcactatttacatatgctagtaaggtgcccatgcgttgaaatgggaaatgctatatatcaatttcaaattatgttaagtgaatagatatcaaatattcattgagtgaaaatttgttgaacacatatgcagattaatttcaaaacagaaatatgttttcattacataagcataatgaaagctttctgcggcatgaaacaatctcatggtgtttattaaattataaaaagacaacatagatagaagactgctatgaaaatttaagagagaatcccttatatgccactgaaaatttgtctgatcccttggatgccactgaaaataagctcttcacttatatgccattggttcaaattttcgctccctctcatgccactgccatccgttgactggtagttgactgttaactgtagagtgaaatgacgtatttgcccttcttgagttgataggcatgcagtaggtgttagtatgtcagttatatactacattttagctaggcatcacatatatttggaataaatgaatatatgaatgtatagcattaatctatatattgaatatatgaatatttttcagtcacataattttgaggcacatatttctctgtttttcatagtagaacaaagcaatctgttatggcattaatgtatttttcacatacattaaccatgtacttctcgaacaaaagcttcaacaatatttactagggagcacaacatttctctgtttttcacagtatcgacaaaacattcaagtaatataatagattgcttctgacagacatttaagataatgtgtaattgcacattgtttgtaatgcacggctaaacagctaaaataacaaacagattgtttgctagaggaaggagatatacacagtagcacagaatatgcaacaaatattatagggagctgtttaaatgaccagagagtaccaaaatgcatactgacacagtaccaaaatacatgttcaggcttactgacatggtgcatcagagggatgttgggcttggcccacttggacaattgggccatattctcatgtttgggccaaagggtatttttgtcatttcagtaaaaaaactgacaagtgattacatcctatcaacagtcaactaccagtcaacggacggcaatggcatgagagggagcgaaaatttgaaccaatggcatataagggaagagccaattttcagtggcattcaagggatcagacaaattttcagtggcatataagggattttcccaaaatttaatgatgtcatacaaattaaagcacaaacaaaaaatctagaacaacaagtatttccagatattgtatttttcattgataacaattatgatttgtagtttctttggattgccagaattgttttccctgtgttcaacaaattttcactcaatgaatatttgatatctattcacttagtataatttgaaattgatatatagcatttcccattgcaacacacgggcaccttactagtcaaatgtaaaatactatataattatagtgtaacctaaatttaactactatatccgttcccaaatacaaaccatagttattagaataggaccatcacgtgaagttggagaaaaaatacggaaaaagctgcagaacttggatacgaacccaaaacctccatgcttccacggaaagcctcaaccactaagctatacggcttattgtgaaaccaatataacaaacatctaattgaacctgtttaaaccggcggtttgactccgaccaataaaccaatgacccgagtgccttaccggtttgatcaccggtccggtcttaataactatggctgcagcttccacagcttctgagaatctgtagttacatatcctgaaaaatgaactaagaagccagaagctggagaagctgggtttcagagcttttccagattctcagaagctggctaccaaacaactgcttctcagaatctaaagctccccaaataggcccataatataacttgtatgtaaattttacataattttagaccatcaatttactctaagatttgtgcaaatggggaaggagaaaattacaacatgcacataggtaagggattcgatcccataacctctcgtgaatagtttttaaaagttgcatacaaccgtatattatagccacgtgcaaattacaatgtaattatactacaattatatcctatttatatttggaaaaaatctgggagaaaagttatcgacaaatatgttgcaatgtagatgttttctactttttacctacagtcttattcaatttggagatgattaaaggtgattagagggattgagaatgaataattccataccgcagtggttgtgaaataaattatctctaatccctctctcatgaggattaaccgaatatggcctaatagaagaaatcattccaaatcactatttatacagatgaccggactaaaacttctatataggcaggaatatctttgctccttttgtctgttgtgatggttttctcatcttggttttactatcctagagacattgttagcaaagtggtggacatggcatagtatagcacggtggcgatcatttagacatcacatttcttttctatgcatagggaaaaggacatagatgtaactaactgactataattcatatcaaatttggtaaagtgcattgctagttacatagaacagacaactctcgcattgccctcctctaggggcggcttgggaggcgacgacccggttgccccctctcccccaccttcctcctccgcctcgctgccacctgagtggccgtcggcaaagctgcgcggccacaaggacggcggtggcggggcttctcgcttctcgcgctcgggcggccaagggagccgcctagggtagtggcggtggtgaccgccagatccgcgtcgctatggctggatttggtggggtggtggctggcggcggggacagcgatgatggtgggtatggcgaaggcgacaggaggggcgagctgcgctaggcatcggtggctaacggcggccgggatggcaatgacggggcggatccggtcgcgctggaggtggatctagcgccctcagaggaggatctggccccccggcgatcagatcgggcgagggcgagcacgcagcgggagagcccgtcggggcggtgactacgcgaccttttagtgcggctcggccaagcctcgcagtggcgcggtcgggcacgacatcgacggtgatggggcggcacggtgcacgtgcggaggggcggctgatggcggaggagactggtgaggcgctaggaggcgcaaccggtatggaggctggcgaggcgtgtctggctcgtggccgcgacgctaggaggcgcagggaggctcgggtgccagtggcggaggccggcatgtcgcatggagatgtggccggcacagcaggaggcgaggctggcagaggtggaggccggcgaggtgcatgctagtgcgacacgatgaggcacggccggtggcggcatcgggaggctggccggcgggggcgccggtgtagtggtgcccacacgccaacggaggtttagatggtggtggagcaatggtgtgtcagctgtggatatgcaggcgacggacaacgtgtgaaaacccagcccggccttggtcgggttggcgtttcgagcatcactcccctcttgagggcgttgttgtgccgtctcaacccctctagcggcacggccaggtgaaagcctagtctcagttctctttgagaccttgacggatgtcggcggcggcggagcttccgtcgcttctctccttggagacattgtctttggcatccccttgccgaaaccttcgaaatagccggcgcaagctcgctctagattaacgtcttcttatgtcggcgctttagcttctgcaagttgtccacatcggagggtctagggggagagcggttccattctctctctcaccctatctccctcaaccccaaagatgtggatagagcgggattttgtgtcggttataagggctgggttttgggcaatctcggttgtagttcctttgttggtctagcggcggccggtacagtgctagccttctctagggtttatgtgttggagttgtcggtgggtgggtggtggtatttttttttgtttttctggttatgacctcccagtgttgtaatcttgtattttttttgttctatcaatatgaacttcattaaaaaataataaaatgtaagtttattcgatgtcgatctacaggagttgcaaagaaaaaaaatagcaattcctacgagaaaagccgtatgaacccaaatttctaacatgagttgttgtgttacttttgcctttaattaattcatagcttttatgtgcatggctaatcttgtgtaacagttacatacacttattttcgacattgtattctataattatagcattcatttaatgataaaatagtagcattctatgtgaaaacttaatttatgtcgtactttcttgggtttctatttttaaattttagaacttaattttaattttgagaatcaatttagaagtttttatttcttagcttttgatctactataaatccctctattccaaaatataacacctaattagatgagccatatctctaaccaaattcgtcgtactagtctcatctaattctaagttgctatattttaggacatagtccattatcgtaaaatcattttttttcatcaccacgtgtcttccgcgtattaagatgtaaccccacgaaatatatatccaagcacgacatttttgaaacaaggacactttggacactagaaccattctaccgctacaaccatgaaaaatacgagggagagaaaacccaaaatacagtaaattgtttctatccaaacttgaatcgagccgatattcaagcgacatctcgaaggtagagaaaaagaaagacaatcatctcgaactcaccctcccacgcgtccacccactattggcccccgcagattagactccgctcccgccgcgccacacacgcctctccccaccaacggcaacccatcgcgtcgcatcgcatcgcacccctcgccgccgactcggccgtgccaaatcaaattccaaaaaagtaggccaaaaaaaaaaaaaggaaagaagaaaaaactcactcgactcgagcgcgcgcgccatgggggagcgcatcgccgcctcccttcttccgggtgcctcggcctcgcctgctccgtcccctccccccccgcgcccccgcgtttccgccggggccgccgcctcctttccatgctgctccacaagcgccggggggctccgcctccgctcccgcccgtttcgcttcccgcaggttcgcaatagttttagctcggctcgtgtttttttttttttgggggtggggggggggttgaatcgaggtgttctgagttgactgatgcgtggcacctgcagaaggctgcgacgacgaggagcgggcgcgccggcgcgggggcgcgggcggtggtccggtgcatggcgcgcggcggcggtggcggcgtccgacgcggcgcagctcaagagcgcccgggaggacatcagggagatcctcaagaccacctactgccaccccatcatggtacggaacgcccgcgccatctcagctctcgcatccatatgaacagagaagagtcagagatgatgaaatcctgcgatcctgctaccatgtacaggtccgtcttgggtggcacgattctggcacgtacgacaagaacatcgaggagtggccgcagaggggcggagccgacgggagcttgagatttgacgccgaattgagccacggagccaatgctggtacttaatttctcgtgtctcggcagtgcaatttcgaattcaggaaattcgtggagtaatcgtgctgatttccttcataatcgtatggttttggttggaattttgataggtctgattaatgctttgaagcttatccaaccaatcaaggacaaatacccgggtataacttatgctgatttgttccagttggcaagtgctacagcaattgaggtctcagacttcttctctctgctctagtgactttgctagatattttttggatgatcggtagtctatgtgcttgaatcttttgagaaaaatttcttgcaggaagctggtgggccgaaaattccaatgaaatatggacgagttgatgtcacagcagctgagcagtgcccaccagaggggaggcttcctggtcagtgtttccattaagttcttcattctgtttctgatcaacgtttgcatttatgaattgtgagaggaacttatcaaagagtgaccttctggtgttgataaatgccccccagatgccggtccacgtgtgcccgctgatcatcttagggaggtattctacaggatgggccttgatgacaaggtgtggatgatgcaaaaaagaaattagttgcctatctgctatttgttcttcatgtatgttgtataaccatttcttttggactatttatgcaggaaattgttgcattatctggagcacacacacttggaagatcaagacctgacaggagtggctggggaaagccagaaacaaaatatactgtatgttttcttgtccactttggaaactcaacaggaaaaataagttattttcagcagtaggaagttctaggcatggccagaccttcaatgttctacactctgggtatagaatattacatttttggggcatttgcaaatttgccaccggttttttcaatattgcaaggatgctactcgaatgacagttctagtgatatttttgcaattttctagtggcagttttgcaataacgattcaaagtagtggtaaatttgcaattgcccctacattttttgagacattcaggcagaggtgaaaacaatgcatgtacttttttgtgttatcttgtaagtaagcaccatattatgcttttaaaatccgtgaatactttgtccttatgctgtaaataaataatgttttaattcaggattttacaaaatgggttatccttacgtttcttttgtatgcatataatggtaaaatagaattaggatgctaagaacttcatagctaacaactttgtcattctctaagccctgatacttctctgtggggaaatgaagattaacttttcgatgcaatcttaccttaatcacaccagcacaatagcaaatcagattagtttcagttttcagactgacatttaaaggtggcttctattattgtggtctacagaaggatgggcctggtgaacctggagggcaatcatggacagttgaatggttgaagtttgataacagttacttcaaggtgtgttagcattttgtcatggtttacaaaattatttttttcatttgaatatgtgatgattcagctgatgataatgtttcaggacataaaagagcaaagggaccaggatcttctagtgctacccacagatgctgcattatttgaggatccgtccttcaaggttatttggttgtgctcaatttgtggcttgaatagctcataggtcactgtctgaaatatctgcaacatatgcaggtatatgccgaaaaatatgcagaggatcaggaggcattctttaaagactacgctgaagctcatgctaaactgagcgaccttggtgcaaagttcgatccacctgaggtgaggactaccatctttttttttcattttgatctcctggcaaccaattgtgcctaaacaatcataaacaatacgaaagacacttaagctcttaagttcttttattagaacatgccagattttcttgctcttgtttgcaagttcaaaacatgactccctgattcctcgcccacatcgagtagatatcttttggaatgtattttttttctagagaattcagtaatgtacttatgtgacaataagatggagtactggaccttcaggacagaaatatagttcaaatagtttttctttttaccgaatgtaatccaaacactgggagtttgaggtagtccatcatatcaatctttcttctgcaatgcaacgaaatggggtttactatggcagcttttcttagctgttcttcatgtaaaaaccagtgcaattgtaggttggatatttacagagtccaactttaccagccttcgatcaggaagtgatggatgtgattttcctgcagggattttcactggacgatgaaccagccgtcgaagagaaggatcctgaaccagcaccagcgccagcagcagcaccaccacctccaccagtcgaggagaagaaggaagctgaaccaactccagtaccagtaacggtaggagcagcagtggcatcatcgccagcggatgacaacaacggtgcagcaccgcaaccagagcccttcgtcgctgcgaaatactcctacggaaaggtatgcactctccacgaagcctagcttctagccctagatttgatggacaatgcatggtatcttgcaatggcttttgcagaaggagctgtcggactcgatgaagcagaagatcagggcggagtacgagggattcggaggcagcccggacaagcctctgcagtccaactacttcctcaacatcatgctcttgatcggagggctggccttcttgacgtctctgctcgggagctgagagcgatggtctgatgacctcctctgacgagtgttttgagttgttctgcctgtgctaagatttgcgtgtttctctttccatgttttgagtcgttattccgtaaataaattgaggtaaaaggatgggcatgtgaatggattccagtactttctgaacttcttgagtaattcctctagagaaatatttgtcggagagaaatgtcacattatctagttgtcatggctcatgactacattctctatactgagggaaattatgacattctctaaactaaggagggaaataatgaggacaccccatatatcactctttcttatggcatgttcagtataaaaggaaagtgcattttcctctccaagaacattgtatatatatttacttcttaaaaatagggagatggatttttatccctggaggggatattctcttgtattttttatgccatctaaatagttagaaaaaaatgattttttaagacatagatcatcatgagatatatcactctataagttcaaattcgaattctacagttctccgactgtggtggcagtcctctcctctcctctttcctagaggatttggtggcagctgatcggggtggcaacaagcagatgggtcagcgccagtcagcgatagcatgcaacgcaagatcaaggccgggacaagctcctccctctttggccgccaccgccatctctcccttcttaggctgacgccatcaaggctcgtggcgaggaggtacgtctaagaaggtagcatattgctaggcggcgcaaatctagttgatgaggccacatgaggttcatggtggcacaaatcgaggttggaccaacgagctctacggtgatgggatcaaatctgtagcgacggtaaaaggcccttcttctcctcccagcatctatgtcattccccaatcccgttcacggcattgtcgtctttcctcaagtctagtagatctgggttccactgctttgagctccgtgcgaggagtggctcaggaaataggggaccacacgcatcatgtgggtacggcttgcccaacggggcttgtaggccatgcccccacaggcgccctcaccttgataaggccccgtgccctctgtacgacctgagtggctttgcgaagaacacatcttaagccaatgtggagctacgacatcgacgtggagggctagaactaatcactaggcccctacgctacgtacccttataggccaaaattactcctacttgtgtattgaaatcataggtggcacatcctttttaggcatggctcgtcaagtggctcgtgccgtggtggctctcgtgctgaggatagagcacaagcacaacttagtaagaagacgggtaggctgggccaacacgagcccatatggcacatgttcctcggcctcgctgttccgccaacgaagcttgctggcgatgcctccgtgcctctctgctcagctcggccctgtctcggctgtcacaagttgtacagtgcaccaccgctcccaaacaccttggcccaagccactgccaccgtcagctcgccctcaacgtgtaggtgctagtgaggccttttttttttccttctatgagacttacatgtgggttctatgttggataaagactagtaaacttgccacatcagccaaaaccactttccaaaccaccaaggggtatattttgtatcggttttaatagttaagggagtcaatatatacgattttacggttgaagggtacgaattggattcggtcaatagttgagggactcaaactatacttttccctagttgaaattgtgccaaatgaaggccggcctaaatgacgactaattagggcccaaaatgtttatgggccgagttcatgcgcatttatgggccgaatccatggtcaacgactatatgggcctaattcattactcattatagagtccgagtcacaccgtcactcctcggctgcgcggccgtcaatgaacgctcgccgcgccgcccccgaccactccatccaacctccccgccaacgaccttgaaaatcgactccagatccggcgtagctgctgccgcgatgctgagcgcgcgaggaacggggttaaagttcagttttctctctatttttttttaagaagggtattttttaccggcctctatatataaccggatatatgcggtcatttaaattaggaacttagctccgcaaacaatctaatctaaaattcgttactatggagatttaaactcataatcttggttactaattatctctctactaggacccatatggaactttaattatgctctccattgcagcgaggtggagcctggaggagattgattctagctattcaggacgacgtcgagctgctgctgctgtcgctgctgcttgttcttgttggtggaatccccggtcctcatttggtgcgaaaacgaggaacatgtcagagaatgcaggtaataatttctctgccgtcactttctaatactccctccattttaaaatgtttgacaccgttaactttttatacgtgtttgaccattcgttttatttaaaaaatttaaataattatttattcttttcatatcatttaatttattgttaaatatacttttatgtatacatatagttttacatattttacaatttttttgaatataagacaaacggttaaacatgtgctaaaaagtcaacggtgtcaaacattttgaaatggagggagtactgtttccttggggatagcattgagctacaggggatgaatttgccaccacattgatgtgaaatcaccttggttggactgagggtctatgaggttatctgatctggtaatcctaagtagagtagttagggttgcttaattgatcctgtagccaatgggatataaattatgaatagctcgaaaatatcatttattttcctgtaacaagtactcactactttattttttagcagtaagcaacatcatttcagtaataacatgccggggaggaaagctgcttgacttggcaatctgaactctcaagttttaagtcttccccatttgcatgtcttctagaatacgttgattcagcaaggcaatgtgatacgacattgaagttggttgctatcgttcgttcaatgcattgttctttttccaattaatttctctatcgctgatctttcgctgggctgatttattcagaaataacaactgcgcaactataccttgtagtgccttacagtagcagtcaatactgtccagggaaagaacattacaaaacaaccttgagccatatcccctctactctagccaagccatggaacacttatctccccagaaattgatcctgccattaggtatactactatcctcacttgttctccttcatgccattgccgtgccatccatcgatgagcaagctgcagcgcttattgcctggaagaccaccctgcaaacccagcaacccctgcagtcgtgggatagcaaggcatggccatgcaacaactggcgtggcatcaggtgtggcacactacaagggcaaagggtgatcaccaagatcactctgcacggagtgaggcttagaggctcactggaggccctcaacttctcggccctgacgaccctgacaagcatcaacctttcacacaacaggcttacagggatgatccctcagagtatcatgtctctcaaagagctcagagccttgatcctgcacaaaaatcagataaggggctccttattccaactaggtttaacatctttaacaaagctgaggttcttagtgctaagcaataattttctttcgagttcaataccaaaggaaatatgtagtctaaaaaggcttgtgagcctaaacttgtcaagcaatcaactgggtggtcatataccttctgaaattgggttcctcagtaagttgattagattggatttgtccaacaacaacattattggtcgtctagacagcttgttcatgacaaacaagccaggtaaatataacaataaatcatctttgtcaaatctaaaggttttagcactatccagtaaccaattaactggtccaattccccatgagttgggagatttagtgttacgccccgaactaatcccgaccggaactagcccgtgacgctccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactagaccgaaaccctaaaactcatcgtagccggcttgctcctggaagaactcctcatcagcaggttccgcttcatcttcttcagcaactggggggggggttatttatatagagcaagggtgagtacgggagtactcaacaagccatgggaaataagtgtttaatgcaggcttcaaggaaaggctgttgtttttgcaattgattttatttgaactcttttctaaaaacaactaagtgagtgcttctcaaacgacacggatgagacagtgcgtctcgtccggtcggagtatgtgcaatgtatcagtctttagaattgaaacaaggttggcacccggccgatagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtgggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctccctgataagctagttactcagccaggggtgtcccattccacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccagtgtcgggttttccaagtcttttgtaaaacccaagttttacccaagaaattactcagattttaagtttgaaggcgaccgtcgatactcgcacagggtgcacgaatatcgaggcgcaactagatggttacaaggggacatgatataacaattaacaaaggaagggtcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcgaaatgggacaactcaacaaacggcgaaaataaagccctattaataacctctaagcgtgccattagatagatctcgagatttgaggaattttggaagttgaacggagtcaatcggatttacggttgggaagatattgaatttctaagattattggatttttggtctaaaggaaaaggatttaattaaatcctttttgaaaaagaaaagaaaagaaaagaaaagagggagggaaattagactttcctcgggcggctagggcgcggcccgagagaaatggggcggctcggccgagctaaatgggccggccggcccaaggcggcccaaggcggcccaaggcacgcgggaggggaggagagagagagccggtggatcgggctcaccacgcgtggtcccgggtgggacccgcttgtcggtgacacggttcaccgtgcggagcgagcacgcggcgcacgcgcgcgggcgggggagggacgcggtgcacgcgcgcggttcgtggtggacgcggatgcggcgggcccacgcgcagcctcacggctcgcggtggaacgcgcgcacggggaggggctgaccggggtcggctcgacccggtcttggccgagctggcgccgacgtggcgcctacgtggctgccacgcgggccggcgggaggtagacgacgacgccggccggaacggacggcggtcgacagcggcgagcggcggagcgaaccacggcgatacaggcgaaagcgagcacaccgggtggttgctcaggtcgaggggagacgagccaacggctcggattcgtcggagggagcttgacggcgacgaattgcggcggcggcaagcggcggcgggagaagggggaagcggcgacgaggtcacgaggggccaattcccggcggtgagagcatctacgcggctacgggaatccgttgctagcgtcggattgggcggagctacgccgagcgaggccggcgacgagcgagtgctacggagcacgggcggcgacggcggcgagcacatggcgagcggcggcaacggtcggggcggcgccggctagctacggggaggctacacatgctactaccgaaaactaagggggagagatggagcgaggaggaagaacggagggaggcactaccgtgcgggcgggcgcagtgacgagaggccgacggcgcgggagtaatctctccggcctcgggccggggaagaggaaggagagggcgcgcccggagtccccttccgcgtccacgaacgcaccggctctcccggtgcttggcgatgaacggcggaggcgagacagagcacggaaggcggcggcaatggcgcggtggcggcgagcgaaacgggagggggaatcgatgggagggcgccttggtttataggacgacgatgtgggtttgggaaccgaccttgggcggcaaggctcgagctggcgcccacgctcttgtccaaaacggtgacagaggcggatgacgccggcggcgaggggaaaaggaaaagagggagagaaaagggggcttgcccccttgcctcttcgggaaaaggaggagggaggggaagcgacgcggctaagggaggaggagctctgcctccgtcccttggaggctagcgcgggagtggcggggccgaggcgatgacggcggggcggtttggagcggtgcgacgacacgggcggcaggcgcggcagaggctgacggcggcggcgaccaggcggtcggccaccacggcacgcgcgcgcggaaaacaacgggcggcgcggctcgggcacgcgcgctggctgcggtgccgagcggctgcatgcgcggcagggccgcggggccgggcggcgcaaacggtgcaggcgcgacgcgggcgacgaccacgcgggcgcgcgcgcgaacgacgcgcggggagcggcaaccagggagcggaaaggagggctcggctcggcgcgggcggtcacgcgcacgcgc

SEQ ID NO: 4267 - DNA, 5907 bp, Oryza sativa
tcaggaggaatttgattaggaaggatttggattcggaaatgagctcgacgatagatcggggttttgagatctgagatggcacggacactagacaacaagcaaagaaacaaatttcgcaatttaggtttttaagagataattttcccgctaggcgccacgacggaacgggcgctacatttagtgagcctagaataccttaatcttagtcaaaacagtcttgttgattccattccaaccaagatcattaacttaaaggagctcaagtccttggatctttcagataataacctctctggacatattccggagcaaattggtaatttagtgaggttgaggtccttaaaacttaattctaatcaactttccgggcacattccaaacaacttagggaatttggctaaactctgtttcttgtatcttcaaagcaacaaactttcttggcacattcctcaagaactaggttccctgttgaacttaaaggacctacaactttacgataacaagctcataggttccatcccaaacagcttagggaatttgaccgaacttagtgtcttgagcctttctggaaacaccttgacgggttctatcccaaataacatttgtaatttgactaaattctccatcttatctctttggagaaaccaactatctgggtacatttctcaagaactaggtaaaatgttgaatttagagagcttatatctgagtgaaaacatgctcacaggttccatcccgaatagcttagggaatttgactaaactctctttcttggatctttctagaaatcaactttccgggcacattcctcaagaactaggttacttggtggacttaaagaatttatcactttatgacaacgtgctcacaggtttcatcccaaacaacatagggaatttcactaaactcagtatcttgagcctttctggaaacatgctcacaggttccatcccaaacagcttagggaatttgcctagactctccaccttatctgtttggagaaaccaactttctgggtgtatttctcaagaactaggtaacttggtaaatttagagaacttataccttagtgaaaacatgttcacaggttccatcccgaacagcttagggaatttgactaaactcactgccttacatattcgttctaaccaactttctggatccattcctaaagaaattagcagcttaatgaatctaaatattttgcatatcgatcaaaacaacctttctggtgaattaccattgggtctgtgcgctggaggccagctacagaatttcactgctcaggataacaacctggttgggccattgccaacaagcttgctaaactgcaaaaccctggttagagttcgtcttgagcgaaatcaacttgaaggagatatctccgagatgggccttcatccaaaccttgtctatattgacatgagctcaaataaactatatggacaattatctcatcgctggggtgagtgcgccaaacttaccactctacgtgcatcaaataatcgtattactggagtcataccatcgagcatggggaaattgtctcagttagggagacttgatgtttcatcgaatgaaattgaaggacacattccaccagaaattggtaacgtagtgtctctattcaatttgagccttgcaaacaacatgctccagggaaccataccaaaggaagtaggttctctacaaaatttggagtatttagacttgtcatcaaacaacctaagtggacagatacatggatcgattgagaactgtttgaaacttagattactaaggctaggccataatcgcctcgatggaagcattcctgttaaactagggatgttggtaagcctccaagaattgttggatctaagtgacaattcattttctgggatcataccaagtcagctgggtgctttgagcatgctcgaagctctgaatctttcacacaacacactgaacggcagcataccatcatcatttcagggtatgatcagtctctcatccctggatgtatcatataataatttggaagggccagtgccacatattaacttcttggaagaagctccgattgagtggttcatgcacaataaaaagttgtgtggtacagtcaaagctttacccccttgcgaccttaatcagaaaggtggccagggaaagaaattcaaatccattttacttggtatagttggtgctgctggcatgtctattgtgtttatcatgtcactagtggcatggcaatgcaaaaggaagaaatatggggaacaaagcgaaaatggagttggagacgcaaaagtgttttcagtctggaactttgagggaggagaagcatgcaggcagatttttgaaacaacaaaatatttcaacgaaactcactgcattggaactgggggaaatggatctgtctacagagctcagttaccaacaggtgagatatttgcagtaaagaaaattcatatgatggaatatgacgagctaatatttaagcgagaaatagatgctttgacgagaattcggcatcgaaatattgtgaagctctttgggtactgttctgcagtccacggcaaatttcttgtctacgaatacatggatagaggaagcttgtcaagatatttggagaaccataacattgcgattgaattggattggatgcgaaggataagtattgtcaaagatgttgctaatgctttgtcttacatacatcatgattgctttgcacccatagtccatcgagatataacaagcaacaacattttgctcgatcaggaattcagagcttgcatatctgattttggtatagccaaagttctagatgtggaggcatcgaactgcacgaagcttgctgggaccaaaggttaccttgccccaggtaaatttgtactaaatcagttgctctgtccttttgtatattagtttgtaactctgacaaatattcgagctaactgttaaagtattcgtcttactagtatatctttgattcatagtagtatattagatacaattaggcaaatttgcatctcattttgtaaaaatagcatcgaatgccttctatactatttacatatgcaaatttgttgaaacaaagtcttaaatttttacatggcagagcttgcatacacaacaagggtgacagagaaatgcgatgtttatagcttcggagtgcttgtctttgagctgttcatggggcatcatcctggtgatttccttttgtccttctccatggccaaggaaagtacaacattgaaggatttgttggacgcccggatcccacttcctaaagctgagacagcaagtgaaatatttagagtgatcatggctgctgtccagtgcttggaccccaacccatcacgtcgtccaacaatgcaacatgtaactcggatgttttctacagctgaaggacctagcaatcctgaccatctacatgttgacataatcatccctgcgtactaccagtgaatgttgtcagaaaattgctgtttctcatgttgctcagggttttttccccacaagaatgtggcaattcacaccataggtaggtcagtctattgcacctgttaatgtcaacttgtcaagtattataaagcatcacttgtatgatgatttgtgttctctctacttcgttggtgttaattgcgtggttgtcaaacatacctgcattttgtacacgaccctaatacgtgttgctggtgatgttcttgtgcttactatgctaccttgtttgatcaatctgctttgttgtaaattgtaatacgaatctctaagatttatgatggatggtatacatggctaccattttctctgactacatggcaatgaggcttcttgttctcctattctagcaaatactgtataattgtatgtttagtatcaaagttttcagatgcatcttttgtctctgctctccttgtgttggtatgtttcagtgatgataagtagtagctgcttaaaacggtttggttttatcatttttgaaattgttcatgagataagctgagaattgcttactgtttgcctgacattcaaaacggagcctgataaattgcagaattttcaggtcatcttaattctcagagcttcagtagacttgagaggatgtgtaatatcgctttttccgcctccgtgcctcatgcggcatgtcactcttctcccatgatcacctcccattccaaccgttgtcgtcaccaccgctgtgtttggccatcactcccaccctctccacttatagtgttagaataggtgtcgaatatccttgtcttatgaagccataggactgggatatccaacatacagaagaatttctttctacaaagcaaaattaatggacaatctgaccgaacaactcatcaatgttgaaactgatgcaactcatatcatccatctcaatgaagttgatgttgcaaactgcaaaggtcatccatgctctctagaactccaaaaatccgtgagcactggcacctccatgacgcccaatgaaggagtgcttcttctggttattaggcgacgatgtcacatcttctactggagagtcgtccatcacaccggatggatgaatcggtgaactgagagatgatcaaaccacaccaattacacctctcatcaccataaactccagacaaatatcataccatgagctatacaaattctttaggaccagtaactgatttggcaagacgggtcatctgagggttcgctgcggttcatttcttataaatgtatcgattagttgtgttgataaggatcatgatgaaattgcaagtacaaatggattgagacctgatcagttctgatcctttggcatgggaaattcttccttttactctctcttttgaatgagtcgtagtgcgctcatcaagaaggggaaagatggatgggaaatgcttgtcaagctcggttctttaaagaatagcatcctcatcttcctagtaaaaagcacattgggattctctacttgtggtggtggtgagccgtgtgatgggaaaccatcccgcacagttcggagagtaccgaaggtgaatgagaggttcaccaccacccatatactggatcaaataaaaacactgggcttccatcaagccactactacatcaattgcattaggaatcgaggatcttttaacaataccctctaagggatgacaatgcaacggttatcattggtcaaaaaagaaatccaaaaggaactcgcgtttttggcacgatcgccgaggaagcagctctgatcggtgccattagagcaagtttaatagtatagacagctgtaagctgtaatctataaatagtttatacatgtcatctatagataagtttagaggggcttcaacccctccgtcatgagcgccgtcgtcccagtgtgccacacccgccgctgtgcatcgtgcagccacggagccattccaaccgtcatgcaccgactcaattaccgcgtgccgccccaaccgagagagggagggagttgcttctgccgccgtcgttgtgagagaagggtgaggaagggagctgcaaccgtgcgccgccactaccgacgtgcgcagacgctaccgccgtgcgacgatttctcttccaccgtcgcgagagaagggccaggaaggggttgggaatgcgtcgctcgcccaatgcgggagggaatcgaagggggtagagtggtggcattttcctataacttcagtaaaaaggaatgggtagtgctgtaattattttcggagtggagccgtggagctacattttcgccgctccacctcaatacaatattttggagcgatccaccccgttccgatccagtttttggcgaatctgaaccgtttggttgagcttcagctccaggtaaaatgaatctaggagctggagttgtaccaaacagacccgtaatttctataatactccctccgtgccataatataagggattttgatattttgct

SEQ ID NO: 4268 - DNA, 7258 bp, Oryza sativa
  unsure (1)..(7258): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatagttatatttctagatttgtatataccacaagctgcatgaagtgcatgctttgattatattaaaattttgaatgcttcatgagccaaagtagaccaccatatgcgagaaacgagaaaaaaaaactcatctttttagaagcgacttgtgcttcacacatatgccacagttgtctgacacaagcccaacatactcgttgggggataactaattacatggtaattatctaggatggactggattgggttcaatgcctcccagaccatttaattattcataatgcaacagattatgtatagatatcatcaacataacccggccatagctaatcaaatggtttgataggcataggacctactgtcagctctaacgagtactgacttagctaggttctatatttctatttattcggcaaacttacttcatcgtagtcatctagtgacaaaaacacctcatctaagcatgaaagctcggtgccctcaccgtggaagctcacatgtgaaccgcagctcgattcgaacactcggcacagcacccagttgttggactcctgtaatgatcatgcataaattctagtattttgtgctccagttactccttatacgcaatttactgaactgttgactgctgatcgagcagcaagatagagaggatatgcatcacttaccatgcttgagtggcctctcttcctatgagacctcctgttagagctcgagctagtcaagttgctgctaccgccagcgacgcaatccccgtctagcagatggtactcatgcatgatccagttggttctgatgccttcagagggctctccaatggagaatagcagcgttttcttcaagccaacattgcggccgccgcttcttactgtttcatcaactccaatggggctccagtgcccattggatgaggtcctactttgtgttagatggcagaagaagtaccactggttcccagcttgcagtgctttgccttaaaattgcaatttctatcagcactcagcatgacttgtaagagaacaaattagtgaaatcatattgatcaatgcagttgcagacttaccattcagctcccatggattgtaccgatgcggaagcagcgtcgggatgatgtcagggtggcatgggaggagggagaccttgcgacggaggaaatggacgacgagctcttcatccgaggggaagaagtggaaacctggaggtaagtttgtagctcctcccatgctacaactacaagtgcaacttacaaactgcagtcaaatgcaacttggctgggatattgatgaatttgaaatgggaagcttgctgatcttggtgagcgagtgctacttatagggagcatatgtgtgtgattgtgtgaaagagtgagatgtagagagagagagagagagagagagagagagagagagacgtgcaagtcaaggagtgctgagtgctgatccgtaggaggatggcagccaagcgagggcgacattttgcgatgcttatattctatatatttctcttttcttctttggagggaaataatgatactatgaggagacatttgttggatcatggattcatgatgcactgctatgtacccgttggctgcagtagtgtgcagagatatatattagtttttcagaggggggcagaaataataattgaatcattccatagtacatgcatgataaaagtgttcatccagcagcctgtgatataattgatggccttaaggattgttggcttatattagatctcagctggtaggtatcagtacttttttgttgattagtcattacctcattgaattggattttctatcagcaatttctttaagcctgtattaattacttactgtatagattattatatcaagtgtttgaagttttatcaagtgataaggttttcacatgagctgattactacattgtgacaggcactccttaatgtacattccccaaaacctcagaacaaggtaatgtgacaggcaacatctctagtgcagtatttcttttcatgatcattgcgtatactatttgtttcccccctgaccattgcattcttgctcatgtcatgcaggcgtcacccttctcaagccatatgcaccttgaccacagccagccattatatacacgagtgccagcaagcaagttgcacattttttctggacctgtgtggcaaaagtacaagggcatcacttgaagaagaagcaacccagatgttgtcctcctgttgtatacattgctgcgtcagaggggtacactaatcattccaaattattcatgaatcaactggggaaaattcttatctgccttggcaggcacaataattatcaggagaggatcacctcacctgagagtgattaactagaaaaatgcccagttggtgaaaggactccatgccatcaagttgcatcgatctcaagtggtaagagtataagaccccccccccccccccctccatctttcttggtagaaagtttaacaatctcatgatgaccacttgtgaagagatccatcaaaggaaactgtggttcgattcaatcccgattggtttcagatgcaagaagatgcttatctcgataagattaaccaaaatgagatcatgatggccgaatcttccaggaactctcacacaactcctctgtgctgctcccaggaaaagatcatggtggcctcatcattccaatggtgcggaggcagccccccctcgctgtcgctcgcacggtttctcttgagcctctatctttctagctcttggatctctttagtttttttttggctttggctttatcttttgggatcatatgcatgctgtgcttctttgtggcagggcatgtccgccactggaagccggtgctctgctgctgctgctgccggggggaatcaatggaacgccattgccgttgccagcacacgtgaggcaaaacctaacatctcctgagtcctgaggggggtggtgggccccacctgtcatgcagagcgtgggtgacccggccccaccacagcacctggtgctggtggtgatgacgtcgtgctgatgcagttcggtcgaggcgcgcacattggccgatgctgtgggggaggagaatgatggagatcctcattcttgttggcacatgctcaggtgcgcatgcaggcgtagtgtactgcctgcggttggttgtggcatgtatcatttgatcatcccaactctctagccttgtagcctcgaggtgatgttcttgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaaggatgagaaagaggagggcatacgaggccacattctgccaatggcacctgagctatgcaaaatatgccgctcgtgggcaatgtgaggcacacattttgcatcccgcattcctgcctcatcggatagggcggaacggaagggatagaaatggttggatggatggataataccttgtggcagtcagtgttgctgctgcagcagcagcagccttcctccacttccaccaccggcgccacaagaaaagacgacgacgaccgacgccgacgccgacgcgtgcggcaccagccgacgatcgacgaggtgataccgagcttggtgcggtggtgatggcgaattgggtggagaacgaacgaacgaacgggagagacccaaccacgaggatagtaactactactactgtctttcacctgttgccttgcagggtaaaaaaggggctcttcatccgttggctagtttctccagctactgcgtgtctacatcaccagtgacgcatgccaatgcagtgcactccagtagtctcctacgctgctcttgtgcaaacttatttgctgctgctacgacggaccacatcggtttgcagatttccttgaattgaagtactcgactagcgcatccatcatctcgacgttgtggcgaatcgaatgaatggagttagctcctcttcaactattgctttagccggttgctgtgttcttgtttttcttgtctcttgcgtgcatcggtgcatggtgttcttgcatcatcagatcatctccatagtgtttgctatgctagcttgttccggctgcttcaaatggttccaatactccaatccactggcctcaccaccacccaatggtaaagctgctctgcccactcgctgagttttcttttttttttaaccattttgcaacgcacgcgcaaaatgtaccaagcacattattgttatctgctcaaatggaccatcctcatacggcgcttgacattcagcactctcaggcacattattgttccatcagattttccttttgtcgccttcttcaaatgccttgtgaagctgtgatggacgaagtaaagtagaacgagtactccaaaattcttttgcaaatcctcctaataaaaaaggcattaaatgtaacatgggcgtaatcttcccaagttgcatgccattgatagactgaactagacatatatatatatgccttcatgcttgtcaattgccaattgacgacaacatattcttcaactccgatctgaatcatccactgcaaaattcagtcaaacttcgcacacaaaaattatattatatatgtactctgaacgttcaataacaaagactacaaattacaaagagtggaaagctgaagacttctatcctaccaccttcccaaatccaaatatacgatcatcgtggcaaagattggaaatcaacacctctattgcagaggggggaaaatgagtaaatgactcagtagttgattcttcaaactcacaaattgagctggatcaggcaattgtaaagctctgccgaggcaatggcccaaagttctggactctgaatttgtcctgtcagttgtcatcttcaagtgaaaaattgatccttcaggatgccaagttccaaacgaatcaaaatcgtacgagtttatttgtgattgcaatctcaaagaaacacaataaccacattttggactctgacgctcctttgcagcatccttgaaacacaccaccaatctgccataccaaggatgctgaaggcaaatcagtgggcttcatccctcatgcctgagaccaatggccttgttcttgcaatgctaaagcaattgtttcattccagaggatgtatctttcagcacaaaacaaaattgccatgcttgtcctcaacattaccccgagcacgtgatgaaaaagcttgtccagcatctcatatatttcatttgcgtcacagtgagatgtgttagcagcgacaaacaagtgtttttctctctgcacctctatccaactataagctcctcaacattaccccctataatgaacatgtgatgaaaaagcttgtccagcatctcatatatttcattcgcctcatggtgagatgtgtcatcggcgacgaacatgtgttttgctctctgcacctctatccaactataagcttggtccttcctcaatcctttccccttcatgagagccctgacctggcgggcatcgtcccactgtcctgctgctgagtatatgtttgacaacatgacataccgaccactgttctcaggctccaactggaacagggcctcggcaacttcttccgcgatctcaatattgccatgaacatgacatgcaccaaggagggccccccatgacccagttgtacccagaccgatcttggaggacaagcctttgatgaactcacttgcttcttccagctggcgattccgaccaagagcatcaatgaaagcggcgtagtgttcagctcttggttcaacaccatggtcctgcattgattcaagaatccggcggccatcagagactagaccagcatggctgcaagctgtgaggacagcgagaaaagtgacataggttggttgtacttcatctttaagcatcctctcaaacactgcaagtgactgctttccctggccattgtgcgagaaccctgtcaccatggagttccaagagatgatgtccctctcaagcatcctgtcaaacaccgccatggccgctaccatgtcgccacacttggaatacatgtcaataagggcattgtggatgaaaacgttgaaagggtctgaaccgatgctcctgcgcaagatgaagccatgcacttccttccctcgggcgacaagaccaaccttggcgcacgcacccagacatgacacgagggcaaagggggttggcactaccccctcacctgtcatcctttcaaaaagctcgagagcgatctcctcctccccattctgctcatgcccagagatgagtgctgtccatgctatggcgtcctgcgctggcatcatgtcgaatacttgcacagcatcgtcaagcatgcttgcccggcaataccctgcaatcatcgatgtccaagaaaccgagtcacggatggtcatctggtcgaataccccccgtgcatcctccaccctcccggccttgctgtaggcgtccaccattgcgttggccatgatgacagtcacctccatacccgacaccaccaccgcgccatgcaactcgcggaggtgcctcgcatcccggagccccgcgcacgcgctcgcggcgctgaccaccgtgaaccggtcgatggccacctgctgctgccccaggcccctgtccctggccagctgggcgaacacgcggagcgcctcagactcgcggccgtgacgcgcgagcgacgagatgacggtgttgtaggagacgacgttgcgggaggcgggcggcattccgtcgagcaggcggagggcgtcggggagggtgccgcggccccgggccagcgccgccagaagggagttgtacgagtgcgcgttcttgtgcgggaggtcgtcgaaggcggcgagcgatgccgccggggtggggagcagcgcgtaaagcgcgaccaggcggttggagaggagggtgtggtgggtg

SEQ ID NO: 4269 - DNA, 2016 bp, Oryza sativa
ccatggcggagtgagaagcggcgcatgcgcttgcaacgagcagccgcgacgacccagaaaagagctaaagcccaccactgtgccgttgtccgtgggcctcgagctgtgggctttgggccgtgggccgtcaaagcaatcgaagagtttatattttgtgggccaagtaaagccgtctcgtcttgctgttctagaagatttctcttcgcgtcgccggcgctgacaccgccgccgccaccgccatctccggcgaaaaccctacctgcacccgtccagcgagcgccaggaggtaggctctagccgggcggaggatggtgttcgggcaggtggtgatcgggccgccgggctccggcaagacgacctactgcaacgggatgtcccagttcctctccctcgtcggcaggtgagtagctcgtgcttctgctgctccaaccctcgcaagctactcccttcgtgctcgcggttccggtgctaggtgtttgtttgtttgtttgttccaaatttctggtcggccttgcgttctgttggttgcagaagcgtattgcttacctcctgggcatggactcgctatgcagttcgggtaggaatttgtggaaagcaagaactaggtcgcttgattcagatagtaggtagatttcgaattgagtatgccggctttatgccgatagagagagaaggttgggagagtgaggggagatgggcaattttctcccatggaggcagggagcttgctcatggaaggtttccccaacttgcaaatttgcaattatgctaaatgttttgacttatgtgcttcactgttgcgttgcaggaaagttgcggttatcaatctcgatcctgcgaatgatgcgttgccgtatcctctgcactttgagctctgaaatgctccatttgccatattatcttgtttcacttgttggattgttgttctgcagttaaacctgaaatgtatccttgacagcggtgattaagatatgaatgcgccataaacattgaggacctcataaaactgagtgatgtcatgtctgagcattcgcttggtccaaatggaggtttggcccagagccccagacttcaggaatcaaacctgttatttcttttgtatgttcgcttatggtatgctgttgaaatttgtgtcaggccttgtgtattgcatggattacttggagaagaatatcgactggcttgaggaaaagttgaaacctcttattgaaggtcggtataggctggctttctttattaaaaccatatccatgagctgcagcctggaagatctataaaatggagatcttctatagaagtcatgatctcatcgatattgttcgcacagctgataaaaaaattgttgttatggtgcattcagagaaaaatgtaatatttggtcaatttcaattatttccttttcaaaatggtttactcacaactgtttgtttggtctgaagtcttaactttttgcagttctagaaaagtaggacccaattaaagttatagattttgaacaattagagctcctgggttccattattctgaggattgtgtttcagtttgttcacaagtacaccttttgtttgttgagctagttctgaaagatcatagtaggggttactaaaatacctatacagatactgctttattgtcatgatttcctatgtgatttgctcaatggtggtgatgatttctgcagatcactatctgttatttgatttcccgggtcaagtggaacttttctttctacactcaaatgcgaggagtattatttacaaacttatcaaaaagctaaacttgcgggtacaactgtgttaaatcctatccagagttcattgattatgtaatgaattgcgttgcccacaatatttcttggtattctacagctgactgccgtgcaccttattgatgctcatttgtgctgtgatcctgggaagtatgtgagtgcattgcttctttcactgtaaacaatgctacacatggagctgccacacatcaatgttttgtcaaagattgacctcattgagaactatg

SEQ ID NO: 4270 - DNA, 11659 bp, Oryza sativa
ccaagcagcaaatacataactttactgcctcaaaaagtcatgcatatgcagtccagcatacttgcatagttacattgcacttattgaaaccttgttacttgatcaaattagatgtaattaagcaggcatttccagttctcttgggaatattgtgaaatgtgtgtgcagtagcagtacccttttgtccatttctttgtttattgagaaaccaaaggttgcaactaatatatttgtgcaaaaaatccgatgctcaacctgtttaagattaagaatatgtacttgggtaaagttgaaaaaccaaacacaggagttgtgaatgcatctattgtttttgcttcttggggattgatagacgatcatcctaaatcaatgtctgttaacatagcagtgtgacctgttatgaagtgagatgcagtaaccctgggaatcatttaattattcaaatcaaaatctctgataatgttgctcttatgcttggatttcacctttgtaattatttttattgcttgggttatttataatatttttgttccatctgcttaaggaaacttactaaggagctgtgcgatgtgattgacgattttggcttggtcaattttacaactttggacatccaggtacttacttgaaagattcagttatttcaattaagatccctgtgaacttggtcttacaagttgtttttgcctctaggacaaggaaagcgtcggcaatcttgtgaaattgattgacaaaagcaatggctatatattttcatctatagacagcagtgtcgttgagttcagtaaaattgcagcagcgccacttgactgggattactacagatatcctttactgtctcttctagcacctagcttattcaaacaaatatctttactctcataccttaagttattttcagtgttctagaagcactctattcaaatcacccctctggcacgtacaggcataaattattacaatatggaacaacactagaatggaacagcactagaccaccttacatagcaaatttatggctgtgcaacttgccaattttcacatggagcctgtagtatttgtggcaatgttggtattccagactggtatttggatttactagtgcttacccttgaaggcaattcgcatgcctgctgtatgatccttggatgctgctttactgttttttttttctttctcttgtccatgaaatacatcactattatagcccccttgcacctttccacatttccttttgttccttgacatgtgactacaacagcagaggtgcaggagaagtacatgaaagacgacgaattcgtgcagaagacaagcaagacgcgatgaaactgaatttgtttgtaatgcttgacatgtgaccttgctatgcttgaatgagagctccatttgcccccatgccgctcaggtagggatgtaacatgttgtgacatgcaaactggaactgagaaatgtactctctccattttaaaatgtttgacaccattgactttttagcacatgtttgaccgttcgtcttattcaaaaaattttgtgaaatatgtaaaactatatgtgtacacaaaagtatatttaacaatgaatcaaatgatatgaaaagaataaataattacttaaattttttaaataagatgaatggtcaaacatgtactaaaaagtcaacggtgtcaaacattttgaaacggagggagtattttaccataacaacgatacttgtagtttcaacccatgtatcccagctgtagatgtctcgtgctagctgctagatgtgctatgtgtaggacagtaggagtacaactctgaacatgctatgctaattcgatctaggcctgcctagttcttaattttttcttcaaacttataacttttccatcacattaaaacttttctacacacaaattttcaacttttctgtcacatcgttctaatttcaatcaaactttcaattttagcgtgaactaaacacaccactagtaagtcggatctggtcttgccaccccaccagtttccaccagggtttgtatttcggacgacaaccgatcaaaaaccacgaaagtagatacccagtgaaatttcaagtggtttttgataattcaattttgaaacagtaaattttagctaaattttcgatcaatactgggtgttagagatctcacctggttaccacaaagtatcataaagcacacaagattacaggcagtttttgcaatggtataaacaagagtacaagacaagattacaagcaggcagtttttgcaaggttttttgcaatggtataaacgagacaagattacaagcagtttttgcaaagatttaaacaaggggatcatgatccccaatcttcaaagtcatgtaactttatcattgacatgtggatccgatgaaccattgactcatatgtcaataactttaaatatagaggatcttaatccattggatccacatgtcataacaaaagcatagtaactttaaatgtagaggatctaaattcatcggatccacatgcaaaagcatagtaactttaaacgtagaggatctaaattcatcggatccacatgcagtaacaaaagcgatctaaatccatcggatccacatgtcagtaacaaaagcacagtgactttaaacgtacaggatcttaatccggaacaaagtggcacagctattttgtctgctctgatccggagcttctgacctgtgctcaccaccagagttttaaaatggaaagcttgcatcaggccacgtggcgttgacaaagaaccaatcccaatgtggccacgagccccggccacgccgccgccgccgccatggccatcaaaacctagtgccgcctcgcgcagcgcgctgcgtcgtttggatctcgacgacggccggcgccaaggcacggagggagaagaaaaccacgcgcctcttctgtgttctccggcgatggcgagctccacggcatttgcagcggcatttgcgctgctgctgctagcgtcgtcggcggcggcggagggggaggcggtgctgacgctggacgccggcaacttcacggaggtggtgggggcgcacgacttcatcgtcgtcgagttctacgccccatggtacgtacattgtacaggcaaaccccattcctcgccgccggctcggcgccatggcgccttgctgattttgaccttgagctcagctgaccaaatcctcttcgccgccgccgcaggtgtggccactgcaaccagcttgctccggagtacgaggcggccgccgccgccctgcgctcgcacgacccgccggtcgtcctcgccaaggtcgacgccagcgccgacctgaaccggggcctcgccggcgagcacggcgtgcagggctaccccaccatcaggatcctccgggaccgcggcgccaggtcgcacaactacgccgggccccgggacgccgccggcatcgtcgcctacctcaagaggcaggccggcccggcctccgtcgagatcgctgcctccgcctcgccgccagcgggcgactccatcgccaacgacggcgtggtcgtcgtgagtttgacctcctcttctctctgcatcagctgtttatgcttatacttacaagctaaaggctctcattggatggcctaaatagtcaaagaataagtcaaattttaaattttcaaacttaaatttaagattgattttaagatatttttaacgtaatttcttttttaatattggcttttaagtcatcaagaacatatatatatatatgaaagttttatctataaatttatttttatcccctaataagctgttttggcttattagggaaagagccaaacgatgggagactaaaatttaattttacatttgaatttttggttttttattataaatagcatttacttttttaagtacatttgattttttgttttttaattataaatagcatttacttttttatatgtatatataaaagttttactcacaaataatatttttatttacaaataaagtgattcggataaacatacaaataagcgaaacaatgacccgatgcatcagtcaaatactcttgctgatgcaggtcggagttttccccgaacttagcggcagcgagttcgagagtttcatggcggtggcggagaagatgagggccgactacgatttccggcacacgacggacgccggcgtcctcccacggggtgatcggacggtgagggggcctctcgtccgcctcttcaagcccttcgacgagctcttcgttgactcgcaggtacactagctgaaaattaatgctacagagatactctgctctgttttgatccctccaggggaggggtatctctgtattcttgtttgcttaaaatcatccaagtagttatgattcatgaaaatttctgtaaaaagttgacagcgttcgtacaaatacatataccacctctaaaaaaatgtaagatccaaactcaacttacacattgatatataaaaaacataaattcggtatatgaataatagggtagtggtagtgtccatacccgaatttatctttttttttcaaggtgcatgtcaaatttaaacttaatttctggtgaatcgataaatatcattatactttatattgccaattttttcaaaaaaatttacagctatttacaataaatttggaacaaaaatatacacgaggggatatgaatatcctccaagggattagctagtagtagctcacattttggataagaaatggacagaaatttggattgcttcttgtttttatttttcaggattttgatagagatgcgttggagaagtttatcgagtcttctggtttccctacagtggttacctttgacactagtccggcaaaccagaaataccttctgaaatacttcgacaatgccggcaccaaagtaaggacagacaattggttgacttctcactctgtttgcctacactggactgtttagcttgttgtttaggccatgattgcctcttatcatgtgcacacgattttcactgtctctcatgttttatttcaatgtgctgctggaatccataattgagaatgcaactcttgtctcacttggtctgatcatctgttctttctgaacctgattttgagcgtgcaggcgatgcttttcctgagcttcagtgatgacagagcagaggaattcagaactcagttccatgaagctgcaaatcaatacagcgcaaacaacataagctttctgattggtgatgtcactgcctctcagggtgctttccaggtaatcttttgccttcttttttccataacaatctttattagtacattgctttgccccaacatttcgtataaaaacaatgtccaagagttgaaaatgcctgctgtctgaccatttttgaatgcacaatgttccagtattttgggcttaaagagagtgaagtgcccctcgttttcatactagcatcgaagtcgaagtatatcaaaccaactgtggagcctgatcagatcttgccctacctgaaggaatttacagtaagccaatttctgaactgacgctattatcctcttcctcgtttactaattccctgatatatattctgtgggttctttaagtcgcttgcgtgatatttagtctcactattttatactagggactatgaaggttacttattattagtactacctctttttttaatttctgatgctgttaaatttttgggataagtttgaccatcgtcttattcaaaaaatttatgtaattattatttatttttattatgacttgatttatcatcaaatgttctttatgcatgatttaaatgttttcatatttgcataaaaaaatttaaataaaacgaatggtcaaacattgataaaaggttaattacgtcatacattaaaaaccggagaaagtttcgctacgtgcttagtcagtttgccttgattttctttatgcaggaaggaacattggcaccccatgttaaatcagaacccattccggaggttaacgatcagcctgttaagaccgttgttgctgacaatcttcgagaggtggttttcaactccggcaaaaacggtatgttcttggctacttgcttgaagaacttgtattaattaccactcgacctgttacagaatgcaagatgttttggtttttgttacaagcaattttttttcaagtttaaccgagtacatagaaaatgtagcaacatttataacaccacattaatttcattaaatctagcgttgaatatatttttgtaatatatttttttagtgctgaaaatgatgttacgtttttcttaaacctggtcaaactttgacttggataaaatcaaaacaccttatattaaagtggaggaggtagatatttgtttaagttatgccctgcatgcctgatgcctgcttcgtcgtcaacatcttaaccattttgttaatttgtttgctcaagctgtcaaaacataagttcggtctctgttttttttttttcaaattccttttgcagttctgctcgagttctatgctccatggtgtggacattgtcagaagctggccccgatcttggaagaggttgcagtttcattgaaagatgatgaagacgtcgtcatagcaaagatggtaatctaccctacctatgagctctctccattgcttggtccatgctggccttgtcaaagatatgattgaaaaatgccttcatagcatgcatccataaaccatctgatctatttatttcttaaaaaaacaaaacaaaacaatcagactgattcattttattttttttagaaaaaaagcaaccatcaaattcacatgtcatgcctggggaaaaaaaagactcaagtttgacattttttttgcctcaaattcaacaaaccagattattatcagaacacgcgcgtttctcaccgttcacctcttgaccaattcgtttgccctgaattgcaggatggtactgccaacgatgtaccgtcagatttcgcggtggaggggtacccaagcatgtacttctactcgtttggggggaacctcctgccctacgacgggaggacagccgaggagatcatcgatttcatcaccaagaacaagggctccaggcctggggaagcaaccacgactgaatctgtcaaggatgaactgtgatggccacttggtcagtgattcagcgactccaagttttttttttttgtttctttaccaaaagagagctgcattttgcaaaacactgatttattcaggatgaattgcaatctaaaatcatctttgtattattttttgtagggggagtggggagcttcaggttaggaggtgcagtgcagctgacagcttgaggacatagctcagtactgaatttaatcttgtattcgagttccaggtttccaagtacatgtagcattaccaatggtttcatacatacatgtccccccccttttttttttttgcaccgctgaaatctgttattgtaacatcattacactacatcgaataatccccattttagcttgccaaacgagtaactaaaatccctgtgtttctgaaccgaataatcttaccaaactgaaccaaaaaaaaaaaaggacagcatcaaatgtccctgcctttctgaatctctgctgctccagagtggttggcgttagataagctctctcgttacagccatcctgtcctaacaaagtaattaagcatgtaaactttgttcctttcttctttttttttttgtgtgggtgtgtgtgttgtcaaaagctatcatcctaacataatgtgaggtcccatggatgatgattgtccacaaggttggtggcgatcgatgctgcactgcaatttgcaaagccgtgagagagatgagatgagagaatcaaagccgtacgcgcggctccgctgttgcaatcaggttggtcgttggctgtccctctcctttttctctcctctctctctctgctgatctgctgccttttggacagtgcatctctgcatgcgagctcagcactagcagcagagcagcaaggctttgcacttgcaagctttttttttttttttgggagaacttgcacttgcaagctgctctccctttctatctccactacttctcactttccaaatttccatatcaatgtgaatgatagtaataataactaattgcattgtctggttgagctatctgccacctaatttaatgaccaaatggtccgctttattaatcgactgcgagtacactgttgcactgtcgcactgttacatatatatatccagatttttaacattagtaacttttgttagtggtaaggtactaaggtcttgccttttattattatttttttctttctcttcagttaattcgattttatattcctagtctttagatatgtgatctggtatgtggaaaatgccacttgaaggatgtaaacaaacatgtacatactgctagcgtgcaacttacaaatggggaaacaaaagcaataattttcctcttacccagaaaaaacaaaaccaagaactcctcaacatttataactgaatttaaatcctaatgttgactgtacgatcgattatgcatacatggtgtgcatttaattttgaaaaggaaaaaaaaaacactgagctgagctccagaagatgcttttaattacacacagtaggttaattaattactttgccgcgaatgtatgtgcggcgagagaatagtaattaagagtaagctagcgctaatcatggcacgtagatgctcccgtggcggcgatggtggtggcggcacggcggcgccggcgacggcgacgacttgtcgacggcgaacagcttccggaagagcctcagcagcagctcccaccccgtcgtcgccctgctcccgccgccgccgccacggcggccgccgtagaactggcccacggcgcccgcccgcgacgacgccctcagcatcgtcggcgcgcacccgtacagccctcctcctcctcccggtggggacgacgacggcgtctcctcgtcgtcgtcgtcgtcggccgccgccgcgggtgacggtgacggtgacggcggcgtcccggccgccgcgcgctgctgctggcggcgccggagctgaagcaggagctcgtcgttgaagtcctcccacagcaggtccatcctctcctcgtcgccggcgcgcgcgtcgcggtcgcgctcccacagctggtccatccgctcctcctcctcctcctcgtcgacgcgccgtgctgctgctaccggcgccgtcgccgccaccgcctggccgcccgacgccgcgtcgtcgtcgtccgccgtagccatcgtggatgagaatggccagaggaggccgccctggctgctcggtgccagcgacgacgtcgccgccgccgccaccgccgtcgccgtcgccgtcgccgccggcgcggggaacgtgaagtcgtcgtcgtcgtcctccatggacgaggcgaggcgaggcgatcgagctgctactgttgcgctctgacactagacactgctaagtctcgcgctgggtttgtgtattgaagtgatgataaggttagagagtggaatagtacgtggacgcgattgggtacccttgccttgtgttgttgtggagttgggcaggtgacaggtagctagcgccagtaatgctagatttggattgtagttagggagagaatatatgtatacgtatgggtggtattaattactcccccgtatctaaatatttgcgttgatttttttaaacatatttaatcgttcgttttatttaaaaacttttgtaaaatatgtaaaactatatgtataaataaaagtatattaaacaataaatcaaatgataggaaaggaattgataattacttaaaatttttaaataatatgaacggtcaaacatattttaaaaaaagtcaacgacgtcaaatatttaaggacggagggagtataatacagattttatttcatttttcgtgttttcgttagcaactttaatttttttttcaaacttttaaattgtatgtttcgtatgaaagattttttaataaaaattaatttaaaatatcaaataaatttatttttaaagtttttaataattaaaatttagctttcttgttttatgtgttacaacattattttcatcttactagcaaaaatacttgtgtgcaacacgtgaagacaattttcacgattgataaaaactctatcaatttaaatgacaaatcctaacgagacgaacaaaataatggtaaaacaaaatcagaaatcatatattatagcattgaacccggctgtatttatagcattgaacccggttgttgcgcttgcttcatacgtcatcacacgaataatctcttacgtacagctttccataacctcacaaatcaatcgggtggccattccataaatcgatacctgggtattttactatgcctcatcgaccatatattgaaatttttattatttagttagtgaaagtttttttactgtagattgaaagcatttataaagtaacaaacttgccacatatacaccttaaacaatgataactttaagaaaaatattgatgagaagagaattttgaaagagaaaaggaaaggaaaaaaagagaaaaggatgagaaaacagaagagggggaggagagggagaggttcatgatgatggagaaaagaaaaggagaaaaagaaaaaaaagagagaaaaaaacgtcgatcgaggcaggggtgcacggaacggggtgccggtgggatggtgtgggacggttgggttgggctaggaggaggaggggatgtacaatagttgttctacttatgtcgaattaggtacgggtgatgtacaaccaactcaaaaattaactcaagcacggattacgtaccaaaattctgacaaaaacgtcatcaatttctataatactagaaaaaaaatactcgtgtgttgcaacaggtgaagtctattttaatcttattattgttatatggtttagttaagatgaaattcacgatcttaaaaaccgactcaaatacggatatgtatttccaaaagcaatcaaacttaaaaaccgacccatacacgaatgacgtaccaaaataccggtaaaaacatcttcatttttataatagtagagaagagatatagattaaaaccaaaacataaaattaaaaccgactcaaacacggatgatgaactacggaaatatcttcaatttttataaccggctcaaacacggatgacggaccacgaaaatatacttaatttttataatagtagagatttgaaaagaagaagacgaccatactatagcaccaacagtatatgatatatcgagagggctatttgcgcttgacggagcgtggggctcctcaccgggagaccgcgcaggccccctttgccggttcggccgggggcgctaagtgaggttcttcgccctcgatctgaggaacgtccgcgagagaggaaatgcacaagacacgggcgacgtagacaggttcgggccgctgagaagcgtaacaccctactcctgtgttctggtggatctgtgcgtgaaggaatacagagagccggagagcgagagagagttcaggctctagcaccccttcgccagagtcccaaacctccttcctcttttctctcctctccctttctctcttaggcctgggcctcctttttatctggtcaggggtcaccacaagggcctacagctacctaagaaaggaaacatgctttttacaatgagggatagtctacagccggaagtgacctctgacaagcagagcaca

SEQ ID NO: 4271 - DNA, 25387 bp, Oryza sativa
  unsure (1)..(25387): unsure at all n locations
gaccccccccccccccccgagggggtcaggccacgtgggtgaccgcggctacccaagcctctagtcacgatacccccggccccatgtcaccgacagcgctattggcacactcttcccttcctttgtggacgaaatgttttccttttcagatgaaagtttcaagttttatgccaaagcacacaatatataatactgcagcacgacaaccattgttctgccaagattacctatataatacttggttttgcatatcatatactccctccgtcccataatgttgcaaccgaggatgggtactaggtctacgaatctgtccagtccaggacagattcgtagtcctaggatggttgcaacattatgggacggagggagtataaacagaagaagtctagagtggatctcgatctacgcacgtctactcttggccctcgtgtcttctcttggttcgggatttaacgcacggaaggcagttcataccattccgctcccatgatgaaaccaacagcaacagatgcaacggtgacaagtatggtcatcacattctcttttctgatcttgtcgaggtgctccctatcaaaaggatgtttgcgtatactcactccttcctaaatgtttggcgccgttgacttttttaaacacgtttgaccgttcatcttattcaaaaacttttgtgaaatatataaaactatatgtatgcataaaaataaatcaagcgatagaaaaataattaataattacttaaattttttaaataagactaacgggtcaaacatttttaaaaaaagtcaacggcgtcaaacattttgggatggagggagtataatgcatgaatgttaggatcgttttcatttgagtaaaaattaatgaaataaatcgtagcgcctccaaattaattaattacctcgccagcttcatctctaattctagctatcccatcatcaataatactagctatcttgccatctatctccactcccttattttctaattttgccaacagatgatcaacctccttcgtcttcctggcaacatcagctctagctcctttggcggatccaccctgctagtaggattaattagagaaatatatatagttagttgaaatggtaatgcataagctaaaaacagctagccatgcatgttagtggatgctaatgatcagagagcaatggctgcaattggctaacggtggtcctttcagagattgtactactaaacttacaaaagtttgacgaccagcatatgtccgactatatgaaatttatattactatacttgtttttggaaatgctttaataacagtacaatatagaaaataattgatatagaagcactaaaacggataccctcatctcaatcgggcggtaagccccatctcaatcgggcacggcgtccgtcacaggctaaaagtcactgatgtgaagagttatctcaatcgggcaaacggccgtcacggatgaacccgccaccgatagctttgacccagacgaccagtcaaactatagcccatcacagatgacctatctcaatcgggccacaactagcgcccgtcacagatgactactaacctcaatcgggcctacactagagcacatcacagatgatactcatctcaatcgggtctaaactagagcccgtcacagatgactacttacctcaatcgggcctaaactagaacccgtcacagatgatactcatctcaatcgggcattaagtacggcccgtcacagatgaccatcatctcaatcgggcatttagttatgtcccgtcacagatgactataatgcacaaaaaaataaattttgttttttggctagcctcaggcctttgctagccatgccagctgcaaaaataacagaaacaaacatagatatacaatatgcagtcgtttggacaagcgtgaattctacggacttctaaccccagtggacacagaacctattttgcttcgtatgtcgtctcgggcaatgtgttctcagcaagaagcatagccttcaaaatttctaaaagatctgtgaaactcttgtctgtctatccattacttgtcttcaacttcattaggtccaaggtaactgacaacttagtgtgctttgctttgcatccagcgtacagaggcgtctcggaatcactgaccaacctactgaacttcatggaatctctctcattctgggctgggtcctcaacgtcatgtaacatgtcttgcagcagatcgtgatccacatcaaacatttcaccgcctaatggagaaggtataaacatgtcatgctcatcttcatcttcctaattatgcgcaccacttctgtctgctgctgctccacttcctgattcttgcttccatgtttcacccaatatgtatagcccttcatgaatcctcgttgtatcagatgaccgtgtacatcctctccgctatcaaacatattctcattcttacaatctgcacatggacaacacatgtaatcgttgtttcttcttttcctatcctcctccgcatcgttcataaaatttattacaccatttctgtactccggaaaatgatgtttcacaatttcgcatacatccaacttcgatcaattgctacaaaataaaaaaaataaattagaggcacatcttataagatcagtattgttaaagtaagacgtgatgaaattgctcaattaatgattaatattactcacttgattgctccattttgatcacttttgggaattttctgttttccttggaaaaaagacaaagaatcgccccctacagcctcctaccaaaatagtgaacagtgggatacagttacactaggtggtggagggtatttatactgtgcaacaaatatctgtaacggtcctaaaacaatcaaccatgacgggcatacaagtaatctctatcgggccttaataaaagcccataaaaaaagagtgtcatctgtgacgggcattaaacttatcttaatcgagtctttagttggagcccgtcacagatgaccctcatatgtgacaggcttcttttagggcccgattgagatatggcaccctcatctcaatcgggcctcaactatggcccgtcacagataagtgtcatccgtgacgggctctagttttatgccgatctaccatggctgtgcgaccatatctcaatcagacgaaactttggactgattgagattacttccttgtgacggcccgcaaattccaatcttgttaggggtcgtcacagatggaaggatctggactagtgaagctatatataaagtagtggcaaagttatgtttcgagaaacacaaaaatcacaaaggccttattcggtttagaagggattgaggaagaataatttcacattataataggtgtggaataaatttcctctaattcctccctcatagggattaaccgaaccaggcttgagaaaaaaaaataaaatatggggatagaatactcttctttgcccccaccatatccacgtgtactcaatgcggactacactacaaattgattaagaaaaaaactgattgtcaccgctttctttcaagcaaaagtaacaagtttagcacatatctttgcatagacctcctctgcaatctggcacttattgtgcatatttaattaattggcaatattcatcattagcggtcaaattacagaactcctctgataacaagggtctgaattgaactaggtaattgcatcaaacccctatatttgttattgtctcggggaagataacaaaaaacagttaatttgatcgtggcctgcaggttaattcgctgatagactcgtcagaaccagggagtcgacagctagctagctatagtaggtagatggatcgaacaagagcggaactagtacctgatcaggggtgggatcaggaagggagttcgccggcggcgaatcatgagagtgcatcgccatgacaccgagacgccggaggaatctggaggaggggggcgcgccggttagggtttgggttctctcaacttaatttgttgcctttgcctgtccgagactgagagatccatgggctaggccatccggcctcttggacctgcgtgacccccaacgacagacgaccaacagcggaataagttcattggaggtcccttaacttgtcgacgaatccgattttcgtaagtccttcaattgaaaaaccagatacaacaggtccctcaactgtcaaaaccgatgcaaaataagctgacgtggctaatttgaatcaatcatcattggatgtggcgcttacgtggcaatttaatttggaaaataataaaaactgtgggcccacatgccagttccacaaaaaaaattaaaaatggtgggggccacgtgggccccacatgtcattatcaccccctcctcttattcctcctctctccctatctcccctctcttcatctctctcccctactcccctctcctctatccaggcatggcagggaagcagccggtgggaaaaggaggggtgcgcggtggccgggagcggcgcacggtggcaggggaggccgctacggcgaaggtgaccatgacgacagtggtgaaggcggctatggtgggggcaaccgcgtctatggcgtctgtggcgtgggaggtggccacaggtgccgtgccgccaccgccgaacctcgtcccttgctgccatggtaggggaggttgaggaggtggtagtggtggtgcctccctctgtcccttgtaggctgttttcgtcgtcatgccaccggagagggagtttgatgctgacataggagcggagagggatgaggagggaaggatgactgttgcgcatcgatgttgaaagtggtgacgacgatgtggttgagcattggggtgcgaccatggccactgtatgtctgccccgtggcagtgaagacgatgaagcgttgctccctactacccatctccgttctcccccgcagcggtgaagacgatgagatgggtgctgctagatccagcaagcagcaggtcggcagagaggagaaggatggtgccggagaggatgaagaggacaccataaactccaaatcaacgcgacagaggcttgttgcgccgatgatccctccgatttcttgaccacagccatcgtcgcttccactcccacaatccgccggtttgcatcgccgtcggggagttggcagcccgccacgctgatctgccccaccccgtgccatgcaaaatcgaggccgtcggtgccaagtgctattccaccagccgccgctctggtctaaaaatgtggttattttttatgtttgcttatgtggtcacatcagcaccccatcagctaaaaccaccttcaatattgagactacatttgcatcgtttaggaagatgagggatgtgttataccccggttttgtggttgaagaatgtaattaagtcaaactcgacgtctagatgaagaacctaaagtgaacttattccacgaacagcacactacaacaatgtgggcctgagtgttcagaagcccacaacgcaacataagccgaaaatcctacccatcttccgcagaaagctacccgtccatcccacaagcaaacctacaactgaattgactaacatgaatttgtttaactcggttgctatacatacgacatccaatgcatctcgtactattatcagggcatgcggctatgggcaagggattaatctacgttggagatgcatcgtcgtacgtctcagtcggatgaagcggtcgtttgtgtagtgtaattcatgtccaatctaatagtaagttgctcctatattttatgcctgagtgagtaactatggttgacacgttttccgatcaccatgatgaatcaccgaaagccctacgatgttaaccggagtcgtcaaccatcttgatctagaaaactctaaaccaatatgggtttagaagaatgaaaaccaactagcataaatagcacaacaattatcagacaacataaatagattttgcataccatagttagcttagaatgttttaccaagattactaacttggtcgtacataccataaacagagttgacctacaagccctaggctatttaaccaaaaaagattttcttgcacactgccgcacggagggcacatttgcaccattctgctcccaagacgaaaccaccactaatacatgtaagagcgtgcactatcgtcttcacattctctcttgtgttattgacgtgccccctatcaaaaggatgtgcgtaatgcatgaatgttaggatcgtttcatttgatcagtaaaaatgaaataagttgtagcgcctccaagtaattaattacctcgatgcttcagcttgaattctagctacctaatcttcaataatactagctatcttgccatttatctccactccctcattttctaattttgccaatagatgatcaacctccttcatcttcctagcaacatcagctctagctccattgccagatccaccctgctaggattaattagagaaatatagttggaatggtaatgcataagctaattaaaacagctattcatgcatgttagtggatgctaatgagagagcatggctgcaattagctaaaggtagtcctttgagaaattatacgaccaaacttacaaaagtttgaccaccagtatgtctgactgtatgaaatttatatttactatacttgtttttggatatgctttaataacagtacaatatagaaaaatcattgttatataagctacaaagtagtggcaaaattatatttcgagaaacacaaaaggtcactaagggaaaaaaaataaaatgaggatagaatactcttcttcgccccaagtaaatcaaacgcccatatatcatggaattaggctgcattccaaagtgttgcgtggagtatcagaaataatctaaattactgcagccgcatgtcagggcttgcagcagctgcacactttgaaaaattgaatagcggctgatgacggttgccgttggagctgagggacggcgactgttggacctgatggatggctgtcgcaggcacggcgtcacgtatggaggagataacggtggggaaaagaaaattaaagctagaagcacacgcgcattgcacttagaaattaatgctgcagattaggattagctaacggcctggcgaaatttgagttttttttttctgctgacaaagcacaccaattaaagtgaaacaaatattgcacataaatgcgtccgatacataaatagttttcgatggaaggaaggagacataaatagtaggatacatatccatttcgaaaatggatgttaaaataaatattgaacatacacttctacccgtggtacatctgattcgcaatagtctcacgataagtcgacatagcttcctcgctgttggggggagtcgtaccaactgcggaggggtggcgcctgtggcacacgggggtacccgttgtacaaagggttctgtgtcatgaagtgggggtcattactatcagtcataaagttgtggagagcaaaagtagcaactataatcttcgtctgagcagcttcctctccatataaaggaattccccgcaggactctccactgactcttgatcaccccaaaatctctttcaactgtattacgcatggcagagtgcatgtagttgaaagtctcttcctttccaaccggtggtggagcttcgttgccttcgaaatcatcaacatggtatctaacatttgtttacggtggtaggaaaccgtacctactgggatagccagagtcaacaagcagatatttccctgaaatataaataattggaagtgttactagtcgacacaaatgaaaatttgtaattatgaaaactataacacaagcttagttagatcactgtactaaccccatggcaaccgtggaaaagcaaatggatagcggcgaactgcctccgatagaactctttggtcgtgtactgaaccaggccaaccaacatctacaaacataactcgttcgtcccaaccaatgatggttagcacatttctagaagtttcattgtggcggttcctatgtggaattgaattatctctacgcacaagaagcggtacgtgcgtcccatctattgctcctacaacaccagcaaagggaaggaatgcatcatcttgggcaagccggtaatgctgcgggaagttgtttggatcaacttgtttgatgatgtcggctgccatctcattgacagcattcaacaccctgtgaaaatatctattcatagtagcgttgcaacgaaccatcctattgttgacgctcctcacggaatgaccacctgccatggcgtacaaaaacattccaattgcttccataggacatacctcataggtaccatgcaagtggtacctacctgctcacaaggagattgtagagagcgtgaatctggtccgctctcatccgaaacatgttatggcactgctctgggttgttcattgtttccataacccattgcatgcccgactgctgaggtacccgtcttggtgctcgtgtgcttacattcctttgaaaagcatcagccaacaactccataattgtttcatcctcctcgcttgtgtatccatctttagaccctgaagtgttccctgaggtggtgctcatcttggtaggtcatgaaatggaaagttgttgtagcatgtacaaaaaaaatcatatctatgatgttcataacataaacagtgtaatacaagtgcaaactgagataatgttgtcgttagtgtatgtgaaaggaacaaaaaatgcacaatatgaaaataaaagttagataataatctgagaggtgcagtgactgtacaataaatgaaacacaagtttataacttaacaaaaaatattgcacattagcagtgagtgtaaaataaattattccattagaacaaccaacttagattaatacgcaacgtgtgccgaattgttcttacatcaatacaaatcaacctgcatataacataactatgttcgatttaaaaatcgaacacattatttcactaacataacgatggaataaaaaggcagagcaaccaacttcagcttcagtcgcaccagcagcagcaaaacttagcagcagtcactcagtagcaactcacagaggcacacacagcacggccataacacacagctagcacacaacagcacacaatagcactagcagaagcaccatacccactcaacacactgcagctccgtcggctcccccagcaccatcatccccagggtccccccatcacccccatcaaaccgtgtaccaccaggtggaaaccaaccccctgagcaagatggtggagggaaaaatcctccaccattaggaaacttcatggcatagtggaacctaatgtagtactcacgcatctccggggtaatggcatcacctaggaagaactcgcaaaagtatgggtcactaaagagcaaaacccccatgtggtaaacatctgagctaaataagtgcccatcagacttgaccaactcaatgcatgcacgagcactcatagcctcacgttctcgctgcttttgtgccttactctcactagacttaaccctcagatcagcgagcctatgcaaagcctcaccggtggagtcactgcgggtccttttggaacccctagacccactagccggtgttgccacccttttgcccctacccctggttggccttgaccgtgatggtggatcaggtgactgtggcgcatctggcacgtcgacaaggtcctcaacatcgaggagttctgcgttggctggctgcaactgctgttccagttcagtgcctgggacacttgaacggttgccgacaacacacctccccctgaagacagcatggtgctcagcaatgaatctgagaggtgcattcctgaaagacctagcacattttctcatctgcatttcagcaaaagagaaacaaactagagtgaacaagaagtacacatgcatatatgtattgcataaagtacagaagctaccaaactacaagcacacaggcatatatgtattgcataaagtacagtacgatgcacacagcaagcacacatggaatggctgcaacctaactgcccataatattagcaacaacatagcttatcaagtggttgcaattattatcaagtggtaagttaaataacaagccgacattttcagataattacgattgctattgcaatattaataaaacaacatcagcagggaagtattaatttcaatttgcttcagcttcatgtaaatatgcaaatgtcatgtgttatccaggcagtagtactactccacaagcactcaccacagctgtgaacaagtctcatatgattcactaaattataccacatgtcatacattcacaacactgaatataactactgcaaagtccatttagctgccaaattaatatggaaaatgctttcagagtatttaaaacatcaaagtgtgcatatgcatattacagatttgaccaaatattgcttagcgcaaagtattgtaaaatcagcaaggacaatataactgagtatttgggtataacaatcaatttttttggtggtaagcaaatgtagttgttacagccattgttttatttcactaaggtggtacttaacattatacatgcagtgagaagtgaaggtggtgttcagttaatgagatgaaagtagaggtatgtactattgaaatatattagcaacttttggaatgttgttaacaacacttgtactctagttggtactactatatcatctttcattttataaattaccaaaggtatcatcaaagggatgtctaagttcttaacaatataattgctcactacaaattatgtcctgacagaatcccaagcatgcatatgtgaatccatttgatgtgcactagggttcctgatcttccgaaaggttctgataaacaacgatttgggtggagtcgcgacacaaatcgatccggcttcttgaacgcgcacgctcttgagccccgcaatcgcagcaccacatctcctctggttatcacccttgtcgaaacgcggatgacctcaccgagaaggctaatccctgtttgccaatcgaagaacacaaacaagaacgagatagaaaacaaccaaaattgcatatgaatgattaagctcacgagttggggtcttacaaaccgatctaacagcgaaactgctctcgacagaataatctaagcaaaacccaaaaacctaaagatggcggcggtactgatatatagagtttagggtcgtgcaaccccctctcgatacaaccctaatgggttccaacacgatacatggcccaaaggcccaaatacggtgacgcagcaccgggacagattctggacgtcaacttgttcggtcgattcccatttactcgaaaagaatttgggcgtgggaccaaaaccattggaaatgttatcttcttagctttccatccatataaagaacgccccaatgcgagcacgtatgcgacctgggcgcctgttttagtgcagactggtcctggactccgaattgcacccgaggtcaaattggtttgggcctccaccttgacttggacgtcctcgtgttgacgaaaaaatcgaacacaccggcctgggagatctgcttaactcctgtgcatgtccaaagattgatgagatgcgagcgtgccagttagtttgatcctgcaactgacaagatatgcaaatagtagatcaaaatagccgatcggctgacaagccgatggagtagttccagccgatagccgataatagccgatgccgataccagccgatagcgatagggattaagcaattggctatatgtccaatgtggataatgatatattggcaatctgccgatgatgatataataaaataacaatataatccagtataaaccaatcggctagcaatgatatgataaataagtatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgtccagataactcaccggctaaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatctagcaatgtgatttaaccgataccggcagaaaccctaaaacgagaagcagccgatagagctaaattgatatgctaagactagattaacaaagacatatgataaataggtaggcaaatatatcatccaaaccagagcaatccaagaggtcgaatgtactgatgcagccttgaacgacaccgacgtaaacgatataattacctgggccgacggaacattggacttaccccttagccagagatcgaacaccgatgcagccccgcatcaggtgccaagtcccttcggacgataaaataaagtagaaaaggtaaaaggtggcgatgcgccgaattgtattgatcgtaaagatagattacatagaccccgagtgtacatatttatacctatgggttgatacaagtccttgtcggacaagaaagaaactttcctaaagataaaaggaaaagataaagtccttataggacactaaacacactttcctaaagataaaagaaaactaacaaactattcctaattaatagataacttgtcatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactactccaggcttaccaaatttcactgtgaacacctcgataatcctccatggctctaagtctttctccaagtgtctccttgtcccctccattgttactaatcacaatataatcattcggtagcaatctattcttgaattcatacaaagaagaacataggaacgagctcacctctaaatttaattgtcgcgcacgagctcttgatatcggtttttgaatgaccgttggaggattgttgtatgtatccgaggtagtgatgtccacatcaccatttgtacttatcaacatgatgacccagctaaaaaatggtaaataagaaataatcccttttgcaatgattctaacacattgtgaggttaccaattaaatggatgtaatacacttgacaactgacatgtttgtgtacttatcattgcaatctccatgtgtacttctcattggaaaaaggcacatttgtacagcacacttgctaacttaacaaattgacaagcttacatctgaaatattgaatacagctatttaaaatatctatgtgactatgtaacttgcaaaactaagttgccatgtacataatactaggtttgaacatttgcatctaaaactaagttggcatgtgcatctaatgctaaaatctgaacatttgcatctcaaagcaagtttcaaaactaagttgccatgtgcatgtaatactaagatctaaatatttacatgtcaaactaagttaacatttgcagcactatttgttctgaaactaagtctgaacacatggtttcggtaaagcaaaaaggaagagaaagggaggactaaccccttccattgcttcccaccactctggggaggcgtcaatgctgccggtgtacgggtttgttcccagccctgtagccatcgattccaaccatgtccaggtctggaaacggcggcgacaagcaccccagaagttcttcacttgctgcttgctgacatgcttccctgccttggacagcatcttggcctgcaagttggcatacccctgagtcttggggcatgacgaagtgatgttgcgagcttctatttcctccatgcagctttccaagaacgcatggagttcgtcctcagtccagtgagtgtgacctccgccggccatctaagcacacaaattgagcataccaaaataatcatgaggaaacacaaatagagcaaggtattacctttcttagtttgtccgattcgaggaggtcctagtccagcgagcgtgcaaccttctccggggtgaggcggcggatgaactgccggacggcttcgggggacttcgcagctacggaggagagtgcacgagtgacaagctccacatcgtcttgtgcagtggctccggatgcagcgtcaaagaggtaagatttggtcgaatcttcgctcaattccagctccacggactcctctcccagcttaccgacgtcgatgggcgacgccgaagaaggggaggagcagatcagaggttcagcggcctcaaatttcctcttggttcctcttgcagccatttgcgaccgaggggtctctaaaataggaggcctcggctcttcaatggcgcattttcgaaatgaatgtggccgtcgtcgatgcagacccactgtattgcatgagatcgatgcagcgattgatcaaatcatcctgcaaggcttcacgagcgcagcaggaatcgatgcctcgatgcccaatgcctcgtcgatgcagactgtcttccacgagatcgacgcagcgattgatcaaaacaaccttcaaggctgcatgaccgcagcaggaatcaatgccgcgtagcccggacgcggctggaatcgctgccgcctactgcgcacgccgcgcccctttgcactcgatgcggtatccgattcccctcgatgcggtctccaagagcctgctcacgagttgtcgatgtcgatcggctgtacggcacctatggcaaggagcagcggccgctgctccgcacggcacgccgatgctctcctcctccgcctcgacgactgccggtccgtgctgtgcactcttacgggaaagggaatggggtgaactgctggacaatggggtgagctgccccttgcgtcgacttcacaacatagggaggaaggagaagaccggtgacggacggctgccgtaaggttcacatcaacaacggcgtcaaactcccacacctacatctacaggaagcattgagcccaagacaacattagtctagagtgacgactccagtagcccatccaagcccattgaactatgcactttagaacgcagccttatccgttcatcgtatccgcgtgtagtcaatgtgcgcggtggaggctgtcacatcctgaaaaattcaaaatatataaattgttgtttaattggaatttttagaaatgattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaacctcttctctctctcctcggcccaagccggcccagtccgccgccgcgcgcgcgcgcgtccgactgctgacaggtggggcccgtctgtcagtcttcgtcttcctcgcgtcggccgccgcccgaaaccctaaccgagcgccgccgccgtttccttccaaatccggccgctcctttccttctccggccgaattgatagaggggaaatgatcctagggatctcctctaccttttcccctttggaaacatcggctaattcgttttggaagttcgtggaatcgagttcgattcggatcggcctctttccttcgaaccccgaagtttccttctcgtcgccggccgccgtgggccttcgtcgccccctccgagcccctttaaaaagtttccccgagctcttctttacccggcggcaccctcgcctttggctctcgtcggccgtagtgctctagcgccgtgtgacctagcgccgtcgttgccgccgtcgctccagccgtgcgctgccgccgttccggtcatcgccgttgctcggaaagaccgccgtcatggtcgcaaagtcgccgccgtccttgtctgccgcttcgccgtcgccgaagatcgtcggagcaccgccgtcaccgtcgacccgaagaccgccgccgcttcaacctcgtcgccgtcgccgtccgttggtcttccgccgctcctttggtcaccggtgagttcgccgcgtcgcgctctacccgttggtgccttccgttcgcgccgccgtgccgtcgttcgccggcgagcatgcgcgcccaagccgccgagccgccgccgccggtggtgacgtcatcgctgacgtcatcgtcgccctctcccgtgagccgccgtggacccgatcgatctcggccgtccgttttggatggattgatctcggccgtccgttcacgtgaaccgtcgcccgtgcgcccggtccaccgaaaccctagccgctgacgcaataaatcccctttttcttttcaaaaataattcattattgcgtcataattcaattaaaatccatataagtgttttaatccgatttaatcttcaaaaattcataactaattcatcttagctcggatttagttggtccaagtctctaaatttttctaaaattgagatctacatgttaaaaatatccacatgtactgttcatgcttgtttatgtgctgttttggtgtttttgctcttttctgtttagattccgacatttccggagagtccgttttcgcagcagaagaatttgaagagttccaaggccagcaaggcaagtcacacagattccaaacaaccctttgagcatgttgatcctatttaaagctattgtttctattcaactattgcatttattttcgaatgtcattgggtggaattaacctattctttgttatagcccttttgttcttgattactttattccttgataccttgggttattataatttgactagttgagctctatatgttggttcaactagatgtattagatataattgcttagccctgcttagaaacattagcacattattgggataacttatgactcactattatttcatgatggcttaatgataattcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcatgggcaacggctttatcttttatatagcatggttcattgcggggcaccagactgagaagtggcggagataagcccacgggggtcgctggggagtccataccttgtttataagggggtgattatgatccaggaaaggtgcgctgtagtggattgtgttatgcaaggggtattgtcacaactcctttccgaggtaccgtggtggtgttgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccataataaaaggtgctttaattggtaataatttgattagctcctggtttggaatggtacattcctagtttggagatagaactgttcagccgggatggttgttcagaatggttgggcctatgcaacagagtatgttgtatagtgttggattaatattgattaattatttactccactgtttttcttctcttaaatgtttgctaaacgctgcttttgcaaatgagccctatactatgccattctttggtatccttgtgcacttgcatatttgctgcgtgacttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagaggcagggattatggcccctacaccccactagacaacaagttgcttcagtaaaaattacttcctccgtttcacaatgtaagtcattccaccattttctacattcatattgatgttaatgaatctagatcgatatatgtttagatttattaacatcaatattaatgtaaaaaatgctagaatgacttacattgtgaaacggagtgagtaattgtcaccacttattttctttcgagcaatagtaacaaggttagcacatatctttacgtatacctcctctacaatctagcacttattgtgcattttttttgggagtagctatacttatggcgctatatttttcaccaaaaaatagtcaccatgtatttacattgtaagtccctaaattacatatgtaattttagtgtacttacaatgtaagtttcaaaattacatatgtaagtttctaaattacatatgtaagtttaatgtaattacaatgtaagtgcaagacaacgtctatattttgcattgtagattacatatatttatatactatgcagatacatatgagtagaaccatcaaaagcttaaactaatgaagcatgttaagttttaattaattgtgtaatgacagccgagaaatactaaggacctgagtggactgaacaacatctgacggtcagaaattcgactgtaatcagccataaaatatggcgacatcattttagcaaatccgttttttgtttgcgttgcgagttgagctatagcgctggctttgcctctatgtgagcctgtcatgggcctcttgggcctgcgtgactccaaaacagcacgctttttgtttgcaaaaggaataagttcactggaggtctctcaacttaacaacgagattttttttcccttaaccacgaaaccagaaatgtatacccctaaactcacacaaaccgttcaataccacgagaagagtgggagagagaagagggaagagtggggaaggatttttttttttacatgtgggtgccaaatagacctcacattacccaaaaccggtttcaatactagggcatcagcaatgtgctcgcaaaccgggtagtaagcaataaatacactcttactacctggtattaagcattgtggggctagtacataactacaaccgggtcatacccctactgccggaagcaaggaaatagaatatgcatgtacacagtgttttctgacagcaaaagcattgcttctcccaaccgttgcatgcatgctctgtccttgctacgatttttattaccccatggaccccaccttactgccaactcacagatataagcaatgtggagcacgtctccctctattaccgcctgtcatctgggcccacgctaataccgatgtggatagcaaacattgctgatgcccttaggactagggatgcctcgtacgcggttttgcggttaagggatgcgattggaacttgaggatgcaaatttcccccagttccctgatcaatgatgggctgcttcaagtgggccgagcccatccggcccatacagctccctccctctatcccccttggctggctggcatacacagctacacacggaaacggccgccgaacaaagcgaacaactactagtcgtctcgtcgtgctgcgcactcgccccatcgacgagagatcgcctccgcctcgcacccgccggcgccggcgccgcctcctcctcctcctnctnctnctnctncccgccgtccaccggcgcgcctctttcccgccccgatcggctgccgccgccgcagctgctcgccgcctcgtttccgactcccaaggtgcgccgcgaagccgactccctccccctcgatctcctcccggaacgagccacacacggtctctcgtccttagatatggatcggacgccgcgagttcgtgattggccgccgatttcggtgcgcgcgcgcgcgtcgggttttttagaagccaccgccgccgccgcccgcttttccttttcgtttcccgtggcagtgagcgagctgtgcctacccttttttgtttgggagcaaaaggaagctgaattttcgcaaattttttgccgtaatgcgtccccttttaagtaatactgtttctggctactgtaatttctgcgatttgtcagttagctcgattcccagcttgcgcgatcctcatctgatctctctttctcccaaatcgtcaacctataggagcagtatccaggcattcggatccctcatggcccccgagatctccgctctgatgctagccgcagcttagggggtccgatggctgcctgtgctgctcctccatctacaggccgccttcgatccgcgcttccgcctcgcgaggagcctcgtttcggtggctggatgcagggctgcaggagatctccctctttaagtttcccgcagaatcatgtttccaccggtgcccccaacgatcttttgccctgcaccattacgcgcagcttgtttagccaccaatgcggccgtagccatctcgcagtcatgagggctgaaggttcacattatatattttttatttccatgaaggatgttagcctggagcttatttctataatttctttccataaaaattgtttgttatctatctctggttatttctaatgtctagggacatataagctgtgggtgtggctaatatgtttatcccttgtcatcccagtatcttgacactatccataatacatattatatagatcaaagccattaacctattagtttctggccctttgatttttcattacacttcagtttgctaattctattattatttatatcagggcattcctccatgggtggggcaaatgactcaagtccatcctctaaacttcacacaagactgagactatgggagttcccagaccgctatgtatttgagccgattgatggtcttgctgacttgtatctgtcagctaaccgttctgatggttcaatgaatctagttgaagagttgccaccacgtgactcttctacaaaaccaaaatgtcaaacagtgtatggtgtgataggagttctcaagctttcagttggatcatattttttagtgataacaggccgtgattgtgtgggatcctacttgggacatgcaatttttaaagtgacaggactaaaagttctcccctgcagtaactcacgtagcacttctggcaatcaggtcaagcaatacttatgccttcacagttttatatagcttccatctatttttcaattagtgatttgagtaagctgttggcagagtaaaatggaaacagaattttcagaactcctgcatgctgcagagaagactataggcctgtacttctcatatgatatcaacttaacacttacgtgagtatccttcttgtcaaacatagtcacattctagtgtcttatagtcaaagcttacaacctcttgttgcatacttgcattgaggatttccagcatagtatgcaattctatgcatggggttcttctattttagtagatggcattctctatttatttttacagtccacctgtgctatcatctttcatttaattctcttcttctgtttttggcttattgcaacagcatgcttatctatgtttccttctattgcagtttgcagaggctacataatcttggtgatgagttcaaatcacttccgctttggagacaggtttgctgccttcaccatttggaaccttttagttctagagtttgtttatacccatagggtctgagctttctccattgttcttgtaatccctgatcttttgctgcctatactttactgctgtggtgccaaaagctacttcttgttcacttcatctttagctatcagtttacacatctgatgtagaaatatggacataaactaaaccagtctgatttttaattccaattcccagacacaatttgtaatggttgattattttgacatttatgaaaaagggaaattaattaacaaagaagtcagaagaggttgcatattggccacttgtatttatgtgttttgccatcatggttcaagaaggcgctaggcactagagggtcagcagggcgcgccctaggcgtcacttagctagcatctaggtccaacatgacttgtgaaatccaagcaattagccagcatattacatataaatgttagacagtaggacattaaattagcagctaaaggagcccacatggatggttagccgcccaaggccactcccaatgggagtttcattctcactaaatagagtgccatgtcaatattttttatgatgtggcaaggaattgatgaagagattaagggcctgtttgggggagctttagattctgagaagcagctgtttggtagccagcttctgcgaatctggaaaagctctgaaacccagcttctccagcttctggcttcttagctcatttttcagaatctgtaactacagattctcagaagctgtggactgtttggggcagcttttaggaaaagctgcagctgggacaagctcccccaaacagggcctaagagagaggtggaatgggtttcatcaagatgaaactatgtgtacactatgtccaatatctgttgtctcttgcatttattgcctaggaaacaacaaaatgaaaaaaatgcatcgtatgggctgtttccaccatcaactaagggtatgtttggatgctcaggtaagtttagctatagctcgaatgggcaaactagctcattttagctatgctcatttcaactagctcatttcagctattgctgctcttgcccaagcaccatatttggtttccttgcttttaccccacgttgagaaacggctatcagtttttcccctcacgtatgcacttcttgccgatgagagagagccaattcggttctcatggctgagcaaggtttttcttgcccatcaaggctagcttgtccctcaaagctagcttgtccctcaaagctaggatatttcatcggtaccaaacaccaagcctggctaggctaggctagaaaatctttagccaaggatccaaacacgggggatgctagtgcgcgcgtgcgcgccagggaaaggagccggcgcgtgcgccagccgcgtccctacacgtttcttttttttttctagatctcctattttaacgtcacttttttgtttccttttttaaaccgcttctttttttctagatttttttaatcgcttctttcttttccacactcgcgcatgatttttttgtgatattttataaattcaatctttcaccttcaatatcagttgagagttttgaatttgagttgaaaagtttctaaaatttaagtttaatgttttgaattttgagatgaaagttttcaaattttgtcaaatattttgaattttgaggtgaaagcttttaaatttgagctaaaagttttcaaacctcagttaagttttcaaatcttgacttgaattttttaaatttgaattgaaagtttcaaatctttagttgaaagttttcaagtccgagttgaaagttttcaaatccgagttgaacattttcaaatccaagttgaaagtttttaaatccgagttgaaagttttcaaatctgagttaaaagtttttaaatcttgacttgaaagttttcaaatattgactcctactcttagacgcgtgtggtagttaacggccaaaaaaaaaagaaagaaagaaacacggctgttgcgcctaccgaaaaaaaaggaaaaaaaaagaaaaaagaagcacgcaggcttggtcgtaggaggacccgccatgtggcacgctcgcgacttggagaagtcgcgtgtacgcgcgaattaggattcctgtccaaacgcaccctaaatgttttgttgcttatttggcattcttggaaacataaaactgaaaccttccactagtaatgatctaatgcctaattcaggtggctacctggcacctagagccgatttgtataacactgtttgccatttgagcgcctggaattttatttttgcttctgctgcttctatagtccagtaattgctgcacaattatcttgccatctaggaaaacatagatcccatctaggaacattggagctttaatagcatttgttttaaagacctgtcttgtccccaaaaagtagcatgctgtggcttaagttaaaactttcagtagttaagcatgaaaaatgtaaagagtgctaaatttttacagagtaacatactacagtactttttttccactggggagttaagtactgttgaattaacattttatactgtgaaacatccatcttgcactgtccttttccacaaaggctcaaaatgggtcatatgtgacaataattctgtaaatatctccttttttaatcatataccatatgtattttactttcaagactggggcaattccttattttgaattttaaatttataagctatgccttgaacttgtatacagtagcttcttaaagcaacaacatagtgctgctatgtcaaaagttgctcgtgctaaatgcctaaaagcacaacagattaaacatgtaaacaaaaaattcctgtgccttttcaaatctatattgcacaggtgaaataattacattctttacaggcagaaccaagatttctatggaacagttacttgctggaacctctaattgagaacaaggcaagaattaaatttgaagcttactgatttcatagttttgaagaattaaataactgatacttgcaaaatgtattgattgtttctttcttccttaacagctggaccagtacttgttgccagtcattcaaggcagtatcctttgtttgtcatatgacatttcaatttggtcactgtcagaaatgcaatataataatatattattatttgaacttgagtcaccttccctagggtcatatgtcaatataagtcgcagacacttaactgaatatcaggctttcagaatatccatgcagaagttggatcggagaaggtaaatgtgaccctgattgcacgtaggtgcacacggaggataggtgagaatcatcagtgatcagaataagttcacatgttctcttctgcttattgtcacttgaaaatatttttttatatgtatttgattattttttctaatttttattacatcctggctccttatttttgagaaactcactggcatatgagtagatttaattcagttgatgagtttttttttaactaaaaggtacacgaatgtggagacgtggagctgacccagagggttatgctgccaactttgttgaatcagagcagataatggaatcaaaagggttcacagcatcctatgtacaagtaagtttcttagg

SEQ ID NO: 4272 - DNA, 686 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggatta

SEQ ID NO: 4273 - DNA, 624 bp, Oryza sativa
agtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgagg

SEQ ID NO: 4274 - DNA, 20697 bp, Oryza sativa
ctatagaatactcaagcttgcatgcctgcttccccgccgcccgccgtcgcccggcgtcagccccgccagatccggccaaaacggcgcggatttgggcgggggtttccgccgccgccggcccggtacgccgccaccacgcaccgccagtcgccaccgccaccactccgccccgccaccaagcgccaccccgccggatccggccgggcgggtgcggatccggacggtttgccaccgtcgccgcccggacagctccccgggccgccgagcgcgcgctgaggcgaagccccgccgccaccatccccgcggccgcgcggctttgccagcgcccgctcaggcggcggcgaggcacagaaggaggggggaggaggaagacgacggcggcggcgtcgcctctcgtgtcgcccgtggggagggcgacgcgagagctggtcgtgaccaggaaacctccattataataatataaagcggtaaattgaacaataccatgagttacgacaccatcgtatatgtatgagccttccgaacattatagaatggaataaatactagaatcctataacaccaagcatataaacactaccattaccgtttcatcggttgccaatattctctaataaatctttttaacttgttattagaaaataaaaataaatttagaggtaaaacttttatatatgattttaatgacttaaaagtcaatactgagaaataaactacgttgaaaatatcttcaaatcaattttaaaatttgttttagattattagagcaaccagtggctcttaatcctcatttatgagaaacaagaatggctgtagagagcacggctagcattccaagtcgcatgggggacgatgggaagttggtcatgggacccctgccggcttaggccccaggccgtcacacagcccgcctagattcagagccaacccttgtagtttatataaataaatccaattttgctatatatttatcgataaattttctcctaaaaatttaacggatgtaattacagtacaatcgtagtgtaattacactataacttgcatgtaattacactgtaactataaatataacttgtatgtaactttcaaaaatatctccgtaaaatgttattttcggtacaatggaggtcgtgggaacaaatcctttcacatatgtgtgtgctgtgatttttttctcttccttaccaaaacaaatcttgtaatagatctaacgattcaaaattacgttaaacttacatacaagttatattgtatttacatgcaagttacagtgtaattactctacgattgtactataattacatccgtcaaatttttaggagaaaatttgtcgacaaatgtataggtggtcccaaataaatccgttagttgtaactccgtgtaatttgtagcaaatacacagtaccagggtagaattgccttgtcgtgcaaatccggcccaaaatgcagcttgggtctagctctacattccctttcgcgatttcagacgtacgtgccaagtgtccaagtggacgatcgaaaaccctgcatatgttcaagcgactcttaaagtttggactaagataagaaattccctagaccacgaccacatatatactctctttaattgctggcactctcggacaaatgagacactatcaatagtttaataattcagcaagtggttcgtttttttttctctcataacatcagaaacgggtattcaacgcatccgagaattacagtctatgtgccggccctgccgattgcgccaaattgttcacgagcgagaaactcgatcgagacttcatgcgcattttgtgcataattaatccgaactaaacgcgtcacacttaattaattagctttgttttttttttcctaatttgctagttgagtagttgacccccctcaaaaaaacaactaaacaaatttctagcagttggcattggccaacgccttcatccaagctttgtgccattttttaaagagcttatcatacatatgtcatcccagtttgatatagatgatgcttgttgaaactcagtttgtgtaacaattatacacaaacgaataattaaatattagaaagctcaaaagtccatgtgctgccaatgttcggatggtggtttcggattggctaacagagcatggcggcagggttgcagagggttccaagcgaaaacttagcccaatgatttattgggtcaactacgcttttgggcgtggtaatcatcctgaggacgctgttgggatacccctcctccaacagtaaggagctctgagtgaaaacctgtctagttctttggacggatgacaacggcgtctttcggcaccacaaccttcgtgagggcgtcgttttttagagtctccgcttcgtggtggtgttgtaaacccggtggtgaccggtctctcgtagcgacggtcggcttggtgctccgcttccctctctgtaacatgtgtctgtgcggttggcacatggttcggggcgtgtgctctagttcatattctttctcgacagtcagttgtcgatgaaaaatttttttgcaacatttttttcatctatcttaataacatttggataaccttctttggtcatcccggtaagaaaaaaaggaaaagctcaaaagtaaattaaaaaacttttataaggaatgccaatgaaaaaaaaaaggacatcgctccaacttgcaatgtcttttctaaattactgtttagtcgatgactcgatgtaatacattgtattcgcattgttatttttattttatcaccctgcttagagtttcgcccggagccatgaaattttctgggatggccttgatataattatcctcttccgcagaccatgtaagaggaaaacagaaccttcgcggacgaacagtttgatctctttttttattactcgacataaattccctgtatgaacagcaatttattttgcatggcattggtgatcgtactgtctgtgcgagtagttaaaaaaaaagtgatcgtactgtcacgacgagtcgacgaacgaagaccagcaacaaccgagatcagaattgaagctagcaaatgcacgcgtccacacaaaaccttgcgaaaaacgatccacgaccctcacaagaaatcttgacctcagctcactaattaactaacacagggagtacgaaaacaaaaataaaacgtagagaggtgcttactcctaatcatcatcaaacgaagcatcgtttcctgtggcacacgcctcacggcgtatgtccaagtcatcaataattagacttttcaacacatgactgcattggctgcttgatatcgccttatatgcgctcataatttctttgccctatgtagtacaagtgtacaaccaattgccaaactgctatagttgaaacgatggctggattggtcatcggctacctggccgtgcagctctcgctgatgtctctgctgctctgcccgtcctcgtcgacggcgcagcacacgctgggcagatcctccatgtcggtggaagaccacgcgcggccgttcctggtgtcgacggacggcagcttctcctgcggcttcctcgaggccggcgacaacgccttcaccttctccgtctggttcaccgccgacccgaacaggaccgccgtctggtcggccaaccgcgacgcccccgtgaacggcaggggctccagggtctcgttcagccgcgacggcgagctggccctcgccgacaccaacgggaccacggtgtggtcgagcaaaacgacggctggcaccgggaacagaaggggcctgaccgtctccctccgcgacaccgggaacctcgtcgtcggggacccgtcgaccggcctcgccgtgtggcagagcttcgagtggccgacggacacgctgctcccgtcgcagcggttcaccaagcagaccaagctcgtcgccggctacttcagcctctacttcgacaacgacaacgtgctgcgcatgctctacgacggcccggagatcgccagcatctactggccgctgccggggttgaccgtgttcgaaaacggccggacgaactacaacagcacgaggatcgccatcctcgacgacgccggcgtgttcctgtcctccgaccagacgaaagccgaggccaccgatctgggcctcggcatcaagaggcggataaccatcgaacaggacggcaacctgagaatgtacagcctgaacgcgtccaccggaggctgggcggtgacatggtcggcgctcaagcagccatgccaagctcacgggctgtgcggcaaaaacggcctctgcgagtacctgccgagtctccggtgctcgtgcctacctgggtacgagatggtcgaccgccgggactggaggagaggctgcaagccgacgttcccagtcggcaactgcagccagggatcggcgccgccgccgtcgccggcgacggcgccgccgcagttcaagttcatcgaggtggcccagactgattttttcggcttcgacctggggtacaccgagtccatcacgttcaagcagtgcagggaccagtgcatgaacaactgccagtgcaccgccttctcgtacaggctcgacggccggggaaaatgctacccgaaaggcacgctgttcaacggcttcacgtcggcgaatttccccgggagcatctacctcaaggtgcccctcgacttcaacgcctcgtcgccgcgggtctccgcgcagcgcgccgccggcctcgcctgcggtgccaacgtcaccgtcgtgaccgtgtccgctgacgtgtacgggatggcgccaggaagcaacgggcagtggacctacttcttcgtcttcgccggcgtgctcggagtcctggacatcctcttcatcgcgacgggctggtggttcctctccagcaagcagagcatccccagctcgctgcaggcagggtacaagatggtgatgacgagccagttcaggcggttcacgtaccgggagctcaagggcgcgacggccaacttcaaggaggagctcggccgcggcggctccggcgcggtgtaccgcggcgtgctcgacggcggtaaggtggtggcggtgaagaggctggcggtcgacgtgacgatgcagggggacgaggagttctggtcggagatgacggtgctcgggcggatcaaccacatcaatcttgtcaggatctggggattctgctccgagcgcaagcacaagctgctggtgtacgagtacgtggagaaccagtcgctggaccggcacctgttcgacgcgtccgacggcagcggcggcaaggcgacgacgctggcgtggagcgatcggtacaagatcgcgctgggcacggcgaggggcctcgcctacctccaccacgagtgcctcgagtgggtcatccactgcgacgtgaagccggagaacatcctcttgacgcgagagtttgaagccaagatcgccgacttcgggctggcgaagctgtccaagcgggacggcggcgccggcgtggagctcacccacatgagagggacgtcggggtacatggcgccggagtgggcgctgaacctgccgatcaatgctaaggtggacgtgtacagcttcggcattgtgctactggagatggtggtaggaagcagggtcgcggaccagaggacggaggccggcgagccgctgcagctgccgcagatcacgcaggcgctgaggcatgtggtggacagcggcgatgtgatgtccctagtggatgccaggctgcaggggcagttcaaccctcggcaggccatggaaatggtgaggatttctctggcgtgtatggaggagaggagctgcaggccgaccatggacgacattgccaagtctctcaccgcgttcgacgacgaggacgaacaccctgcctaccactcttgatcagtactcatgaccaccaggcaaatggcacgctggattaactatagaagtacatccgtacttagttcagagttcagagttcagaatttctttttaagctcctcagagcatactaattttgtatgaagtttttgaaaagaaaaacttcattttatctctcaactcaaataaaagatagaactgcgccaaatctttttaatgctagacaaattagttctcttagtacaatgctacaatccaatatatgttattttcttgaaacaggaatccaatatatggttttggttaaattgccacatgttttgcctctctttgcctagggctgaaactccatccgttctcaaatataagggacataagcatttaaaatttatttcaaaatataaaatatttatgtacaatttgtccaatcaatcatcttaccattcaaattttcttttcactttccgaataacattttcactcaccatataatggggggtgttatagtctttatctttattattaatttatacaagaaaacctataattccttgtacgtatttaggaactgagggaatatctatctttccctcgttggtagagccaaggaagtcaagtcacagctacaatggccgatcattgagctcaatattgtggtgactacggtcatagcatattggaattttctccagggaattctattggacatggatcctctctgcagtacaacacatgcattagcagatccgatctcatatgtcagtagtagctattagaggtgtaatactacagacaattcgtactgaaatatatttgtctcgagaggacatttatttgttttgtgcaagtcgcgtaaaaagtcataaaaaataagatagatcaatatgtggcacaaacatacaaatcaaatttaacctatataagcataaaaaaaaacaaatttgaatgtgaatagtgtagttgattatttgctccatgcctctaaaaatactccccattggtacataagtataattttagctagtcgaagacatattaagtaaagaattaaaatattactatgcccttcattattatgcaaagaaaacatggatggggagtaaactagaaggatgagatatttatattggttcaatggctaaaaaggagaagtaaaagatgaagtagtattagaaagttctagtggaccactcaaaaactaaaattatttacagacaaatcttttaattaaaactacacttatttaaggatggcaggggtattttctgtatattgtttagatcacttattttgtgttgtttgttcagtttttaaaatttttaaatcatctctatatataacgaagtagataattcattaaaaaaaatgtagggccttggagcacaggaaacatctagaacaatgacgggtggttttcggtaaggaatatggataatagttggataatagccaaacagtgccatcatcgtgtgtagggagaaaaagaaacaaaggaataaaatggcaaggaatgacgtgcgggatgatctttctttccttgtttttttttttactattttgctactatctctgttttaatatgtaactagcatggtggcccgtgcagattgtacggttagcatcattatattttctcttatataatagcatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcatctttaatatttttttaattctgaattttctgaaaattgtatttctatatagagtactctatgctcttcttccaatattatttattttatatctgaatttttattatttctaattgtatttctatgtcgactctaaattcatctttcaatattctttaatttttcatttcaaattttgaatttcagttacttcgtaagttgtatttctatatagactctatgctcttcttccaatattatttatttttctttctaaatttttattatttctaattgtatttctggactctaaactcatctttcaatattctttaatttttaatttcgaatttcgaatttcatttacttcgtaaattgtatttctatatagactctatgctcttcttccaatattatttatttttctttctaaatttttattatttctaattgtatttctggactctaaactcatctttcaatattctttaatttttaatttcgaatttcagttacttctaaattgtattcctatattgactttgaactcttcttcccatgtttttcttaatttcgaattttagttatttgtaaattgtatttttatacggactataaactctacttttaattttattatgtttattccaaattttagttagttttaaatttctatatagactctacactctacttataatattccttactttttaattccgaatttctattttttttcttaattgtttttatatatggactctatactctacttctaatatttcttatttttaattccgaatttcagttattttctaattgtatttctatatgaactctatactctacttctaatattccttatttttaattccgaatttcagttatttcttaattgtatttctatatggactctagtctcctattctaatattccttattttttaattccgaattttaactatttctaaattgtatttctatatggactctagtctcctcttctaatattccttattttttaattccgaatttcagctatttctaaattgtatttctatatggactctgttttttctttttctccgattaatgtgagaatttctaggccatgagagcaaacgtggaggctcctttttatattcctttaataatataataactagctgggtggcctgcgcaattgcgcggctagcaccgatataaaattatctaatttttaatatagttttacttaaaattttgttaaatagatatctcgttgtcttaagactttgaaaaaccaaaccttatcatccctgtgtttctaattttatttttttaaaagttatgtcagttgctactcctaaattctttgtcacctgtcatttatttgctttctcgatctaccactacgtctatttgtgtcgagggaagaccccctgatcgcgggtcgcgtgacccccctttcgtgagttcggccgagggcagagactcgtctctccgaagtcgcgtgttcgtccctccgatccccgtttagatagcacacaattcgattacccaggttcaagccgctttggagcgtaataccctcctcctgcgtttgggattatcagtggatttttacaaggttctccttgctcctctccgctctccggtgggcaaggtcctccttttatagcttaaggggataccacatgcgccgcctctaccctccccctccatcggagggaggggagggggcccttctccctcttcccaccgggtttcaacctgtgccttttgctggaagctaagcatcggtcggtccttgagtggggcccagcgccgtctcccgcctgacacggggggcagccctgtcattccctcataaatgagtgaggacttgcggcagccctgcatcgaacgacgtccggatgtgacggggcgtacctaccgccactccgcggagacagaggcgacgtgggggcacgaccacccgttcaatcggccgtgaccggcaatagactggtcacagaccggtcgcatccgactgacaggggtcggtcgggcacgccgcacgtctgccctcgccgcattgaatgcggcgagggacggttggggcgctgcacatttatggccgcccagcctagactctcctctcacccttccccccgagggagggcctcgggctaaaacgacgggagagcccgagggggtgacgtcacccccgaggggatgtcgtcgacccccgaggctctccccatcaccttagtgactcacgaggtatgtgggtgggaccagctcgcagagccacgtggctggaaagggaagtagctctcctttactccacatacccccgggcccatatctccgacagtagcccccggcgccatgtcagacgcgggcttcctgggatcggtctgacatggtgcctcacgacctccctagctggggttgtgggcccggcggggagtttaaaggagtattgccgagcggccagattagcgggccagccatagcggcggttcggtcgcctctgatcgcgctaaagacgaggatgcttgggacgcgataatcgggggatcggttagaccacgcctcgattacctcgcccgctattcctacggcggttgtggtgacggttcactcagcttgcgcttatagccgttgcgcattccacctcgagtgcgccgctgataggcgcactaaaggtgggacgcggacacgacgggcgacgtggtgaacgggcgcgggaaacggagagacaactgcggacgtgggggcaattatgagggtgcgaaacgaggaggcgagcgcggatgagacaagaattaaaagggagtggaggcagggacctctcctccttcctttcgccaaccgccgactcgtcctctcgcctctcgaaccctaacactctcgccactccacgcagctttgcgcgccacgccttctgccactgcctcgccggccaccatggctcaagacaccggcgacacagtgctcccttctccccgcatctcggcagacagacaccttagcctcccccgcaaaatcatgccggacggcgccgtcgtgagggcgggggagtcacggccgcggccgcgatatccggagcggtccgtgcacctcttgtccttcgccatggcgggattgattccgcctttctcccgatttttccacgaggttctggatttctacgaaatccatgccttgcatctcgcgcccaacgccgtgatgacaatgagcatctttgcgcacctgtgcgagatgttcatcgaggtgcgaccgacgatgcggttgttccaggccttcttcgtcccgcagctgctacagggtgcggtggtggggggatgttacttccagccccgaccaggcacggcggggcagtacatcgagagccacctccgcaagaaatgggaggactggaagaaagactggttctacaccgcgctgccggatcacccacgacttcgagttcccgccggtcctcccgagagatccgccgcatggctgacggcttcggagctgggcgaggaatatgacgcggtgtgggatcgtctcaggggcctgcgaagcttgggcctcacaggagcaatggtcttcggcgactactttcgccgccgtatcgcccctctccaggaacgatcccgtggcgcgtgggagtataccggccccaacgaccccatgcgcaagcacgcgggcgagcgctgggactggggcgaggaggacgccaagatggtgattcggcgggtgctgggcctggactccgccgagcaaacactgatcccggatgggatcctccccctctgctgcgaccgcgaccgggagagcatcttggccgtgatgtcggtcgtcggcgccggcaggggccggcctggccgagggggcgccagcggtagcgccgccagcgccggtggtggcggcgcgtccgtgggcgggagccggccaagcggtccgggcggtggtggcgactcacgggcgcccggctcgggcccggagacgacccagcaagtgacccgaaggggaagcggaaggcggccaaatcttggccgccctctcccccgcgtggaaggggtgcagagcgcgcgacagaccttccaccggcgggtcacaagcgacctgccgggcccgaggccggtcggaagaagaaacggcttcggaaaatagggcaaacggagccgtgccgagggagcttcatcgagcccccgaagtggaccttcaaccatcctccccgcaggtacaaacgctggcgcccacttcggtgctcttacctagctcggcctcttgttccctccctttctttttcttttgttaacgcgatctgggttcccttgtagcgatattccttctcaggggacctcggggtcggacccctcgcggaggacgaaatccgcacaaccggagcggtccgggcctggccaatccaaggccacggggtcttcgcaacctcgcggtggggtccacaggacacgtaccgggcccgaggttgaggtcgaggctgggggcggtcctgagcccgaggccgaggccgaatccacccgaggactgggagcgggggacgaaaagaacagccgctcccccttgcgtttggggcaccctcggggctggcctcgcagaaggggggccgagagcaggccccgtctcgcggggggtccagcagcactccgtcgtcccgggggcgaaccgcgggcttttcttccccatccccggcgagcatggagccacttctgcaggtgctcgccgccgccgactccactgtccgggaggggctcaacacccaagttcaagccctggcggaagagcggacggccctggatgccgaatgggctcagcttgtggcggaccgcgcgcgagtcgacgaggggcaccgtgccgtggaggacatggtgagggtggggcgcaaaaaacaccaagcccacctagctaaaatccaggcgcgcgaggaggtgctggactccgtcatgcgggaggcggaggaggagcggcaggcggcgctgatcgcctcgagcgccctggacgaagcgctgggcgatattcgcctttagtacgaggcccatgccgaggacctggcggagagggtcaggaatgcgcgtggcaccctcgacgcagccgctgcccacgagcggcgagcagcggaggccgacacctcgttgcaggcccggactgcggcactcgaggctgaacgcaaggccttggacgatcgtgcccgctccgtgcaggagtttgaagccacgatccgtcggcggattgaggtccttgatcggagccagcgcgaacaaaacgcgcgcggccaggaacaggcgcagcgggcccaggagctggaggagcaagcacgcctgctggatcagcgggagtccaccttggccgcccatgagagaacggcggcggaaacggaggcctcccttcaccttcgtgaagaggccgcggctgagcacgaccggatcactctcgccgcggaagcttccgcgggccgccgcgcggaagagctacggctgcgggaggaggcgtgccgggaacgggacgccgcactcgccgagcgcgaagccgaggtaaaccgccgcgaggtagccttgcgccggctgggcgagcagcttgcgaagcgcgaggaggctgctgctgggcgcgaggcccggcatctggagagcgcttgcgctgagcgcgcggcgatagcggcgagggcttccgaactggaggcccgggagaagcacctggcagccggcgggccgcccggcggcgcggggttggcgagcgagctcgctaaggctcagagtacccttgccgacctggggcgcctggtgcaagatcaggctggggagatcgcggcccttcgcctcaccaacgaactcgggcccgggcagctctccgacgccgtcgctcggctggagcgcgcggcgcgccgagtcggcgttcccatgcgccagcatagccaacttccgcccacacaaccagcgctcgcgttccggttggacgggctagcggcgggcctggagagactggaagaggaggtcggcgagaccataaagtcctcgtcagcttctttggcacgggccgcggtggagctggttcttgcaagccaccaagcgcgcgaccccgacttcatgccgtggtgcgcacttgaagattttcccccaggaactgaagcgagggcccgggagcaagttcgggaggcagccgacgcgattttctcgggcttcgagggatcggccccccgcttcacctccgggctcgcctcggacgaagaaagcgggagcgggggtgacgatagcgacgaagactaggacgacatcgtcagcggcgccggcctcggagggccgggcaccccgtgactatccgcgccttcaattccctcttgttgtgcgcccgtagcgggcacctcttgtatttaggccgtcgtgccatcctgccttgttttgcaattgaaacttgcttagctccttttcccctttcgcttcttctattcattgctccttccactgaatgtctttgaaacagagagaacaacaaacaaaaaacaagggaaaaaggggataatcagtccgtgatcgagacgccgctttgaccccaccccccctcgggcttgttctagcgagatggtgaatccgcgtttggtccagggcacctaagtggtgatggacaaacccaccgctccgagggagccgcctagcgggactggccagaccgaggccgcgtcgaccgggggtcggggacggccgtgtgtaggcccttccgatcctccggggttcggcgcaacccagggcacggcccgcgttcgtgctccctttcggggtttctaggccgcctcacagcacttaggattcagagcaaacgcagattaccccttaaaccaggacaagccagaggaagggaaaaaagaaacggtctttgggtaaaagtacacaagaattcattgcttgtaagaggaaaaaaggatacacagtggtagcccccggccaggcgcgcacaaaccgaggggttgtgcgggggctggcccgagctccaagaaagcaaaaaagtctcgatattatggatagaagcgatggaggtgttcgatattccaggggttaggcaattctgtgccgtcctccgtggttaactgtcacgcccagaaatttagcccaaatttccagactattttgtgtattaaatccctgtccaggaccagccagggtacacaaaacgacaaataatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaaaacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccattcagttgcattttagttggataattacgaccatgaagcatggccagatgtctcgagcacgcagctcattctgatactaaaaggtctaatactgtaattatcccatcaactgagctagtagtaattaagcatggctaagcatatagttctagctaggtcacataagtaacctgagctagtcgattcattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcaaaacaatcttccgaactcttttccttgcgaccgcagacttccgaaacaacggattctacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaaggttttgagccattttaatgaatttctagaattattcacgaattattgcgcaattattatttattttctcaaaggaaaaggctgtgctgacgtcatcaaaggggaggggcggcgccggcaagcgggccccaccggtcagcggcacaaaggcgccggtccaccgtggaccgggaccaccgaggcggtccaccgccggtccacgggatccgacggcccggatcggcccaaagccgatcggacggccacgaggcggcgcggctggggcacgggcacggcatgaagccggctcggccgagacatggcgcggcggcggcaagggggaggcggcaagggggcaagggggaggcggcaaccggctgcagcagccggcgacgtggaacggcggcgggtggccggaggacagcggcgcgcacggggacggcgacgcaccccaagaggcggcggtcggcaagaaaggggaccggaaaaaaaggaagggaggagagatcctcaccggaagcggcggccgacgcggaggaagaggacggcgacgacgattgcccaatggcggcttgcgaggacggagggcggacggggtcgcccttgaccttccgaaggagaagagggagttagggagaggaggaccgatgcggggtgactggaaacgaagaccgatggcgatgacaagaggtagagctcaccggcgaccgaggaaggaggagctccggcggatttccggcgaagaggggtggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggtggtgctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcggggaggagaaatcgtggccggacgagcggcaacggccggcggagtggggaggtgaagtggagctcgtggggaggtcaaaccggcgctgtttcttgcggggtgagtgggggaaaaggtggaggacgtggagggggttgtgtccacgtggttggatgtgagctcgggtgcgggagggcgccggattttgcggcgacgtggacggcaatggcggttggggtcggccggcgagaggtaggaggaggagctgacgggtgggaccgctggtcccacctgtcggcgaagggagagaaggagggacgcaaaatagacttttgcgagcgggccaagagagaggggagaaggcgcgcgggccgcgggagaggaaagaagacttgggccgaaaatggcccaaagagaggaagggggaaatttatttgttttctttttatttaaattagtttaatgaactttgtgactttaaaactatttctcgagctccgaaaattcacggaaaattccggagagtacattagggcacaaagaatattacaaaatattcccggccaatgatttttaagggaaaattttaattctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcaacctttctgttcctttgttttgccaaaactggaccgactggttatgcttgaactgacctaggccagaactgtggatgctcctgaaacttacttatcttggactgaactgttgagattggcaattttggtaacctgagaattcaccacgctggctataagaggatgaaaatggaatctggcatttgtaaatcatttaccctatgtccgcttggactggtcccaactcaaatgacaagtaattccaggaaaacctgcttgacctgtctttcgtctgtactacaactgtcctcgctgttgcttctctaagctgaactgttgacatgcttcacaggtgtaccttagaatcgaacctgtcgacctgagattggggtgactctgctaatggttcgcaactgactcctttaattacgaaccaatttgccgcaccgggttgaacctacaactgaaacggcaacgaggttagccaaaactcatctgtgagacctaccccccttacagtgggtagtcttactttcgcctgactgagaacctttgaactgttgtccttgaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaggtgactctcatttagctcatggacacattgactcttgactaactttcccataagttctaactactggcatgactgtcctgcttctagcttgacttcggtgtcgagttgcatagttgattcctcaaaactgaactgaccgactctgcattggaactgacacaacttgaggagttggggtgtcactaacaaagctcttgatgtgatgacgctgacgccttactgtggaacaaccctctgagaggtgccctgtcgtacatcttccatggatagttggacactttgcaaaaactgctcttgaaaaccataaccactgtaggtagcatttgttgcctctgggattggtggtgacttagctgtgctggtctgctgaagacttggtggcgtactgtctgaggttgcaggtgcttcctctttgaaaacaaactggctttggctctgatcctaattccagcttgcatctaggcttgtgcatgttgttggagacactgttgttgcatctgctgcatcggactctgcggttgctacatcaatatctggcacatccatcttccaatcttggctaaccagagcaaggtgctctgactcagctggtagcttgttgtcttgaactgatccactgactctgactgcaacacactactgttggagttatttccgctacatttgaccaggtatcgaacctgcatctcccacatcgaatacacccatcttctgatcttggacaccaaaagttgatcatgagcagggttcatctggcattggggcaccttgcagctttcaactaaaccattgatctgtggctttaatacaccgtcgttgctcttctctctgacactgaccatctgccgccagaacggaagagaggtggaagagaggggttgctaaagataaggtactaaaccacttgcctattgatctgttgtgagtagatttttatggtttaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggcttgacttgacttgactcccgaacagacacaaagctgacggtttatcctccacgttttaacaactataagaattggagggacagggaggagaattttgaaaaactgtttcgcaaagaaaagccgaagggcgaggggagacatttttcaaatagggttttcagaaagcttgtccttagggtttgaccgtttggctcaacctacagtcaacctggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccatactcagcaagccacaccaacgatgcagacgtgcaaggggaacacaaggacggtttgtg

SEQ ID NO: 4275 - DNA, 12841 bp, Oryza sativa
gaagggccccgtattttgcgacaacgtggccgcaatggcggttgggtcggcccgcgataggtagaagaaggagctgacgggtgggcccgctggtcccacctgtcggcaaaaggaaaaaaagaaggaacgcaaaaacagacttttgcgagcgggccaagaaaagggaaaaaggcgcgcggcccccgggaaagaaaagaagacttgggccgaaaatggcccaaagagaggaagggggaaatttatttgttttctttttatttaaattagtttaatgaactttgtgactctaaaactatttctcgagctccgaaaattcacggaaaattccggagagtacattagggcacaaagaatattacaaaatattcccggccaatgatttttaagggaaaattttaattctcccattatttcacttgattaaattgatttatcttttatttaatttctagaaaatgtattattaatgatttttaatcccgaacgaaaatcggggcgttacattaaccgaacggagcctggccggggcacgccgatcactttgtatgggccttcccacattggcgaaagcttgctcagccctaggcgcgactgaacgcggcgtaggacgaggtcgccaatttgcagtgatcgggcccggacgttacgctgatggtagcgtcgcaggctctgctggtagcgggcggcacgcaaggccgctcgccttctccgttcctcaagataatcgagatcatcgcggcgaaggtcatcctggttggtctcgctgtacagtgcgacgcgaggcgatcccagggagagctcggagggtaggaccgcttcggcgccgtacaccagaaaaaacggcgtttccccggtggcgcggcttggggtggtccgatttgcccacaacacggcgggcaactcctcgagccatgaatccccgtgcctcttcaagacgttgtatgtcttggtttttaggcctttgaggatttcggcattggctcgctcgacttggccgttgctcttggggtgggcgggcgaggcaaagcataacttgatgcccatgttgtcacagtaatcgccgaacagctcactggtgaactgggtgccgttatctgtgataatgcggttgggcactccgaaccgagaggtgatgcccctgatgaatttgagggcagaatgcttgtcgatcttgacgacagggtaagcctcgggccacttggtgaacttgtcgatggcgacgtacaggtgctgatacccgcctcgagccgctttgaaaggtccaaggatgtctagcccccagaccgcaaaaggccaagagagggggatgacctgcaaggcttgggccggctggtggttctgcttggcgtggaactggcacgctttacaccgccggacccattcttgggcatcttgtaatgcagtcggccaataaaagccttgacggaaggctttcccgactaaagttcgtgaggccggatgggccccgcactcgccctgatgggtgtcggctatgagctcgatgccctgctctcgagaaacacacttcaagagtatcccgttggcggcacgccggtagagggtcccttctacgaggacgtaccgcttagagatgcgcgcaagcttttcagcttctgcgcggtcctcaggatgagtattgccgtcgagatacgcccggatgtcagtcatccatgcgacttggcgaggggggtcggggtcgaccccctcgggctccggggggcgcggaggagggtcggggtcgaccccctcgggctccggggggcgcgggtcggcaggagtcggggcggagggtatgtcgttggagcccctcgaggggttcggtcgtgctgatggttggacaagcctttcttcaaaggtccccgggggaagtggggctcgcgccgacgcaacacgcgacagctcatcagcgagcatgttgtcgcgccggggcacgtgccggagctcgattccgtcgaagtggcgttccatgcgccgtacttcgcggacatatgcatccatttgagggtcggtgcattgatactctttggatacttgatttacgaccagctgggagtcacctaggaccaggagacggcggatgaccattccggctaccgccctcaaccctgcgaggagcccttcgtattctgccatgttgttcgtggctcggaagtcgagccgaacgacgtatttgaggacgtctccgcttggcgaggttagtgtgactccagcacccgcgccttgaagggtgagggagccgtcgaaatgcataatccagtgtccgccacgaatgtcagcgtttgggtcctctttctcttcgggggaggaagggggttcggacggaacatggtcgtccactggggcccattccgcgatgaagtcagccaggacttgacttttgatcgcgtgccgcggttcgaagtgcaggtcgaactcagctagctcgatggcccattttaccacccgtccggtgccctctcggttgtgcaagatttggccgagagggtacgatgttaccacggaaacccgatgtgcttggaagtaatggcgcaacttcctcgaggccatcaatacggcgtaaagcattttctgggcctgcgggtaccgggttttcgcatcccgaagcgcctcgctgacaaagtagacgggccgctgcaccgttcggcggggccggttcgtgttgttaggggcggatgacccggggcgcgcctgctcgggggccccaggggattccggattatcttgggatcacagggctcggggcctcctgccaaagcctcgccttctcctccgggggcctcggggtcctcccgggggctgggggctttgggggacgaggggccatcacgagccggagggacctcccgctcggtctcctcgcgttcaactactagggcggcactcaccacgtggggggtcgtagccaagtagagtagcaatggctcctccggccccggggccaccaggatagggggagaagtgaggtaagctttcagctgattgagggcttgctcagcttcctccgtccatacaaacggcccggggcgcttgaggagcttgaataggggcagcactctctcgtccagtcttgatataaatcgacccagggcggccatgcatccagcgacacattgcacatccctgagcttgttggggggcgcatcctctctatcgcgcgtattttctcgggatttgcttctatgcctcgggaagagactagaaaaccgagaagcttgcccgccggaacgccgaacacacacttatcggggttcagctttacgcgcgtggacctaagactatcgaaagtctcggccaggtcctgcagcaatgtgtcccggcggcgcgtttttaccactaagtcatcgacatacgcctctacattgcgccctatctgattacttaaagtaattcgagtcatgcgctgaaaggtaggaccggcattttttaacccaaaaggcatggttgtataacaaaaggtgcctacaggagtaatgaaggcagttttttcttcatcttccctagccatgccaatctgatggtacccagagtatgcatctagaaagcacaaaaggtcgcaccccgtagtggagtcgactatctgatctatacgtggtagagggaagggatctttagggcatgccttattgaggtctgtgtagtcgatgcacatccgcagcttgccgttggccttcgggacgaccaccgggttcgccagccactccggatgaatcacctagcggatgaaatcagcctccaggagccgcgccacctcctccacctcctccctgatgaaggcttgtcgctccggggcttgacgccgcactttttgccggacaggtcgcgcatccggtcgcacggcgaggcggtgctcaatcacctccctggggaccctgggcatatccgacggcttccatgcgaaaacgtcagaattcgcccgcaggaaggagacgagcgcgccttcctatttggcgtccaaggttccgccaatcttagcggttttggacggatcgtcgccaaggggaatctccttgacgggaacctcgtcggccaaggtgaggcgcttcttgggggcgcgggacgcgggggcctccggggcctgcggccccgtggccatcgccaagttgtccgcgcgctgttctgcacaggcgagggcgactttgacatcaccaaagatggtgatgggaccggcaggacctggcatcttcatctggaggtaggcgtaatgggtggcggccatgaacttcaccaacgcgggtctgcccaggaccgcgttgtagggcagattgagatccgccacatcgaagtcgatccgctcggtgcagaaattggtggagtcgccgaaggttactgggagctcgacgtgaccaagcggccacgtgtgtcccagagtaacgccaatgattggcagcgacggttggagcttcatccccggggccttgagcgcgtcaaaggcagccggggagatgatgttcagactggccccaccgtccaccagcacacgcttcatcttgacgttgtggatagtcggggagaccaccagggccaacttccctccccgagcgagtaccgtcggatggtcgctctggtcgaaggtgagctttacctccgactagcgcgccttccggatcgcctcgtgggtgggaacagcggccagaagttcccgcctcatggccttgaaccctcgacgagaaatgcgagcgcaagcccccccatcgaatgtggcgacggtcccttggggtatctggaaatccagatcctcactacctccgccatcgtcagcaggggccttgttcttggcctcctctcgctggtcactggttgaggtcacgggagccttgccctcccgtcgaccctgccgcttttcctcatcggcctttcggaaccgctcggccaagttcttgaccgagcggcagtcggcgagactgtggcggtaagtgttgtgcaccgaacaccacttgtccgccgaccggccttcgccggagggggcggtggagctcggcttatcgccggtaatctttcctttgcgcggggcccgcgtgggcccgtctgccgcaaggacatggccctcgtcgtcggaacgggccggtttcctcttgcctctcctatctcgccgcttagagcggggggcagactcgggggcagccgcagccgccgcaccggtgccaggagagttccaggcccacgcctcctccttccgggccaccttgtccgccagctcgaagagctcggcggtagtcttgggctccttggaggcgatcttctccagcatgcggttatgccgcacgccgttccggaatgcatacactactgcgtgggctggaatgcacggtatggtgtggcggacctggcagaagcgctgtatatacgaacggagggactcgtcgtccttccgccgcacagcatgcaggtccgcttcttcccccgggcggggatatgtcccctggaagttcgtgacgaactgctggcacagatcctcccaagagtgaatggagtcggggggctgggtcatcaaccagccacgcgcctgacccttaagggccatgggaaagtagttcgccataacccggtcgtcaccccctgccgccacgatgatcgtgttgtagatttggaggaactcggaggggttgatgctgccatcatacttctccgtgaggttggggcgaaacttcgggggccaccggacattccggagactcgcaacgaaagccctacaacctgcccccccaggggtgagcgtgaggggagggccgcctcgcgaagaagagcgtggcactccagatgaggaggcgccttcccccatgcgggtagcccggcgctcgtcccggcgtcgctcgatgttgacccgagcgtcctgcgccccgtagaggtcatcgtgacgcctccgccttcccgagacctccgatgtcgttggagccgtggatcgcctcgaggttgtggccgatcgacgggcccttctcctcgccgacgaggaaagggtagccggggcacttgatgtacctgtggcggtggattggccacccgtggccaactgccgctgggcagcggtgaccaagttggccacgtcgtccagccagcgccgtacgggggtctccggctccgggttcaccgggggatgccgcagaagggcgcccaccgcctgaagcgcgccttggggcgaaccaccgtctccgtagtcgagacgatgacgtgctccgacgcgtcgcgacctccctccgcctgggggcgggagagggccgtaccacttgaacgggttggatcctccctccgcgaaggctcgcggcggggaggacttcgagagccacggcgatggtgatgagggtcacggttttcgcccgaatccccactcccagacggggtgggggtaaacgccaccgcttcccccgcttccaggacctcgaccatggcggtctagggcctggtccgacttggagcggaaggaagcgacttcttctcaaacgcgcaactgccccctacctggcgcgccagctgtcgagggaagaccccccgatcgcgggaagtcgcgtgacccccctttcgtgagttcggccgagggcagagactcgtctctccgaagtcgcgtgttcgtccctccgatccccgtttagatagcacacaattcgattacccaggttcaggccgctctggagcgtaataccctcctcctgcgtttgggattatcagtggacttttacaaggttctccttgctcctctccgctctccggtgggcaaggtcctccttttatagcttaaggggataccacatgcaccgcctctaccctccccctccatcggagggaggggagggggcccttctccctcttcccaccgggtttcaacccgtgccttttgctggaagctaagcatcggtcggtccttgagtggggcccagcgccgtctcccgcctgacacggggggcagccctgtcattccctcataaatgagtgaggacttgcggcagccctatatcgaacgacgtccggatgtgacggggcgtacctaccgccactccgcggagacagaggcgacgtgggggcacgaccatccattcaatcggccgtgaccggcaatagactggtcacagaccggtcgtatccgactgacaggggtcggtcgggcacgccgcacgtctgccctcgccgcattgaacgcagcgagggacggttggggcgctgcacatttatggccgcccagcctagactcccctctcacccttccccccgagggagggcctcgggctaaaacgacgggagagcccgagggggtgacgtcacccccgaggggatgtcgtcgacccccgaggctctccccatcaccttagtgactcacgaggtatgtgggtgggaccagctcgcagagccacgtggctggaaagggaagtagctctcctttactccacatacccccgggcccatatctccgacaatttggtctcactaaaaacctctaaaaattagacttatagtttttagagtttattgtctcgtttgggttttgtttttataattttcagaagtctcgtcaaatgctgccaccatactactctacggtccatccactgcctcttctctttattttcattgggattttaaaaatcaaacgtaattaccatttgggttctttttttactttctagaagttccaccaaactgtcagcacctttaccattgtacacatgtactgctctcccgctgcctccctctttattgtctttgagattttaaaattcgaacatgattatcattgggtttttttttttactttttagaagtcccgccaaccgttgtaaccatgctactttatgacccgtccatcgtccctccttttaatcatcattgggattctatttggggtttgtttatagtttttagatattccatcaaccgccaccactctaatcctttacatgcatgttgcttctcctatatttgttgtcatttgtcatctttttataatttttagaagtcatatcaaaccctgtcaccgtacttctcttcggcctatccactgcctcttctctttattgtcattgggattttaaaaatcgaacataattattatttggattcatattttactttctataagtcccgccaactgccatgaccggctgcttaacggcccatccgtcgtccctccttttaatcatcattgggattctatttgaggttttgttaattgtttttagatgtcctgtcaaccgccaccgttctacttctttataaacttgttgcttctccccctctttattgttgtttgtcatcatttgtgttctagatggagttttttttagaagtccatatttttcattccgatatttttatttacaaattatattcctacttaaactcttataattatttttctattttcagaatttatttttttgttatttcaaattttagttaatcttgtgatatgttctagatggtctcttatttcaatagtttttatttttttatgacaaatttaagttatttataaattttattcctaggtgaactattatttttcctttttctatttttggaatttattttaatttttatttagaattttggttaatatcgtattatgtcttatatgaattattttttaatgttttttattttcaattttatagttgtttcatcctactcaaactatcttttttatttctctaatttcggattttattttatttttattccgaattttaattaatctcgtattggattcttatatggactcttcttttaatattctttatttttaattccgaattccaattatttctagattatattcctacatagactcttctttttccaatttcagattttattttatttttattccgaattttaattaatctcgtattggattcttatacgaactcttctttcaatattgcttatttataattccgaatttcagctatttttaaattatatttctatttggactcttcttttctttttcttcgattaatgtgggaatttctagccccacaacgaacgtgatgccttcttttcgagctgttttaataatataatagatagatagatagatagatagattagtaatttagaataagattagaagtattttagaattatgaatatggacatatatctatatccagatttaatatattcaaatttatagatctacggtggatgtaaagttaccgcatacttccttcgtcccaaaaaaacttaacctagtactcctatctagatttgttgtactagattatatcccatcgaagtagtaggttgagtttttttttttggacggagggagtattaccatgtagaacgccatcacttcgaatttcgttatgaaaaagctagttagtgctgatagatgattcaagaggtgaactagacatccttcaaaccgccttggcccttgagcgactctgcgactgaaccacttcaccactccccactccccacttcaccagcgaaccagccgcgccgagtgccgaactgccgctgcgctcgccttcgctccgcctcaaccacgttgcctcgggcctcttgccaccagcggagccatcagatctgcagctctctccgtgtccccggccgcgtccggcgtgctctctgcgcaggtgaatgttatccccccccccccccctccctcctccgcccttgtccctgccccgtgcagacctctattgtctttgcggaattctatcgaacaccttggcggcaaccacgagaatggggaatcggggatgactcggatgattgaggacatatcgcgggcccctccctcttgatggctcggttatgttattactagtctcgtgatggtattagaaaactgacatttttgccgtcaattggtaccccacaggtgatgtcgcagcagtagatagatgaggcgatgagccatccctagaactgaatgcggctgtgcatagcggagagcgtatcctttatggctttgtgtatgtgtatattttttaaggaaagtaagcttactgcttacgagatcacatggtactgtggtagtgtaaatcatgcgccaaaggatcaagagaaatgtgcactaaattgatattgtgtatatcatatccttacttgggcccttctgaataactgaacgcagcttgccatcaaataaaggtactggtatcgtacttctttctaaatgaacctacttagtttcatgcaagagttcatacagacactagaatattcaacagattcattacaattaagaacaagttgatatattattgccctaagaagaattcataacatgctcgaactgatcttttctctatggtataataattcttcttcttgcaaaataaaattagtgttgttattggtcaccattagtaggttgtctgattatcgcggtggttgtattctaggagaacttccagtatttaaatcattattagtgagctggttctttcaaggaaagagttcctttctggtccttacaaattttccaacgataggtgtagcagtctagcacctttcatcattatcttaattcacttgtttaggatcaaaatggccatattatatagtattaactactcgtaggtgaggcaccctcaaatcctatttgccattttaatctctgatactcagtgccttgagggaatttttagcaaacattctgcggactgtgctgattatcattgatttgtattatgtttacataactaccacacatgatcatggatgactaggtaagttacaggatgtcatactcaagtcaactatttattcttggattctatattctctttaagctttgtacattatctgggcaaatcagctagcagcctagcatattaattcaaccttactattccagggaacaacaaatacttaaattcgtaaatttatttgtggtcatatcgtgagacactactcgttgtctaaagcatgatggaagggtctttcctggttagatctctaacgggtgaaaaaatgtgaagaaatagttgttggatgctgttgctgtatttcccaacagatgactacaccagcaacacaactacaaattattcttagctacgtggaaatatatacgtggagaatgacacgtcagtatgaggagattctcaggagactcaccagaagtgcaaagttaagaactttaaacattggtacagcgttccactgatccaacacacttatttttctattggatgtacatttgaataaacaaacctgccactatactgaaatgaatttatagaagtatctgacttattttctctaacaagaactgtttacttcaagtattgtgcatgctaaactgaataactagtttttgatccttcaaatcaaaacactattgctttgcaggtcaccatgagtaggctgggtgattgtcttcgtcatcacatgccaggaaggcttttgcaatttcatccattgtaggcctgctgtttctttcttcaagacaagatatagcaacttccaccattacctttgcttgctcagaattgaaatgcccattcagtctagtatcaattacatccttgacgtccccagtagccagaatatgtttcatgacctgcacaaaatctctgagctccacctccctcccatccacttttatcccgcttgatatcctgcttccagttacaatctcaagaagaacaacaccataactgtagacatcaacctttgcattgattggtgagttcaacgcccattctggtgccatgtagcccattgtacccctcatatgcgtgaagtttaaactggtactgtctctctttgagagtttggccagtccaaagtctgctatcttcacttcaaaatctctggtcagaagtatgttctctggttttacatcacaatggacaacccactctaggcactcgtgatggagataggccaaacctctagctgtacccaacgctattttgaaccgttggctccatgcaagcaatcgctcagcacttacatcaccaaataaatacttgtccagtgattcattgtccacatactcatacaccagtagtttttgttgaccctcggagcaaaaaccccacatcctaactaagttcatgtgattgatccttccaataatactcatttctgcccagaattcctcctcaccatgtgaaatattcattagcctcttcacggctatcactctcttatcttcaagtactcctctgtaaacaataccagaggctcctcttccaatctcttccttgaactttccagttgcctcccttaattctcggtacgtgaacatcctgaattggcttgttaccatcctgtagcctgcctccattgacatgggtatgttgtgcttgctgtaaagaaaccaccagcttgtacctgtgaagattagcactagagctcccaatactgctgcaaacacataataggttgcataatttttatttgcatcattcattccatacatacttgaagatcctagtacaatctctttggttgggttgcatgagagatcggactgtttggaaaccatattcttgggtagtttgatgtagttatcacccggaaaatttgtggagctgtagccattgaagagtacatatttgatgtaacaagttccagaccctgtcttatacgtgactgctgagcaggagcagatgtccaagcaagtctttttacattctttaagtgagatggattggttgatgattagatcgaagccataaaagtcggtttgagcgagcttgaagaactcatattcttctattttgctgcagtttttgctgaatagtggacgacaacctctgctccagtttgttggatctctcatctcatatccagggggacaagaacacttgaagcttggcaagaactcacatataccattctcgccacacagtccatgcacatcacacaattttgctatagc

SEQ ID NO: 4276 - DNA, 21745 bp, Oryza sativa
  unsure (1)..(21745): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctacgttgagccacgctttcgaccgccagcacccggcctgtcgttgcttgtaccgaacgggagctagctcttcagatcgatcgtggataacggtagctatagctgccgtttctctgctcagatcgaaacgaaaaaggaagcagaatgtgtaggttttcttcggttgtcaaatgccgatgtgtgcagacgtacagtacgtggtcgtcatcatttgatctggccgtggagtttgtgtgccattgcaattgcaattgggtgtggctaatgggcgatcgatctgagcgaaacccatgccccctgtacacacctctcctcccctccccttcttctctttctactacactaaaaatttttaaaaaataaaaaaacaaagttgaaaaaatttatgtatagaaatacttatataaaaaaattagaattcaaatttaaatttgaaacggatgtgtaaacttttgacttataaattttgggtctataaactaatatttgaattcaaattcaaatttgaatcgggtatgtaaacttttgacttataaaatttgggtctataaattttaggtgtataaactttagatgcatagaaatactatatatataaaatatttgaattcaaattcaaatttgaatcgtttataattcaaattcaaatttgaatcgggtatataaacttttgacttataaactttgggtctataaattttaggtgtataaactttagatgtatagaaatactataaataaaatatttgaattcaaattcaaatttgaattgggtatcaaattcaaatttgaatcgggtatataaacttttgacttataaactttggatttataaactttagatgtatagaaacactatatataaaaaatatttgaattcaaattcaaatttgaatcgtatataaacttttgatttataaactttaggtctgtaaactttagatgtgtaaacttcaggtgtataaactttaggtgtataaatttactaaaataggaaagtaatatggtgtaaaaaaaaaacacgtggaggagggggggggggaaaccgatcgctcctggcgatcaatcgccaactggactctaggagtttcgattgcaattggtcttgcaggaagacgagacatctctcgtttctgaatgtggaattttttttatttttaattttttttattaaaagttttacaaaaataattttccattttgaaaattgacggaagtagtcgcctaccgccctctgggaaggcgatttttaaaaatcgccctcccagagggcggccaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccctttgccggcctccgcgagggcgattttgtactgtgcgggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaaaattaaaatctccaagtctggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctatataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcaacgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaatactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtatgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtataaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcccgcatctggtcgaaggtcaccatctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcaaggtgcgtgggatacgcgtccgtgacagcggcaacgtgcggctctggggcgtctggagtgaaggtcacacgcgcacgagtgcgaggaaggtaccagcgaaggtagtcacggtagttctccaccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcagctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacatggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggacactgcgcgctgcgaccaaccccgtagggtgcgctatccaccattggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtgttggtcggtcctaggtgtggaaggcgcatcacctgctcgaagcgcgcagtgatatcctccttccacccaaaaacaccgtccacgggaccaactgctgctcccgccagcggtagcccgagcaagtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtgtagtttggcgtccaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatataccacaatcaccggcagcagcaagaacgtgtgagcaaggaaggtgacgaagcttcggcttcatacaactgcaggtacatccaccatccgccttcaagacacattcctacacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacagaccaattttcttgtatcgatccctaaagtacgctttcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatggaaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagacaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatggcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgccccccctcgccgcccatttgcaggcggcccccccgcacagtataaaatcgccctaacggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactacttccgtcaattttcaaaatggaaaattatttttgtaaaacttttaataaaaaaaattataaataaaaaaaattctctgaatgtgatgattggtcaaagactcaagacgagaccttatcggctctggaccgaaatgcagttagaactactaattgggctgtgttcttaaaatgggccgccacaccaacccgtcagctactaaaggcccacagaaggcccgaacaagcctctcatttgcttaaactgctcagactgggccaaaagtgggttgctaattctagtgcatggcacgatcacatctgatccccgaaaacaaaatatttacggcattttagttcgatttttatatacagtaaatttgataaacatagctacattataattataatataactttcacaaaccattagatttgctttaagattcgtacaagaagaaaagaaaaaaattacactgcacaaacgatgtgaaggaattcagtctcgagatgtctccatcgtgagaacaatgcgttaccacaggttttttaaagttagatataagttatataagttatagttatacgacagttactacttactacaaatataatcacactacgattcaattatatttacctgacaaacatgttacggttttagatctgtttccgttggaaacttgaaccttcatggacactcacaaccagaaatgcccaattgcccatcccctgtcttgactcctggccatctttctccttgctgattttgtattctctaccgttttaatgccccattttgcaacgcatcgttatttagaagatttcagtgataatttcagttttcatttcttaattttggaatggaactaaggaaggaacaaactaatcctcagctcaacttccaaacacccggtgataacccagcttattgtactccagttctcagaccaaacgtactgtacgaatttggacaagaaaaaggaaaagtttagaggtagaaactgcacgaggcccacttgtcagtgacacaaccaattggtgtctgacgtcaattggaggccccttctcgttcgcacccctctccttggaaggagacgcgcccgctgcgactgcgagagcgaacccccaaaaccctcgccacctctgcggggcgccgcgcgatcgcgagctctctcccattcccttccctccctccctctctctctcgcgctccaccctaatgccccccacgaggcccaagcggcggcgcggcggctccgcgcgatcccgcggccggaagaagcagaagcgcctcgacgccatccacgatgtcgcgccggtatccgcccctcccgccggagccgccgtcgtcgtcggcggcggcggcgagagcgaggattccgacgcggagggcccccgacggagcacgcgggtgcgccgcgcgccggccctgctcgacacctcgccgctcccctccccgcgccgtaagagggcgcgcggcggcggcggcggcggggtggccgggtcgagcggcgggagctcgcggaggagaagcagaggtagggcgaggggcgaggcgggggttgcccgcgagattggcgaggaagaggaggaggaggaagacgacgaggcggggaacgtggtgtggcgctctcggctgcgggatagggtcaaggggaaggctaagctggataagcgagttaggagcctctggttcgacgaggactacgaggtggagctgaaggaggaggaggaggtggtggtggaggaggaggaggaggatgaggaggagggggatgaggaggaggaggaggagcaggttaggacattggtggtggaccttcgggagggagctgaggaagagacaatgggcgagggaagtgggagcttgccaatgcgagggagggaagtgatggatagggaaatcaatctaaccatcgatttgaatgtggaagaacatgaggctgtcgagggtgtcaatgtggtggaagaggaagatggggaaaaaggaggcgaagcggatgaggagaaaggagatgcgattggtcctggaaatgatctacacgaaggcaagcatgaggaggtaggggacgaggagggtttacatgagaaggagagaactgaagagctgggatcagcagtactagaagggcgaaatggtgatgagctaccttgcaatgagaataatgctgaggatggcactggcagttcacatgaacacgagcatcttcttgtgcaaaatgagcagactgtggaagagagcaacctttgtgttgagcagcaaatggaactggatggttctagtcctagtgagcaattgaaagaggttcagcaggatgtacagacaggtggtgcctcaaatgtagtactgcccgaggaggccccaaaggaaggagtccgcaaatttccagtttcggaagaaaaacagggtaccatggagattaaagaagggagacgttgtgggctctgtggtggagggactgatggaagaccacctaaggttgcattacatgatacagttgacagtgataatgaagcctatgagggggctttgccttcagaggatccaaactatgatatgtgggacgggttcggtgatgatcctgggtggcttggaaggttattgggtccaatacatgatcagtttggcattgctcgtgtctgggttcatcagaattgtgcagtttggagtcctgaggtatgccccacattattttataaaattctcaccctcatactattcctgtaccttctgccttatactgggtcattgtctccttgtgattttcatgaccatattctctcaaaacaatatgcccccaatacatgttttgggattatcattggttactccggactttggaagcaagcaaaacaagctaaatgtgttgcaagcaaaacaaactaaatgcttcaacatagtgcatgctttgaccttgtggtttggatgtaatggaatggagttatgaaaaacttgcttttgtcacattttcaggtttactttgctggtttgggctgcctaaaaaatgtaagagcagcactttgccgtggaaggcttttgaagtgcagccgatgtggcagacctggtgcaactattgggtgtcgagttgatcgatgtccgaaaacctaccatttggtaattggtttttacttaaaccacattttaccattctagttttgccctttagcctttaatatgcattaaccttttcgatttgtagccttgtagtcgagcagaagcctgtatatttgatcaccggatgtttcttatagcctgcaatgatcatcgacattacttccaacctcaaggagataaatatgttgaactgctcagaaaaatgaagataaaaaagatgaaggcagatatcagaaaggtgtcacatgatgcatggagaaaggacatagaggccgaggaaaaatggttagagaactgtggagaagatgaggaattcttgaaacgtgaggggaagaggctaaacagagatctttcgagaattgcacctgtttacataggaggcacttctgaaaatgaaaaggcgtactgtggctgggagtctgttgctgggctcagtaacgttattcagagcatgaaggaagtggtgatactgcctcttctgtatcctgagtttttcagttctttaggtcttacacctccaagaggtgttctgctgcatggccatcctggtactggtaaaacactcgtagtgcgtgcactaataggggcatgctctcaggggaacagaaggattgcttattttgctcgaaaaggtgctgattgtttgggaaagtatgttggcgatgctgagagacaactaagacttctgtttcaggtagctgaaagatgtcaaccttcgatcatattttttgatgagatagatggcttagcaccttctagatccagacgacaagaccagacacacaattcagttgtggcgactttgctttctttgctggatggtttgaaatcacggggttcagttatagtaatcggcgcaacaaatcgtcctgatgctattgatcctgctcttaggaggccaggaagatttgaccgtgagatatacttcccgctccccacctttgaggatagatccgctattctttcattacacacgaaaaaatggccaagtcctatttctggggcattcctctcagttattgcaagccaaactgttggatatgctggtgctgatctgcagtcaatttgcacccaagctgcaataaatgctttgaaaaggacttgcccattgaaggaaatcttactctctgcagagaaaggatttgagcatgggcgacttcctctaccatcaattcttgtggaggaaagggattggcttgctgctcttgcagctgctccaccaccctgttcacagagagaagcagggattgctgcaaatgatctagtttcctctcctcttgtctcctatcttgtgccgtgccttcttaaaccattgctgcacctttttatctccctctatttggatgagcgaatctggttaccttcatctcttctgaaggcatttgcttctattaagcaagttatcttctcatctatggagaagaataatgtgcctcacacattttggtcttcctatctcccatctttgatacaacagaaaggtattgcaaaaagaattgcatcaatcttgtcaggctatggtctaatagcttatcaactaggaaaccatgattctgtgttaaatcacaatgaacagcacgagaagtttgatgcccacagattgaattccaccggttctcacccaaaaggaggtttagcacataaattatcaggatttagagctttagctgctggagcgcccagatcaggccaacaacatctgatccgttgccttcttcatggttttgtgggtcatactgtaatacacaagcttgatcttgcaactatggcacaggagggaaacggtgatattcttagtggactcacacaaattcttcgtaagtttctttatttctttacctcataattgttcatctaaaggcattgtccacaaatatgtgataatattgtctgtatgcatggctctgaggttatataaatgcatgcttgctccaaaagttgtctgcatagaagaatcaatgataactctcttcaagcttaaacctgttattgcatgagcatgcctgtcatattgatatatcatggcactactgttgcctatccacattccccatttcccaatatctgcaattgcatgtaagacatctgacatttcttgctttgacttcttcgttctctatttatactcccattcaacgccatatatctgtagctgccattcctgttcatatttattatcttttttgacaggaagtcctgttcctatttattggttcaaatacatcatgttgtttttttttcctaaaaaatattgtgcacaaaacttccatatcgaatcatcatttctttgttctccttttgttttatcttttcaacactttcatacatggtcttaaatggttaattaaacattaggagcttttctggatctaacatttgataaatttttcaagagtctatttaaacaaactatgtaatatgtcatagctatcatcttcagatataccacaatactgatgagagtgtcttcttattcgatatggggaaccagccattcacaacctgaactgattttggacaagcagtacctactcagttcaaaagggaatgctatttaaccaagaacagtaattagttcaagtcagttatatcttcaagttggatctttctgttgactcaaagttgatctttgagggtgtttggttggttcctcgtgaggtatatacctcaacatcgcaatacatcctaagtacgagttcatcgcgatttagaaaatgatttaaatttatttctaactatccattttcactacactttaagttagttgagtcaaactggagttttggcattcaaagttgaatttgtttccattgagctgtatattttcaaattatatcgttaaagacaaatttgcatatgatctgaagattcctgcaccatgctaaattgtttatatttttggaagccatttcccgataatgattcaattgcaatcaatatagtggagatgcattgtttgaagatcaggcaataaattatgctgagttggtgatacaatgattgaagatcatgcaagaaattaaactgagtacttttaattataacagaattatgctatggcccaattccactttaagctgaagtgaaatgatatagtagttacttatgtattaccctattagcattcttcatttctttccagtgaaatgggcaaataatcatgtattttactttcgcttgaccagtaaaatgccttaatcttggaagatgtataatctatatgcctagaattgatttgtgggccatcgacaagttccatgaacaagaagcagaagatcatgtgctcaatgtgggaacaagcaagttagggtccacagcaacaaaaaatattaaaaaatgttctgaagtatggaattcgttggttgatcagatgggttcattgttagcttctgtatccatcagtgttctggtaaatttcttttcttttcatatgcttcttcaattcctttttgtttgaaaattttgggtatgtatgcatatccatactgtccttttactcacaatgtttacagctgaattgtgcattgcatttatgactaatatattgagattttagtaggttcatgagcgtaaatgactagcattagctgaaaatataggtattgacatttttattcaggcatataatcacctaatttgtactctatccctccaaatatgtataataatctaaacgaataataatttttgaaataatgttctgtccttagaaaaacaaatttaatgaactgaaatgctgctcaagtgttaataataataataataatttaatacatagtcataggagataatcagttgacagctattatcttaatcagtacacaagttacttctctgggtttccattttcaaataaaagaaagggcgaaaaggaagctggaatatatggcccatataccaggggataatttaagaggcagtgcaaggaaaccaagtataatataaaactaagggctcatttgacttcttgaatagtgatatgctctgttctacttcttgttgcagaatgtagttaagaaaatctttgcgtttctagtagaaaatgtattgctaagaagcggccaggcttcagttaacatataaaaagtgtaggacaattgcttaacaagcattacacttgcaaactgcttaactgttcatttattctggattacccctgtgcaaatgacgagtagtttgaccccatttgttgctgtgtgaattttcatattatgatcatctggaacaccgtgaatgttggattactgctattggccattacccctgattttctgatgataaaccctgatttacttggacttaagatctaatgatatatacttatggaacacttctggatatttacatccaaattgcacatttagctgataatttgtttttcagtccaccagtgaactgaagtttcaagatctccctagtggagtaagacatttcttcagcacacatgttgtagatcaatgtcttgcttcttcagaacacacaataccaaggttctctgtgaatgttgacagctactttacctgggatgaggttattgacgcatgctgtttgcggatatcacatgatttagttcagcagcatgttcaacttttgcatgacagggctcataacaatcatgatgaacagaaagaggtctttgttcctatggaaattagtgcaccaggtgaacatagatccagtgggagtaaggaagccagcatgttaacgaagtatccattgaacatggacaagcatccctcatgtggggtttcttcaagagagcatcctactcagctgggcacatgtagtgctcagcaagagccaccaacatctaatgttgaagataaagaggacaatactgagaaaattgatttcaatgagaaagtcgcaacaaatcgttctaatagaattgtgaaggacagtgaatcactagctattatggcctttggaattcagatactacagcacccgcaattttctaaactttgttgggttacatcgaaactacgagagggcccctgcactgatataaatggaccatggaaaggctggccatttaattcctgtttattgcaaagcactacagctgataaatcattatctggaggaaacaatgttcttaagggcaaagagaagattccgtctgtcagaggacttgttgctgttggtctattagcatatagaggtgcttatgcatctgttttggaaatctgttctgaggtgagaaaggtcttggaactgttagttggacaggtccgaactaaaattttggaaaagagaagtcgatatcggtacttccatattctgtcccaagttgcttatctggatgatatcatgagcagctgggcatacacctttcaaaggtaagcaatgggctgtatatttgtgtttgtttgtattggttgtcacattattgattctttttgaagttagtaaactagtaaagtatacttctggcagtcagcaaaaaatattggtacttcatactgctgttttctgacaaaattgtcctgatatttaacttttatatttgtctacaggttacatagtgaaaacaggagagtaaaaacaagtccaaaggtaactgttggaaagtcatccacaagagaatgtcaaggcgacagcaacactgcagaagcaaacatacttggtgctcctgctggctgctctgaggcccaaggcactcctggccaacatacagatgaccttgaagttattcctgctcactgccctagtgagatgcaagagaattcagtccaacatgctccaggccatcttgaaatccatggcattgtctgcgaccttgacaatgataatgtgacatctatatccagcataaatgcagtggaacctgatcttatccattcagcttcacttgatgtgcacacagattcacttaccccagcagatgcagtaataaatgatgggcaatcttgtggggttgacaatgatgggcaaatgtccagagtaatcaatggagaagaaaaccacatatctaatattgaaagacctgaaagccacacagtatctgttgcggatttcaatgagttgcaaaggaaaaatgctgttgcatcctcaactagtaccgacagtgcaggaacatccaggaacatggtgtcttctgaagctcgtggaagtgacaatgagcggaatactgatttccctgtggatgatgtcaaattaggtcatttggttaatcctcaatcacaggataccatgaaaagtctctcagttctgaaacctccatgtctctacaaatgttgccctgtgtgtttcaatgctgtttataagatggttcatgatattctttcaaattcagtaaggcctagtctgcattgcttagcagtcgatgatatgcatgaccttttgtcatcatggtcagtgaatcttctagcaacagttagaaaatggtatacttctcaaggtattgttggctctgaagaaaattctggagaagggcattgtgtttgtagcagtgataatggttgtgttccaagggagtgcacatgccatttggaaagcaacgaagatgctggaactataaaggatgagagctattatctaagtggacagccattaagttttttctttaaagatggtgtattgataccaccagatatcactgcaccaactacacttcattgcagttatatgagattatgtgtttgctcgataccaggttcaatttctatgttcaatcggatctcgagttgatgtgattgtgtgatgcaaggtacttcaatgctaaggataccacagttctgatctttttcctgtgctggcctatcttcagtgtttaccaggtcttgtgcactctcatgggattttgcttgtttccccagtggtagcagctagttcattgcaattacacctcctcccttgatgcaactcccaagctagccttctgcaaataaattgcctttattggttatgttcagcagtggagtgctgggttatatagtttttgggaaacctggatcgactgaaaagaaacaatgctattgattttgtgtctgttaagtggttccgttgtatacgcagtctactgttactgatattggaatctttaaactagctgatccgtgatgctttctcaaatctcattgtattatgtattatagctcaattaaatcactgagttgatcagttgaaacaagattgacaagtacctacagtgtccaagttgtaccttcagactggttactggtatgctttccgacgagctactaacatttaactgcgttcttatgtacatttgagcacactgttacttagaaatgcttaagaaattttgactttggtacttcttagaatataatcatgtacatatttctaaagaaggcaattgtttgacgataaaattaatgtccaacaaagtatttactgattttgtgttattggcatggaacttcattatatggataaatcagtgaactactcatgtgaacttcattgaagctttagtggattattaagttcatgtacaaatttgcttcagtaggcatcttgaactcttgtttctttggtctttgcactgaatcataaattgagtgagggctgatggatgggtttgtttgtatattagaccaagtggccttactatgcccagttccctgaagtagccatgccatggcttggcttatccagtttgatacattttgccatggtggtggtttattgctcttttagcaaagcagttgtgctggctattctttgttggacaagtttagtttgaaggcaggcatatgttctatttgtatgtggcttgccattttcataattttgtcagcagaactgggacaaacttattattgtaaaagggaagattattatttgaacaatctgtatatgatgaactgattcccgttactggtataaactacaaagacatgaactgtaacaaaactggtgaagattattaatattttgtgtctgtaaacagggaaaagcccaccattttccagtttgtcagaaactggttgcattgtatttttagattaattgaaaatttacattctgatgaaacatagattaagattgggcgacatgagaatttgtctgtgattgagccatcgaggtgaccaagaaccatcaataattcaaatactattcttgggattctgaatcttggttataaactataggcaaccgtttttcccccctgatgtttgtgtacaacctgactgttttggttgggtccgactgagaagctgtttggaccagacaacagcaaatcccaactaagttcataccatttgtgttactgttacctgtgctgctggctatcagggagaaatgcacagacaattccctttactttgttattgtttcttaccatgaacctcttgtgtcatctatcgtttactttgttagacttgttctaattggttcgatctgccacagggagtggctctcccacaataaagttttgaccctaacatgtattgagatgcccaagtctatggtgttctctaatgcaacatactagctaagaaatttcaacactttcagcaggagctttgtaactttctttatgccttgcagagcattatactggcaggctgtgttgaatgaactatgtaatttgaaacttgtcataccagccagtgatgctgttatcaaagggtgtggcgatggtttattgtactctcaaaacttattctgaaacaaactattgtctctgatggtcccatgttatgaaatattgtttcttccagcctgttctcaatcagattgtctcatacctgtatatactggtggttgtattgcactggtcagtgagtatggaatgcttatagtaagaaagctcatgctgcagcatgatagttcaagtcaagtgacctttgcatggtagtcctggttagaacaatcattggtttatttttgaagaggagaagttgagagaaggaatgtgaaaacattacatgagatgttaggaagatgcaggtttgtaaagatatggttaatggctttatgtgtcaatttttagtctttggaagatcttgctgatttttcaagccacagaaggttggaaggatacttttgcactttgctgtcaagctagacaaaatatgccatgaagaagagtactaaacacaagtaatatttttgcctctccagttcagttttttattacgttatttgtaatgactttataattcaattcttattttgcaaatacatacacagttgcttatatgtaggaacaattcataaaatgacatagctggtgtagtagtacaataagtttcaccagtgccattccatgtcaattagtatatgctaaattagatttataaatttattacactgaattttactttgatttctcgaagtttattttgctcaaatattatgtcaggtgcacatatttattcaaatcttagcatctactccctttgtcccaaaatataggaagttttgg

SEQ ID NO: 4277 - DNA, 1139 bp, Oryza sativa
atccaaccaaaactccttatattttgggacggagggagtagctaatagggaagcgataaaaataattttgattttgaccttgagtagaggcacttccaacatatctcaattgtgcctgttggtgtcttgcggtggaatattaggaagcactattcaatgattgcacaagtaaatgcataatacaaagcactatttacaacacacttttgtgtagtaatttttaaaacataaactagacttccatatgccagttgttgactaatgtacagcaaatttggtgacttaaataaagtttgatgatattgttctcctgtttgtcaaaattcactaaaattttcatgagattgttatgtggcttatggtttatcaaactagaagacaaatataatgttgctatactgtatatccatgtctggaagtttaagttacataaccttttcttttcttttacaaatagtcaataaacaaaaaattcttatacaacctcagaaaacccagagaatttagacaaaatagcgcaaaggacatactttgtaccacacaaacatgaaatgaatttttatagccatgtagttaatctcccataccagctaggctgcatctgaaaatgccaagtacacacaaaatatgcaaggcagaaaatgaaaagaatatatctaacatttctatttcatgttgtaaggcacacatgatacagaatgacatatttgcattttggtactgttttttcttctaagaatagcgtgggacctatgggcaggggactaagcctttgctcgctttatttatatatatatatatatatatatatatatattctgattacaagtggtcaaaagtatgctgggtgataatcttcatcgtcgtataccatgagatcttttacgatttgatccattgttggcctcttgcttctttcctcaagacatgaaatagctgctttcaccatcgcttttgcttgatcacaattgaaatggcctttcagcctactgtctactatagtgtccaggacctcaccactagtgagcatctgttttaccacctgcacgaattgcatcaagtctatgttttcttcttctattgttatcccacttgaaactctagtcccagtcacaatctccagaagcacaaccccatag

SEQ ID NO: 4278 - DNA, 3360 bp, Oryza sativa
aaaaaggtacctatccaatgactcattttccacatactcgtagactaataacctctgacgaccctctgagcagaatccccacattctgaccaaatttatgtgattgatcctcccaattaacgtcacttctgcccaaaattcctcttcaccctgtctaacatctgtaagtttctttactgcaaccaccttcttatccccaagtattcctctgtaaactgtaccactgccaccttttccaagctcttctttaaattttcccgttgcttccaccaattcgcggtatgtaaacctcctgaactggcttgttatcattttgtaacctttctccatggacttgggtatgttatgcattttaaaaagaaagtaccaccctgtcatgataaagaccaactcaactgctcctattatagtagcaaaaacatataagtatgcccacattatgttgtcagaattttttctgtatgcatctatggatactaacataacttttgaagcatttggcttgcaggtaaaacaaaaatgtttggagatcaaggatgttgaagcaacgttcttaggaagtttgatgtagttgtctccaggaaaatatggataaacctggccattgtagagcaggcctttagtgtaacatagaccatctccacctttgtaggtaaaagataagcacacgcagctgtccatacaaatcctcatgcattcttcaagcgagattgacttgtttgaagtcagatcaaagccataatagtcaccatgaggaatcttgacgaacgtaaaatcctcgcgttgctggccacagctgacgctgaatgttggcctgcagcctctactccagttctcgggatcagtcatctcgtatcctggaggacaagtacatctgagacctggtgagtactcacaaattccatttcttccacacaatccatgcacatagcacatctgcaatacaccttcccctgtgatagtccagttgccatctgatgcattcaagctgtacattctgaggttgccatcataatcaattgtgatccttctctgtatccctaaacctgaatccagggctaccattttgaacccgtcgcttgacaagaacctgccctcgtcgtccaggaccgctatcttgctgctgttgaatctagtccggccgttctgcactgcggtgtagtctggacttggccagtatatgcttgtgatttctggtccattgtactggagccggaggacattatcgttgtcgaaatacaggaaatggttaccagattgggagactaacctcttctctcttgtgagacgctgcgatggtagcagggtgtcagtaggccagtcgaagctctgccacacgatcttatcctcggagtcggatgccttcattaccatattgccactgttgagcagagccaccgtggtgtgcttgccccagccagtcttgctctcccagaccgtggtgccattgacatcggtaaaagccaggttgccctcatggctcagggatatcttggagccatggccgttcaccggaaggccagagtctgcggtccagaccaccgtcctgtcggtggcatgggtgaaccagatggagaagtagaaggcgtttgtgtcatctccagatgggtagaagccgcaggagaaggttgtgtctggtgaaacaaggaaggtttctccatgatctacctggagagatgtacctgtgcctgtggtttgccatggggatgcagatgcggcgcagcacaaaagaacggagatgaaggaaatgaagagtgggcacaggaacttacccatctggatttttggttgttggggggtgacgagtgcaaaggatattggcttctttgtgtgtgcgcagactgtgccctgtggcctgtggcacactgattcttgtcaatcttgtgcccatatctcttgagatatcacatacccatatgcgttacctgtagaacgaaatgccacattgccactggatggtgactggtgactggtgagtttggctggcttattttcatctgcagcgagtgttactttactcgcgtgatcttgttcattggattggatcaccgagaatctgacgtgtgcttttttttttttggttcctgtgtaccctctccagctctcctttgcctgggagaggttgagattctcagcacacatcacattcgttctttgttccaccgaaagataacatggaaactgtggctgtgttctttggttagagcaagtataatagtaggttataagccggctaaatgttgaggtggaggagagaagaaaagagaagcgggttgtaaacttacagccggtttggatataaaaaccagaaactctgtgagagagacaagtgaaccctgtattaattgtaaagatctaactattatatgggtaggctgagagaagactacaaagaactttagagcaggtacaatagtaggctataagccagctataaacataatttaaagaaataaaggaagagagagaagagtagcgggctacagatctgtagccagctgcagcacggactccaaaacgtaacgtgtgtatgacatgtgagactaggtattaatagtatagtaagcaactatttgtatgaattggctattacattggctctagatgatttggagcagtagttggctatactattaaacttgctcttatagccaacagatcggctgtattattagccttgctcttacagttactaactcacctcattcgttattcgcgtgcacgttttctaaacggctaaactgtctttttttttaaaaaaaattctatataaaagttgcttaaaaatcatattaatctatttttttaaaaaatatagctaatattcaattaattatgtgttaataagctacttcgttttacatatgtgaggggataccatgaggaaagagttatctcctagtgttgtatatattggaaaactgtaattttgttttgtggaccaaccgactatatttcttctcaatatatttgtcaacaacatagacgaagtttttgtccatccatgtaattatgaacggccagaacggatcaacaggctaaatacagagtacttcatttgttctaaaataagttaattttaggttctactttttatcctaaataagtttactttttaatctatctgtcaaaagatgagttttattccttcaataagcatacccacccatcaatatttgtcgaaagatgagttttatttctttgatacacatactcacccattaatatttccttttcgattgatgaagaacatttttattttttttcacttcattttaatttgtgtttcaatagctaaatgattttgctattcctctgtcgcgtgattttttcttacgcctcactcgcttttgtggtcgt

SEQ ID NO: 4279 - DNA, 14365 bp, Oryza sativa
ggtacataaatgatggaactctgtcattaaagttaggatttcatatccattagcttataaatcatataagaaaaaaactaacttaaaagtctatgaaaataaactcaatcaatagccatgtgagaggagagaggaaagataaattatttttatttttttcataaaggtatatcttatgcataacataaaggcaaattttgctacaggacacccaaaatttgtgtaatttgctgatagacatcgaaaaaacatgtcatggctgaaagacattctaaaaaaactggtaatttgctgtaggacacttttggctcaattgaagggatggattccaaaaaaaagacgagaatgcccctctggccacatgcttcaaacatggtgttagagtaaaaattaagaatttttccaactctaaattttccatagcccaaagtatatcactagcatacaccatatttcattttcactctagtatcggctcaaaaagcttttgaccctagggtcattcttgtctttttgaaaaatttctctctctgattgagccggaagtgtcctctagcaaattaccatttttttagagtgtctttctgatgaaccctgagttcctctcgacactcaaggcagttgtttggcccgatctttcggtgagttgatgataactacgatttgtggaaaagacgttgacgacccgattacaaccgtacaagacgttgcgttgcgccttagcgatcgatacacctctccgtgggttgttgatcttgccggtgcagatcaaccttattcctgcaagcaatcgagaacaagcaagaacaagatataaagcaactgaattgctagatagacaagacttacaaagataaattgatacacgataaagtggggttccgaacaagcagacggacggtctagccgacacgcgcgctgcaagcgaagtagcaatggctaaacttacaattaatcaaaacccgagaaaccctgaaggggtaactagctatatataggggtgggagcacgacctaggggtgcctaggtcatgctccaccagcttggggcgcaccccacatgggccccacctgggccggggtcccaaatgaagttacaagcccataggcccattataggtgacgcagcaccttgttcctgtgattccggccacacgagatggaattcagagaagaggctggatccgttggaaagagggctccgagagctttccatcaagtactcacaggccgaaaacggaggtcgtatgcagattcggtggccgtttgaagtcagcagtgtagtaggtggccgaatcggattctagcacttggaggacttgatcttgatatcttcttgttcatccatgatgtgagcaatggttgcatccgtggtagccatggtcacatcatctctttcagccataacacgttttcaagatgtctatcagcaaattacacaaattttcggtgtcctgtagcaaattttgcctaacataaaaagtgttatattgatcactttcacaatgttaaggcatgctatatagaccaataataaccaatttttctatatatttaatcgtggtgtattacgtgtttacttctaccttaaaatatgcctaaatattttttatttaccttataacaaagggactaccacaacgatattacgttttccaagttgaaatacgcttatatatttttgtcaaaaaaataaatacatctatatttcattttgatttgtatttaacttctgactactctctctgtcaaaaataaaagattttggttggataagacattgctaatattatgggcatattcagattgtagccaaaattttggcaggatttcttatgtattgatcaaatttggtaacaaactaaagacattcttttgacaattttacttagaaaaataatatggttgaaaatgacatcaaagtgaacatgccctacgaatcatatagcgaggaacggaagactacgacctgttgtgtcagttctcagttgtgatcaccacatgaacaggcccacgtgaatggcccatagaacggcggtccacttctactccggcgagccacctccctcgaactactagtcctttcgccttcctcgtcgtgtccactccccacgcacgcacgcggcggcggcgagccgccaccccccctcccgtcggctttccgatctccgggaacgtcgcgacggcggcgccaatgcgtatgctatgccgcgcgcgctggttctctccctccccccctctgccgccgcaggcgtcatcattgccctcatgtcaggtgccggcagtggggactggggaggctgttgcccttgcaggggcgagaaacgaggtaaagctgttcatcttccctgctggttaagtcgcatccatgtcgtgttcaccacttggcatcgcgctctccttcaagcttccagtgtgccttgagcgacgcagaagccatgggctcaagcagaattgttcggtgcaatgcaacttatccggtggccatcacgcctagaagagatctgcccttcgcaatccattacaaggtgcgtatttctgaggtgagggcatggtttccttgtaaactatgcacgctgcagataattttattttgctctgcatatattgaattaatatggagtagtttctggttatttgggtggggttatggattcgatgcttgtgaaaatgacggttaaagtttgtaggcttgtagagataattgagagaaaacgaacaaaccaatcaattctggaatagccctgcatactattcattcactcatttcatctacagaacaaaacttgttacattatgcaatataatcattccaatgtcataaacaataagcccttgtcaccatatctagctatgcctataattacatcatctaggatatcctattacgtacacatctcaaaatttatgcagtagctgcaggctaatatgaataggcaggatggtagtcgtcttcgtcatcacataacatgagagccttcagaatttcatccattgttggcctcttgcttctttcttccaggcatgaaagagctaccttcaccattgtaattacttgctctggatcaaagtgtccatgcagtctgtcatccactaaatcggtgacattccctgtagcctgaatctttttggcctcctggacaaactctggaaactccacttgcctttcatctaccactatgccgcttgaaaccctgattcctgtcacaatctcaaggagcactactccatagctgtagacatcaacctttgcattgatcggcaaattcaacgcccattctggtgccatgtagcccattgtgcccctcatatgggtgaaattgaaactagtgctgtctcgctttgcaagtttggctagtccaaagtctgctatcttggcatcgaaatctctacttagaagtatgttttctggtttcacatcacaatgcacgacccactcaaggcattcgtgatgaagataagcaagacccctggctgtgcccagggcaatcctgtacctttggctccaacttagcaggctttcgtggcatctctcaccaaagaggtacttgtccaatgactcgttctccacatactcatataccaatagtctgtttgtcccttctgagcaaaacccccacatccttaccaaatttatgtgattgatcctcccaattagagtcacttctgcccagaattcctcctctccttgccgaacgtctgtaagcttctttactgccactattttcttatcttcaagtactcctctataaacaattccagccccacccctcccaagctcttctttgaattttccagtcgcttccttcaattctcggtatgtaaatcgcctgaactggtttgttatcatcttgtatccatcctccatggacttgggtatgttatgcttcttgaaaaaaaggtaccagcctgtcactattacaagcgactctagacctcccaatattgcagcaaaaacatagaagtatgcccactttatattgtccttctttgttccatacatacttgctgagcctagcatgatctcaggagcactgaggttgcaagtgagtctttgttgtttggagattgagggtgttgatttgcttgaattcttaggtactttcatgtagttgtctccggggaaatatgggtacacctgaccattgtagagtaagcctttagtgtaacataaaccatccccacccttgtatgtgaatgataagcaggagctgctgttcaagcaaatattctgacatgcttcaaatgagatggatttatttgatcccagatcgaagccatagaagtctgcatgaggctgtttgacgaacataaagtcctcatgtggtcttttgctatcgattgtaaacgttggttcacatcctttgttccaatctgttggatcaaccatcacatattctggaggacatctacatcttagacctcccgagtagtcacatatcccattcttgccgcatagcccatgaacataacacatctgtatcacggcctgccctgtgatagtccagttgcccgttgactcgttcaagctgtacattctaaaattgccatcataatcaattgtaatccttctcttgatcctaggacctgaatctgtagcctctatcttgaatccatcacttgacacaaaattaccctcatcatcaagaaatgctatcctggtgctgttaaatctagtacgcccatttttttcggcattataatctggacttggccagtagatgcttgtaatctctgggccgtcatataataggcgcaggacattatcgttatcaaagtagaggtgatgataacgagagactaaccttatgtttttggtcaggttctgccatggcagcaaggtatcggtcggtgagtcgaagctctgccacacagtactattgctggaatccttgattacaagattgccggtgtcaagaagggtaactgtagtatgcttgcctgaagatgtcttgctttcccacaccgtcgtgccgttggtatctgtgaggactaggttgccatcatggcccagcgacaccctggagccgtaaaggttcactggggagtatcccccattcgccggagagtagggattcgccgtccacacggcagttttctcggtggtgtgggtgtaccagatcgagaaggtgaaagcatttgtgccaagctgatggaagccgcaagagaaggtggtatcaggtgagaggaggaagatcttgtcatggtcctcagctctgatgtgtgagccggtcgtcatggttcgccatggggaagcacaagagcagaggtggaaggagagtgatgagaggatggttagatacagcagcgcagccattatctccttttccagggagctttggctatcgaagtagagagaagaagagagacagagagaggcaggtagctttaggttcagttttaacactatgcggcttacttaggtgacgatatgcattagcgcgcatgtggccgtaatacccatgtatgttgctgacttgaacaattgaatactggggttggtaaggcaaaaaaactgttgggcatctccacggtgtacacattgcattgtcctactatattgcttgatttagactgcaagacggaatattgtcaacttcatgggggcatccatgtttctttcaatgtgtgaaagaggagtaccgatgaaaccgtgattttgtatattatatatatcagtttttcctcccttctgccccaagctaagttcttttacataagcaactagtgtatgaaagttaaaagtatctttaaagaagaactttatttgggagtaaaaagaggacaatttttggatgaatagtaatagagaaaatctattatatgccattaactttgtcacacttctacaatttaccactgactttatcacgttctacaatataccatcaactttcacttaacttctacgatttactattgccgtccggttagtctcagtgagtactgtacaaatttattgaaatgatcaaaatatccctgggaacaaaaactttcaaattttggacaaaaattctgaaatatcaaatttcatgttttagaccaaattttagatggttacaatcttatgtttataatatgatattttgaaatttttatccaaaatttgaaagtttttgtcgtaggggtattttggtcatttggacaaaattgtacagtgttaacggaggctaaccggacagcgatggtaaatcgtagaagttaagcaaaagtcgatggtatattgtagaatgtgacaaattcaatggtaaatcgtagacatgtgacaaagttagtggcatataatggattctctcatagtaatatggcactattcacctaaaatttatctcttttttttcctctcaaatgaagttgagtttgaacttgtgatttcgtgtgaatgtatgtgatgcctactgctaactccaatattttttttgatgaatttagagaacttttaggtatggttttcacttatgattttcactggatattttctcattatctacccaccagatctgtctctgatgtcatgtttaatatttatcaatttatgatggacaaaacaaatagtatggctgcatcgtatcgtaaaaagtttgtgtacgatcttattttgttcatgacctgaagtcgtcgtcatctctctctcaatatttaaaagtcatttctttggtatttgcccaatataagaagcgccccactgatagcaatttggatgacgaaatcaacgatattaatagtagtttggatcttgacatgatagcttgtggtttgatcaaacgactcttcgtttcagtttgcccattctatctttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcaggcacaccagtagtgacttcacatctttaatctgctagtgctagttgtctgagggtaaggtttcatgctcaaccgctcaaactaggacctgcaatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccaggaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctccaatttgcgcaaaatatgcagcttagcagatgaaacaacaagctacctctttcttcactgtccttttgcctctggtctatgggcttcactccacatcgatccaggtattgacgatgtaaaacaactccatgcattacaaccaccatcagtcatcccgacagcgcacttccgccccttctttctgctctgcctttggggactctggaaccaccgcgccatgatgccatcttcagaaaccaggagccttgtcatcgtcgcctcctccaacgatgtatcgaagacgcaactctctgggcacaccggttaaagagccaggatagaatcgttgtttccacctggaagcaagtactctcccaccccctaaattctgatcaaatggtgcaattggatctcaaatttattaggaagttcttcctctagaatcctcctaaatggatgccccggtaacccaattttacataagagaggtctaagacaaggagacccactttctcctatgctatttattctagctatggaaccactgcatctgatcttcaaagcagccgaggaagccttaattctcaagaaaatagatccgagacgacaaagatttcgttgttccttctacgcggacgacgtggctctcttcatccctccagaggcacaggaactaacaactgtaaagaacattctccacacttttgcaaggatcagcggcctccacacaaatccttccaaaacagaggttttcccgatagcttgtgataatctgaatgttgaaagccttctaaattcattcatggggaatttaaaaaccttcccatgcaattatctcggcataccccttcatacgagaaaactgaggaaaatagatctacagcctctagtagataaggtgggtgcaagaataccaggttggaagggaagattctttacttcagcaggaagggaagtgttagtgaaaacaacacttacggcaacaccaatttaccacctcacggtactgccacaaatgaaatgggttttcaagaaaattgatcgtttcagacgtgcctttctttggaagggagaggaccctgaaaatgtgaatgccggtagcagtttaattaattggcaagaggtatgtaaaccaaagaatttgggaggacttggtattttaaacttagaaaaatttgcaagagcattgcgcctccgttggctttggtataattggaaagatgatacaaaaccgagggtgaatatgtcagttccatgtgatgaaactgatagatgcctattcagagctgggacaaaaattgagatcggggatggaagaaaaacctctttctggttagacaattggttggatggccaaacacccaaggatctagctccgacaatttttaggcttgcaaagagaaaaagtaatagtctacatgctgatctgaacaacaatcattggctatctctgttaaatccaatcacttccttggaggaggtaaacgaccttgtccagctggggggaagacttcagaacatatccctacaagatggactggcggatgaaataatttggagatggactgaaaatggggtttactcagaaaagagtgcctatcttgcccagttccagggatcacacacaaacgttttttacgagcctctttggaccacatctgcagaaccaaagcatcgattttttggctggttagtcttacaccaacgaactcttaccgcggaaaatctgctgcgctgacactggccatgcgactggatttgtagtctatgtaggggggccttcgaggatgccacacatctagcaaaagagtgcccctttacgaacttggtttggaaccatgtcagtagttggcttgacattcaagcaccacaacaacatacagcaccttccattgaagactggtggagcaccctctgcaggatcaagcctaaatcaagaaggaagcacattctgagtgtccttttaacaacatggtggaatatttggctagaacgtaataggaggattttccaaaattcttcaaaaagcgagctgcaggtggccttcctagttaaagagaatatagacctcatcaaccaatccaggctctattgctgctgatagaacctggtcctcaggcgttctttccttgggttgtaaatttaatcgcaggagctgtactgccctgttgttgttttcgtttatgcaccctctgtaagactctcttgatttatttcttctaatatatacggcaaatctcctgccgtttaatgtttcaaaaaaaaaattctgatcaaatgtaatagcaggccgctggcccttcttttgtttctgtttgtgtttgtatgaacatctctgctttaatttcaatggaaattcaggtggggaagctctcccctccggtgattattaaaaaaaaaaagagtattcagatcatcagatgtatatcaaaattttagagaaaaaggtatatacaatatgtaatacgcatgtgcatgaaaaaaaagggaaaaataaggctgtattcagaccaaaataaatctgaacaactctttcgtaagttcttacctcttctgatcttctccaatggtctaattcgcacaagtttactcggcgccggcgtagacaaaataccatgttattattcccgaaaaaataccatgttattactgttttttttaagaacatgctattaaccatttaaccgaattaaaaaaccctaaaatacccaaacaagtcaatgatactacaccatcacgagtaaaagatctgcaaaaaaacgtagaaggggaaaaaagggagcgacgacacgagccaatcagccaaatgtcacgagtaatctattgaagatttctctggaatgggccttatatgggcctagattctccctctcaaccaaagtgtggcctcagcagcccacatttattttccgacaattatcgggctcggcctcttcgcgccggatcgtctcactctcaccccttccatagtggccagctcggcctcgatccacatcgtcgttgttgcacacagcttcgatccacaccgccgccatcgttcatggctttgatccacgccgccgcaaacatccatagcttcgaagccaatagttaaccctgattttgtctgaactctgatttttctctgaacaattgagcaagatctgtctcctttggtatataataaaattccagcacatacatcactaaaacttgaaacatggaaaggctcatcctggtacttctgaatgttatttcatacagatgaaagcttacaaatgttaaaagttcgttgagcaataggtagtcaaatttctgttctgtgttttgttcataccgtaacctgctcacctgctgctagcttcataatacccaaatgttcagaaatggaattggcgctcgtcgattcgttaaaaaaaaaaaggaaaaacagatgttcagaagggaaaagaaattcaggtgtaatagaagggttttttgggtgaccccaaaattacaagtggaaaatatttgtaggggtaaagattaaccaaacatccaagcgtgcccttagcaatcagaaccgcatcctgggtaggggtggataaaaagcttgggctcgtgagctcagctcgggcttggctcgagctcacttagctcggctcggcttgaatgccaaacgagccaagcccaagtctccctttcagctcgtttctaaaacaagccgagcccgagctggctcgcgagccgcttgatttggctcgtgagcctaggccatcatgtatttatatggatgattttatcttctagtggagttattatttgttaatatgtaatttatcatctatattttgatgaattgaatatataaagttattttaattttacatgttgatgatttgttattgcttttcttaatgattacaaattatgtatcttcaacggaaggctcgcaagccagctcgagctggctcgagctaagaaataagccgagccgagctcatattttaactcgttttactaaccgagccgagccaagcctaacttgttgcgagccgagctaagcttgtcttggctcgtttccacccctaatattgggtgacatagaatgatggtgcaccatagtttcttacctaggacctgtttagatttcaactttttttcttcaaacttccaacttttccgttacatcaaactttcctacacacacaaacttccaacttttctgttccaatttcttcaaacttctaattttggcgtgtaactaaacacagccctagcgtagaagctctatgaagctccagtattaaattctagcatcggtcagtttaggcatgcacaagcacaagtggtatatcgtcagtaacaagaagacaaaggagcacaatcaatcactgaccacggatgaacatattggaccaatagctagtagtaaaccaatcatcagcacttcaaatcaaatggaatgttctatactaagcagctggttccttccaggaacatgaaaaattgaaaactctaaacactagcgacacgctcacggcggctcacccgtgacagatcctgacctctctcgcggagcactcgccgcctcgtcggcccttggaccggcatgaggaatccgactcactgctgaactttgaacagctccagctggttcattgagctgaaaatgttttggatgtttgtttagagatcccctcggaagtgttacaacctgcaaagatttatcgacgtaaaatcagcaagcataaatcataagccagctttaggaagcgtgatcacaatttgccggctacaccaatcaatttgggaacctataataacgggcacaactttagtgttcagtctacttttaatagccaattaaaaagaaaagataaaccatgtcagttcggctagcatcgccgcaatgatattggtaccacgactccacgagacagtgacaacacaatgatcaatgacaatacaataccgaactgcccggtcagacatggctacatgacttgcgcgtcactgtcaccctaacgatcagggcatttatcatgcaaattaccaaacgaattgtccacctctacaactggcaatcaacaagtcagcatcccaaacaatggcatggaatgaacatagccaatctttgctccaagtagacaaattactcccatatatagttatatactctagagtccatatagctagcagcaccaaacagaatgttttttttgggatacgcgagggacgcatctttgtattaaggaataaagtatttacagagcgggccgaaaaatcaaaaacacgaaggggacaagatacaggaggggggaggaggaagaaaataaaagcctaatctcccaacgaatgtggcgaccttccacccgacataggggtcgccatggccggtatcgcggctctagccaaccgccaaaggtctgcttcgcccgtcatggccctagcaatttccgcccatgtcctactcttttggttgaagacccgattgtttctttctttccaaatcgtccacgccaaacagaatgttggtattgagaaataatgaggcagctctcaaaaatgtgaaagctgtcatgaagattgtatgaccaagacaagaaacatgtcaaatatttaagctgcacgattagagaatgatggtaaaaacaaaagttcagaccttctaaaattagagagctttaaaagcagtaatatattcaatcactttcatatacctgaaagccgccaggactgaatgcaatgcgacaatgtcctgaaggagcacttaactattcccggtttactggtttaggcatgtagaatttgcagcatggattcaaatttgactccacgaaagaacctttgcaacaagtggatatcaaataaggatgaggcagagcatcataaatggaagcaaacaccttcctccataccatgatctgatggcctgaacacaaagaaaacaaaatggcaagattactctgtctagtcattcttcccttgatcagtgtactgccattctcatatgcttcacccctgttgatgctaagcaccggctcatccttatttgttgaagagcataagcaaaccttccttacctcaccaaacgccgatttctcttgtggcttctatgaagttggaggga

SEQ ID NO: 4280 - DNA, 718 bp, Oryza sativa
  unsure (1)..(718): unsure at all n locations
atcatcgatctcgatctcgggtgcatcatgcatatgcactcggtgcaaattaagcagcaaaagtctgaactgcattgcatatgcagtgagccccagggagtcgttgaaagacgcacgcatgccgacgatgaagatgctgcaccgatcatcgtccggcggcctcacccgggatttccatgtcgacatcctgccgcagcagggagagagacatgctcatatgcagcagagcgtcgatcaaaccgctgaaaagacagaatgtatatatgtaacccataatcattcattattctgtccatagatttagttcgtttttcttatgaacttatactgaattaattggtaggggtgaaagacacggtgataatccaggaggtcgccggcgagagatcggaagaggcggaggaggcggcggagcgtgtcgcggcagattccggcgacgaggctgcacctgcaggtatacgacgcaactgcaactttcgcaaaggactggtttttgactcgcctgtagctttcatggagaaaatctgacctctaaattgaacccacctgccagtcgccgacgaggacaacgccgtgaagaccacggccgccgtggaagaaaccactgctcgtcccgaccagccatgtacccatcacacacctgcacgcagtcaaatnnnnnnnnnnnnnnnnnnnnnnnnnnnnnnnnnnnnnnnnnnnnnnnnnnnnnnnnnnnnnn

SEQ ID NO: 4281 - DNA, 684 bp, Oryza sativa
cgatttgagctgcaacaccagaaagcatatgctccaaataaacgattggtaatcaatgaaggagcaaattagtggcaaactaagctactgatgcaaatcaagtatttcttcagcactgcattaggctctcaggctatgaactatgggtattcctgatgagaattaatcagtatggtcaatcaaagcaagcatcagaatgtatgatttacctaattattttacatcatataacctgcattttatggttgattagtattactccacctttgcaatatggatgaactgataaagcattaggaactcagtagcagaagctaaatgcagcaaacatgctctatttttttaacgcaacctagtgaaaaactaccaccaaaatacagtagtaacatatgtaattgctaaccaaaaatgaaagcatgatggcttcagtttacttgctaccgtgacatcaattaaaaaggtttcaaaatataaatatgacacctgtgagcggaatcgattgatgttccgttcagtggtaatcttagggtgggttcccgtctgtgcaaaatgtaaatcggtcagatcatagcaacgcatcagcacgctataaagaagaataggctaaatgaccaagtcccacaagaaagagtaaaaacctcgatagcatactgctccgcaggaagaccaaatgcatcccatccc

SEQ ID NO: 4282 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnnnntgttgcgaggaaagtaaactggaataactatggagaatccattagaatatacaaaaactaaccatgattttgagcgaatttataattagtacaaccaaaagtccaaaacaaatgcttctgaaaaaaggaacataggactaacttttgaaatgtagctaggcagagcacctccacacaattgagctgcctcctcataaggtaaaatataagctaatacctgcatcaagtgtaaaaaattgaagtcacaagataaacattataaacttcaacaagaacagcttcgtgtgtcttacttttgctcctttagtaattaactcatttgcttctttttccaactcgtttttcttatcctgcaactgatctggtggaatgactcctttatactcaacgaaaggtctgcagtgaacaaagaacacttaattgtgcacacaataatctaactacaaccaaattagtttgagaacacatgataagttggacgcaaaggccaagagtaatcaattgttgttatggagcaacagaataaagcatccaaaacaagcaaccatacccatcagggaaatgatgtcctttcccagggtcgaaatgtgataagccaatattgctcatgcagatgtctatcaaatgccctgcagaatgaagcctgcaaagcaacatcacaggttcagcacgacga

SEQ ID NO: 4283 - DNA, 650 bp, Oryza sativa
ctgtatgttggtagacggtacagcccgagcaccgagctcgggttgccggacctagctggctagctcccccactccctataccattgccatcttcagattaaaatggcatagagtatttgtaacaacatgacccctcttgcagattgcatgaacgaagaagagggtaaagagtaaataccagacatctgtagactgcacatgtatgcatttttatgcacagatcagggcgtatgcttgtagagtgcgcatggtgtttaattctaactccggctcggcaaaagggcactgcgttgccggctggctttgccgccagtatgcgggactgcatgtggccatgccaccacagggagatggcgggaagagggacaccgaggaattctgccgccggtagggctcatctctccctctcactcgcacgacggcatcaacagatagggattgatctgaaaagagaattactaaattgcccttacatttttttagcatattcctataatacccttgtaaatacttgcagtatatactgttagtatattgtaccgtaaaagttctcaaatatttagctttaataattagtttatggttgcatttccgggcattttatgattaattaattccgtggctgcaggatcgacggatcatgtcatgtg

SEQ ID NO: 4284 - DNA, 500 bp, Oryza sativa
tacatgaaacagttcggttccatcaaaattccccgtgaaattcctccggtccgaataagccatagatcagacatcaccattcaccaatgatagcagcaattctctcttcatgtactagtagtctagtagtacaactcatcagaaaaggtagctgatctatgtcaatgtaattaatcaatcacaggttattagtactccagcataggtaaaccaggacgtaagtacaattaatgaaactaatgcagcaaagcaaatgctaataatggccactttccaccctgcactgcaacctagtctactcccctcacatgtcgcaccagctgcagcgccacactccactcctcctgacgactccactgtctcctcttcaactgaatcagaccagaccacgccgcagctgagctgcaggagcgcgcggccagagccttcgtggcgcagcagcacggtggcggcagagccgtcgccatgaaggcggcggcgagggagaggaagccgaggca

SEQ ID NO: 4285 - DNA, 891 bp, Oryza sativa
  unsure (1)..(891): unsure at all n locations
nnnnnnnnnnnnnnnnnnnnnnnnnnnnnnnnnnnnnnnnnnnnnnnnnnnnnnncgatcgatgcgcttacaaatcatgatgctaattaagagtgtataaggtcatttccaacctatgacactagacatagttttcataaacttcacatcatcaagaaactagtactagtactagacactactcttccaatacaaacaccactattctatacttagatttaatgctacttatttcacatgatgtcttgaatattgtgtaaaaaccatgttccatgcaggacatggtttttttttctcatttatttatttgtcacgttatttttcatcctagttgacagtttatttaatgctataaacatcatcctagttattgggttagaaatggtctaatcatgagatgtacgatactaaacgtctgttcgcgttccgcgaacgttcacgtattagcctcacccgctgctcgggcggtgctgcgagaccgcatctgtctcgtgccaacagaccgcaaacagcgtctctctcgtgccgatgttgtggcgttgcggggccgtaacaacgtcacccatttcgcaccacgacaccgcccatgtcatgactccgtcacgcgagcaggacggagctagaactagacagagagatgctgctagcttaatttattttacttaatattgagtttaaactgacatagatacttatatttatattgagagggtgcatatatagcgaaaatagataagatatagttataatttttttttcaccgggttactaggaaccccctaattactctacctccaccctgcacgcgagaccgcacacgaattcagcacgtggtcattattttcacgcaacggtcgagcaatatcgtgtcatgccctttcactcagcgac

SEQ ID NO: 4286 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnncatatctagtactaatcagaaaatctatcgtatggtattccgtggagacggaatagtactactgccttatctcctgttcccctcttccagtctcttcccctccactcactctctctctctctcttttcccctccactcgatccctctctctgtaactaccacccatgagcacggaggcggcgacgacggtgacgacgacggcagcaacgacgacgacagcgacggcggcaacgacggcgacgatggcggcggcaacgacggcgacgacaacgacggcggcgccgtcaccaccagcccccgcgaacgacctagacgacagccagcggagctcccgaccaccacgggcgacggccgccatcgagaagcctccccatcaagctcctcaaggcgctcctcctcttcgtcggtcttgtcggtagcttccttgccgctgccgcctcctcctccttggcggcgctggcgcctcctacggtcggagagcggtggacgcggccaccgggggcgagcgcttggcacaacatgagcgacgaggagctgctctaggcggtgtcgatggagccacgggttccgcggtttggagcgaggcacgacgaccagcgacggaatggcacaaggtaggcaccagatctatcgcttcttcttctttttctccgccgccgccc

SEQ ID NO: 4287 - DNA, 722 bp, Oryza sativa
  unsure (1)..(722): unsure at all n locations
tatggccattttatttcatggcctgatagtttctgtggtaatccgtaatcgccaggggtggggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggcttctttttccaattttcctgcacgatgcaacatgctgcgctgtaatctggattttgccagcctgatgtatcaatatcaacacttggtgggcattttcgcatttgaaccgaaaggccctagttcatacagttttgtacctcctgaaacaatacccccttggaaggtgttgatatactccaaattacaaaagctagctcaataaaaggggtagagatgagtggcctcatgtatttgccttataaaagaggtagagatgagtggcctcatgtatttgccttcagttataatttgtcttcagttataatttgtgtattatttccccgcaaaaaaaataannnnnnnnnnnnnnnnnnnnnnnnnnnnnnnnnnnnnnnnnnnnnnnnnnnnnnnn

SEQ ID NO: 4288 - DNA, 657 bp, Oryza sativa
cttcccttatgcaaggccaatcgtctgccacctgtccggcgacgttcgagtttctccggcgacctcctcggttaccctgaccatgccattgcagcaaggggaggcagcggcgcggcgcatcaggccatatgcacgccgggacgacttcctgctacctcttgtcagagaagtggccatcacatcagctgcaagtgaaggcgatgctcccagctgcaatgtcagccatggcgtccccgcggtcatcttctccatcggcggctacaccggcaacttcttccatgacatggcagacgtgctggtgcctctgtacctcaccaccttccatttcaaagggaaggtacagctgttcgttgcaaactacaagcaatggtggattcagaagtacaagccggtgctccggcggctttcgcatcgagccgtcgtcgatttcgactccgacggcgatgtccattgcttcgatcatgtgatcgtgggcttggtgagagacagggacctgatccttgggcagcatccgacgaggaaccccaaggggtacaccatggtcgacttcacgaggttcttgcgccacgcgtacgggctgaggagggacaagcccatggtgctcggcgagacgagcggcaagaagccgaggatgctgatcatatcgcggcggcggac

SEQ ID NO: 4289 - DNA, 2160 bp, Oryza sativa
gactctagaggatccccgtcgatctcaacggtgtttgtgggacattgccgtgctaaccaccgcttcgaccgtggcttgctgctgttgcattgacattttcgtcgctgccctgcttgctggtttgtgaggagaatccggcaaagagattcccatttgccgcggtattagttcaggacaaggcatttgaatttggataatatggttttcttctttttcatttgtttctgtttatttattggtgttcaggtttgtcatctgaacgatccgtgatgaaatgttcctctttttcatccagaaaaattgaactgcattttctattgttggtgatattgttaataaaagatatttttttcattctttatctaagattgtacagatagctttccagatgcatacatcaaataattggagtgcatttctacgtaatcttgaagatacagactggaagtagtatcgacagttacagaaattatacgcacagttcatgatgttaatctgtaaactgatcctaatgtgtgtcggccacaagctactagccttgcagatttcatcagcaatgacagaagaatttgtttggtagagatataattaaggacggaaaaaatcatttgaaaaaacaatcagatagtaggttaatatatatcataggatattctcctagctactactactacatatatgtgttcatcatgcatatagtatatgattgggctcacatatcataagcaaataaatgatcatgcggtgcaagtgcaatataggacgtttaaacgaacgcacggaagcagagagatgcattaacaaatcccaaatgtctgacccgttgaggatcgatttgcccacgatatatatagagaatgtaaccaacaacgacatgccatccaactctgtgatctcaactgccaaactaatacatactacagcttgatttcccattgatgcatctacattttcagagcttgattaattcaatcaaactcttgcaacaggatagttgtgtaactatggtgatactatgatttagcctcttcaaaggtatcgactctagtcttgtcagacaatgaggtatcaactgtagatagtagttcaaatcatgtataaccattcagtttccagaattaatcatattgcaacttgtaagtagaagtcaatcactggctagcctgtacccatgtgccacactgctaggatatgattcagagaggaagctatcagagattagtcgccgtgcagaaatgagcaaatagtactgacaaatatttcaagctgtagccactacctggtaagctttctttcacaacttgacttatatcaaaggactagcagtacacaagaacagacaatctcctctctcaatttttgtattcgcccattaaaattctatcttaattacagtgtaatagtatatagttgcaagtgtgtgcattcaatatatataatcttcgagagatggaaaagaagagggtaaaagaatgtgaatgtgatgagatgaactaggaacaaaatgtaatcataatctacttggtggcaaggttgtcgagagcttgctgcaacactggcctgaatcgggtgacgtcaatggtgatgtcctggccgtccatgagcgtctgcttcatgaaggcgaaccctctcttgtgcagacccgtcgggttggtgaagatctcgtcgccggcggggtacttgtccttgagcgagctctcggcgacggcgatctcgtactggatgtagttgagccccatcgccgccgccggctcgccgtagtccatgcgcgcgatccactggaggccgccccatggcaccacctgcaccatcgtcgctcccggcggcaggaacatcatgttcgtcaggccggcgccatggacgccgagcagcgcgtcgcacgagttgatcagcttccccacctgctcgatggagttccccacgtccgactcgttcaccaccacctcgaacccgacctcctccgccgcgcggaccacggcgtcgaggttcaagagcagcctggtgcgcccccgggagatgaccaggaggcgcggccgccgcccggtgccgtcgccgagccgcgtcggcgcgtcgcgcggcaacgacagcgcgcggcggaggaaccgcgtgaagtccggcgtcgccagcccgtccaggctgcgctcccgctcgatgatgagc

SEQ ID NO: 4290 - DNA, 11335 bp, Oryza sativa
  unsure (1)..(11335): unsure at all n locations
cgttcatggcgcgcacgttgtccgccacgttagttggtgcccaaaattcaaaattaaactgcacttgcagtattagacatggcgttgattttaattaattcctcggtttgaaattaatcacgtacgtgacgtcaccgtttgctccggcgtgcgagctggctcgccggcgtcctgcagcttcaccggaagctgctgctgattcttctcctccactgtaaaagaagaagaaacacgattttttctcttgagaaaattaaatttcaacggaatttggaattctgcaataatttgactgcgtgcaggtgtgtgatgggtacatggctggtcgggacgagcagtggtttcttccacggcggccgtggtcttcacggcgttgtcctcgtcggcgactggcaggtgggttcaatttagaggtcagattttctccatgaaagctacaggcgagtcaaaaaccagtcctttgcgaaagttgcagttgcgtcgtatacctgcaggtgcagcctcgtcgccggaatctgccgcgacacgctccgccgcctcctccgcctcttccgatctctcgccggcgacctcctggattatcaccgtgtctttcacccctaccaattaattcagtataagttcataagaaaaacgaactaaatctatggacagaataatgaatgattatgggttacatatatacattctgtcttttcagcggtttgatcgacgctctgctgcatatgagcatgtctctctccctgctgcggcaggatgtcgacatggaaatcccgggtgaggccgccggacgatgatcggtgcagcatcttcatcgccggcatgcgtgcgtcttccaacgactccctggggctcactgcatatgcaatgcagttcagacttttgctgcttaatttgcaccgagtgcatatgcatgatgcaacggagatcgagatcgatgataagaaagaaagtgagaggaggaagaagaagaagaagaagaagaagagatgaagaagaacatacgggtggagaagacggtggcgtcggggcgggaggagaggaggaaggtgagggagatgaggaagcagccgacgacgatggtcagcagcctgaacctctgcgactcgaaccgcagggcgtgcagccgcccgctgctcccccccggcttcatggcttcagctaccttcttcttcttcttcttcttcctctcttgctaatggcggcttagctctgcatgcctcctctcgtcgtcaggctaagctagcaagctagaaagtggaagcttctgtgcacaagcaaaatggaaggcagagacgatcgggttatattcttctctctctctctttcagttccctgcttgcttgtctgtcagatcgactatgcctgtgccgttgggttggtgcagtgcagtgcacctccgatattgtcaagcaaattcgagcttcttctcgtgcgtgaattggacaactgaacctggcactcgctctctgcgacgtatatgaattgaaagagctagctttgatgtgctagcattaccgaaccatgcatacttactatactgatctacttacattggatgacctccttcggtcatcccccccaaaaaaaaaaaactatactgatctactacttctttctgccttacttttttttccctagttcttttaacgaatttgccgggtcatgcaagtttgtaggacgtgtttgtggaggtccatgttcttcaattcaccgtgcgatatattccatctcctagatattcttgaattttctaattcatgcagctgatgggggtgtgctgtacgtggatggcacgcaaaaaagaagaagattggtcttattcagattcagaaccattaattttgagtttttgactactcagactccattgcaaaactagtactgatgattgatttcttcagcatcagactccatgcatgttaccttggtcaagtgattgatgggtgtatatacatgtacatactgagatatataatcaatgtgcagcacggcatggacagttggagatcaacagcgaatcatagggtcgtctacagaaacatatgctactatcattgaagaatatggagttcaataatggattcaagttaatgactcctacctatataggagtatctattgtaactgtgctttgtcccatgtgattaatttttctcaactaatactagcagtggtatgatactgtagtatatcattccctccaccaactccctagcgctgtttctttcagacgatcgagcttatatcattcgttcacggatggatgatgccaccaaatacatgcatttcatatggttcacggcaattttgtattgaacaaagtaacacaaagttgaattgatcacaaattaaatcgatggtctattcatgtagtatatgttattcaagaaactctgtacacgtttcttgcactattctttgtctgaaggatcctgaaacatttgtagttttgcaagcacctttgtactgactgaaaatgggatactgctagtttttttttttttccaatgcgcaaaataattacacttcaatacattaaaaaggaaaaaaaggaaaaaagagttttttttacacaacgcaatcagccaaacaggcctatactaggggaaggaagaaaaagcaaaccaaaaaccgtaactaggaaaaaagaaaaactactacgggagctaaacacaactccgataagtgggaggaggggaagagccacactacactccaaaaaaaaccccaaaaacagcaacgccagcaaaagactatagacagccatccgagaggatagactatagaaccacgggcaccgaagagagcatcgagtttcgttccttacacaactgccaagagatcaggggtactgctagttagcacagtgctatatcagtatggcataacttcagatagatataattaaggtttcacttgctagtaaaaatcacaaagaagagaattaacgggaggcaacaaggagacatccgaagcttccaatacatccaaatctaacagaaaaaaaaaagaaaaagaaaaggggcatacaaagaactctgatgaaaagaagattccaaaacgtccacagatgatggtttggcatatcaagaaaaagtccagagagcgtcaggacaggcacgtttcagggttgacatgctcccacatgacatgatccgtcgatcctgcagccacggaattaattaatcataaaatgcccggaaatgcaaccataaactaattattaaagctaaatatttgagaacttttacggtacaatatactaacagtatatactgcaagtatttacaagggtattataggaatatgctaaaaaaatgtaagggcaatttagtaattctcttttcagatcaatccctatctgttgatgccgtcgtgcgagtgagagggagagatgagccctaccggcggcagaattcctcggtgtccctcttcccgccatctccctgtggtggcatggccacatgcagtcccgcatactggcggcaagccagccggcaacgcagtgccctctgccgagccggagttagaattaaacaccatgcgcactctacaagcatacgccctgatctgtgcataaaaatgcatacatgtgcagtctacagatgtctgttatttactctttaccctcttcttcgttcatgcaatctgcaagaggggtcatgttgttacaaatactctatgccattttaatctgaagatggcaatggtatagggagtgggggagctagccagctaggtccggcaacccgagctcggtgctcgggctgtaccgtctaccaacatacagcaatcttaagcagggtagccgcatgtactacttaatcaccattaattcctttaattaatacgcttaatctacatcttccaaacatccaatgaacatcatatcaacaatgcaaactaggaaattaatcaatatctgacagcctcacaccggtgcacctttgcctgggtgaatgacgggcatggggaatcactattggatcttgcgaggaacacctagtagtgtgcttgtctgctggaattaacggaattgccccagcgcaataaaatagaaagacaaatatgccatttttaattttatactgtaagtggtaagtggtaagtaaatcaatctacaccgttagatcatttatattggcagtatatactagtagtatattgtaccgtaaaagttctcaaatattttccagggagcgtagctacctgcatcttaatcagctgcagttcagtcgagttcatgcctaagtttttttttatggatcaactaattaatttccagaacagaacaaagcctagcttaatatgctggttttgccattttcatgctaaaaaaaatgcctatgacacatgccttgccgtgaccgattgacaatacttaattgcctttgccttgccatgagtgattgacaatgattctttcttgtacagcagcgatggatagtgacggagcactaacctgtaaacactattacatagtgctagtctgcaaataagaacagggagcacaacttcacttctacgcagcagatatgcatatatgtatactgattgatgaacctttgcccatagaaatatagaatacatgcatacagcacaagaatctcccaaatactgttgtctgatttgtattgagcggttggaggcatatgcagacagatgatgtgctagccatttatgcagcaccactaatgaattctacatttctactacttttgatactctcttccaacttataattgtcatcttttgtcccactacaaattattttcttgtacacgtacgtatgcaaccattctttaatttacatcaatcacatataagcagccatggcatgtgtgtaataatatcacctccgattacgaagcatgcatgcatgttgtcctagaatgcatagagacgaaaattgttggttaaatatattgtcacggaaatggatccacatataacgtcacaagttttctaattagtatttcaataattatatatatgtactgcatcaattgtccaaagcaatgccttactgatttgggggagaaaccacaactattttcattaaattaattgggtatgaaattaacaactactatatcattaccctttttttagaaactatatatattcttattactgttgatatcatctggtatcacacatataaaattgggattggacattaacaaactatatattgactgactgatcaatgcaaggagatgagaatccaaaaaccagaatttggaaagtgtttggtgggacattccattgatcaatcatttgcaacggttgatacgtactacgtacccgtggcgctacagtggctccatatattttttttttggcagattcgttggttgcaattgcatgcacaacgtgccggacacaatatactctctccatttcaaattgtttggcaccgttgactttttagcatatgtttgaccgttcgtcttattcaaaaaaaatttgtgaaatatgtaaaactatatgtatacatgaaagtatatttaacaatgaatcaaatgatatgaaaagaataaataattacttaaattttttaaataagacgaatggtcaaacacgtactgaaaagtcaacggtgtcaaatattttgaaacggatggagtatatttgtatcgttctgtgctgtacgtatctgtctaaaataacccattgacctcacaaccgatatggtgtgtgtgtataacaatcctgtatgttacttctagtatacctcaccatgcatgcatatattgtgtttcctagctatacattatttcactaaacaatgcaggccaggtacgtatgcctgttcaaatgctgtaatttatttttaaatatttataaaagtatatttgagttttcaagttttatgtttctatactcgataacgccctttaggatggttttttatattaaaaaagcaccatctaaaatgcattttttttcatgtggaaaacactagttagtcgcgccaatgggcatgcagcaattttgcatgcagtccccttatcactctccgagagggtgtttttttcgacccgactaagggatcgtttgatttggcgctcgataaactcaccccatgttatcagttccaacacatgagaacatgaagaggccacgtttaatgaagtcgttccaattctttcatgacagagataatttgcaatcaataaactcatctcagtttatcagattgaacacatgggaacatgaagaagtcgcacttaatgaagttgttcggctatatttgcgcacatgtttcatccaacgagttgggacagcttcactcagcatgactctttgttcccatgtgttcgatctgataaaatgagatgagtttatccagcgctaaatctaacaactctctagcctggtaaagaaacacccccttagaggcaacagtagggttgcttgcaaaattgccatccgcccagcggtcaccccgttagcacgagctgatgatcgtttgccacatcataaaaaaaatccctccggtaggttgtctttttttttaaaaaaaaacacctaggcagtttttgaataatgggaaaggaaaatgattttccacccaacaaaagacatctttaaatcctaaccgttcattatctctcttccatttaatcctatcccttcatttattttttaatcccaatccttcccccgttttccattatccaaacacactggaaggcgttgagggcatagatttattgaatttgaaaaccagactataatggccgcacaaaatccaatcgtaatcctgttatggccgcccaaccaacatgggtcgcacgtaagtcgatatcccgtttcggcccaactataatgggccgaacgtaattcatattccccttcttgggacgcacgggatcgcaagcccgttaactcccaactactatagggggggcctaatacgcgactagtcgcgcgccccccaggcgcgcgatcagtagtactagtactactactagtccagtactagtactattactatactactattactacactattgttgttatactactactagtattactactataaaaaatatatatatttttgatgtataaaaaaatatacacgtatacaaactttgtatacgatgtgtacaaactttatatacgatgtatacaaactttgtatatgatgtgtataaactttgtataggatatatacaaactttatatacgtacgtattaaaaaaataaaaacgcgaaaatacatcgcatatacaaagtttgtataggcgtatacaaactttacatacgcgtatacaaactttacatacgcatatacaaactttgcatacatacgaatacaaacttatatattcatgcatctttaaaaataaacgggaaaacaaccactgaagagaaaccggaaaaaaaaagaaaaaacaaaccgaaaagaaacgagaaaaagggagaaaaaaaaaggggaaaaaaagaaaccaaacaaccgaacagaaacgacaaaaaaaaaacggaaaactcgctactccctcctcctctcgcgcggcgcgtccgccgcccctctccgcgcgtgacacgtgggcgcgcgcgactgatcgccgaatagctttttcgactactatagacatcatgtaagttacataggcccaacacaaatgggacccaggagcccagtatcctggttgtagttgggcctccaagatgggcccaatgagacaaaccgacgacctatcgtgtttgggccgttgggtgtttctggcccaactcgcttcccgctggaatgaagaaatactcttccacttcttttcaagaatcagaaaaaaaaatgagcgacgttgtaattgatctccactagtccactacaatcatcaggaacaaaagcatatgtgtatcttccactgacgccatgcagctctgtacaaggtagtacaaattacaaaagtacagagtgtatatgtatcccagtatatataagaactaaacttatatatgtcaggtaaaaaaatgaattaatcagcaaagaatgagctactatatatgtatagacccctaaaaaaagggaatncaagaatgaaaaaagaaaaaaaatgttcagtataactagtatagcgagctagtcttgaagaagatcaagcacacgcagaagcgtaggcctgaaccttcgcaggttgagcttgacatcgtgcgtcatgacgatgtcagcgagcgccttccacccctggccatggatggccatggggtccctgaacacggcgtgctccctcgggtacctcctcgccaggttgctctcctccgccgccacgtggtactccacgtacatgagctccatggccgccgccggcgcgccgtagaagttggtcgccatccactccatcctcccccacggcacgatctgcaccaccacgccgccccgggggaggaacgcctggttcgtcagcccggcgccgtggacgcccaccagcacgtcgcacgagttcaccgccgacgcgaacctcttcacgccgccgctgccgccgccgacgccggcctcggagaccaccacctcgaatcccagctccctcgccatggccgccacctgccgtaggttcagcagcttcctcgtccgccgccgcgatatgatcagcatcctcggcttcttgccgctcgtctcgccgagcaccatgggcttgtccctcttcagcccgtacgcgtggcgcaagaacctcgtgaagtcgaccatggtgtaccccttggggttcctcgtcggatgctgcccaaggatcaggtccctgtctctcaccaagcccacgatcacatgatcgaagcaatggacatcgccgtcggagtcgaaatcgacgacggctcgatgcgaaagccgccggagcaccggcttgtacttctgaatccaccattgcttgtagtttgcaacgaacagctgtaccttccctttgaaatggaaggtggtgaggtacagaggcaccagcacgtctgccatgtcatggaagaagttgccggtgtagccgccgatggagaagatgaccgcggggacgccatggctgacattgcagctgggagcatcgccttcacttgcagctgatgtgatggccacttctctgacaagaggtagcaggaagtcgtcccggcgtgcatatggcctgatgcgccgcgccgctgcctccccttgctgcaatggcatggtcagggtaaccgaggaggtcgccggagaaactcgaacgtcgccggacaggtggcagacgattggccttgcataagggaagccttcatctttactcttatcatcacaacttatcttactcttaggctttggaacttcactctctgaaactgctggaacagaagggaaaaaaattcagagatagaattggccagtatacttctatggctgattttactggggatttaatcatgtactaggaactattgagtgtatcaagaaatctctgaaactgctggaaaagaggggggaaaacagaaatgaatttggccagttttctatgctgattttactgagaaattaattaactaggcataaaataagtgcatcaagaaatcttttgtattattgttgttaactctaacctgtctgtggtgattttgtcaaagattcttcctttccaggagggggatcattctctgtagagattgcaacctgtctctctgatcttgatttattctctgaatctgtcccattcttaaaattttcatttttaaacacggaacctgcagagcattttgaatttgtaaagatttttttaaataaaatacaacctctccctcacctcaactaaaaaacaatgcaagaatcctttattggcaccctaatcattaactgaaagaaaatttagcagattgtcactaacacatgctaacaagtagtaataagcagcattttgaaaagatcgttgatgatacatatgttgatgcttctacaagaatctacaagctgtttcacacttttcagataatggaagcaaaacaaagttgttcacttgcatgatgattgtggaatatgttcttgcactttgccatcatattctagtctttaaattgttgtaggatgttcgctcagtacatcgcactagtacattggtacatatttttatgaatttccactcatctagaacacaaagaacaagaatcattagctcatcacctagaacaagaagggaacagataattatcttattaccttgtttccccttcaaaattagcattgggtaagacaacggtttccagtgacaaaacccaaggcctttgcaagtttcaacaagaaaagtaactactctagaaacagcaagtacaaagacaattactactcctaaatatcattgaaatgagccaactaattgcatgcataattgagggccatccatatatgatcaaatcaattatagaactgcaaggggacccaatcagaaaatcccaaacctagaaaaagcacaatgtggtagtagtactagtacagtagtactttggcttgcattgcccctgaacctgatgcaactggactagtgttggcgtggtccaggacactgatgccactcacaaaacatgcagtgatctggatgaacagtgcaaatggggggggggatgcatgcatcagctggagcacgagatagatgattcttgttccagctcatttgctcacctaattccggcgatcttgtcgaaatatcttcatcgaccctgcccataatcagaggagcaacaggaattcgaggtacattcgtactggcgctgccttcccaagaactcaccatcctgctcctggttccaatccctgaatatatatatacaattcagaaaaaaagaacagcaaagtaagatcaaattggagcgaaatggaagagcagaattcgagaaatccaagaaagaactgaagagagcagcagtcttttagtctccttacttacgctgggattgagacgagagagaggagaagaacttgacgacgcagaggcagataagcagggcgaggaggcacgccggaaaaagcctgacgacggcgaggtgcctgccgggctcgaccttgctcaggttcttggcagccgccgccgcggccctcccgttgctgtgcctcggcttcctctccctcgccgccgccttcatggcgacggctctgccgccaccgtgctgctgcgccacgaaggctctggccgcgcgctcctgcagctcagctgcggcgtggtctggtctgattcagttgaagaggagacagtggagtcgtcaggaggagtggagtgtggcgctgcagctggtgcgacatgtgaggggagtagactaggttgcagtgcagggtggaaagtggccattattagcatttgctttgctgcattagtttcattaat

SEQ ID NO: 4291 - DNA, 6369 bp, Oryza sativa
ctagactactagtacatgaagagagaattgctgctatcattggtgaatggtgatgtctgatctatggcttattcggaccggaggaatttcacggggaattttgatggaaccgaactgtttcatgtaaaattcctgcatttcaagaagctcttaggtgttctttctgttggattaggactattatgaaatgatggttatgcaacttggacatgcgaatggatcatacagtatgctgcgacgagtcattagtgtcagtgaatccagcaggataggagtacttcgatcgcaggacgtcgagtgggactactcccaaatactgtagggcttcgtcactgaaatcaaaatcgattttctctgaatccagagacctaccaccgacacgccgacgccggtgagacgagtaaattcagacaaggattagttacttgtaacagcttcaatttaataagcttggatttgcacgtacagttgaaaggcaactgcacagtggccacccatgtggcagttgggcaacatgaacacgagattgagcttcttcaacaattaatattataaaccctttttgacttttaacctattcaaatattttaattttttaaagatttaattaagtttataaaaaaatatagtagcatttttaacacaaaacaaatatatcatcaaaatatatttaatggtaaatttaataaaattaatttagtatttttgctaaattattctataaacttgatcaaattcaataaaatttgactttgaaaaaattgaagtaaaacggaggaagtagtgagtattataccgaagcttctctcttcatttgtactcctactttactattctcttccatgttcacaatcacaagcttgctgaaagccgccgctgtatttgatttgaagaaggtgtgttctatgggcgcatgtgagatgctggatgatactgttgctgctgcatcggtatacaagacgagagcaaaattccaaatgcatcttccttcctactaccatcatcctatcctatccctacattttactagtaccttaccttctcccctccctccctgacaaactgaaaagctagcctctatacattcagaccgttgttcacggggacgagaccagccagtggttggtgtacgccactctctctctatctctctgcatatctgccaacaaatctgtacagctgtggttataaaacttaaaaactgttcatccaagaaaattgctccccttcaagatggaaaaccataaggagggagtacatttgagaatttcaatactgatcatatataaaccactcaccttacataacaatctgcaagaaaatgttcttttgcctaattgccagcagatgaacatgcatgatttgtactgcattctgaatatgcactccagttgggtatatgatatatccaatcagtacatatcatcatataatatattttttagataatgagagatcaccatatgatagaaactagtattaagtataagagtcggtttcaattttgaagtagagttggatttattaatggcaccggcggtttctgcaagttcccgccgtttgcatcgttgtcatgttcctgtttgccaatgttgccttgcttgcttgcacgtatctgctactactcacctgccattccggctggccttgcatcgctccatcacattacaacctgttcgttcctcctctcgttgttgacatcacaggtcaaagttggcgacggctactcctctcctaccggcccaagaacaatcccatgtgggcccaatcatacgtgggcttgttgtctcggcccatggattgaatattactatattgtttttttatggaattattaatatattgtttatattgtttagaggaaacctggcattttgtgtgttagtgacaggtgagaaggaggcggcggttagttgcgcaactgaaccgacgactcatcagtttctgttggacaaccaaactctaccaacctctgctacttgtttacaacaacaacacactcaatgcaaatctgtcatctctaacaacgacatgtgcatatgtgctacacaatgtacttgtacaatttctagtagttgttgggtattctaattgtactttttttaaaaaaaaaatgaacacttatttgatcgagttgaaactagagatcaccaaatgcgaacacaattcagtgctaataatgaatcgatttcgttccattccatcctccattatgtgcatcaaagggaatacaaagagaagtagtataatgtaactgtaatcctgatcaaataatcgatcgatttcttttttctgtgaaagaactcgaaagaatagaaagcaaaaaaaaaaaagcatagagaacgaaaatgaaaatgttgcagctaggcattcaaaaaaaaaaaaatgttgcagctagtagctaattacagtagtctttgtggatggagctcgcctctactggtgtttgaggtaatccatggcgtcgcggaggaggggctcgaagcgggcgagatcgaggcggatgtcctgcttgccgaggtagtactcggcgaccttcccccacccgctccggtggaccgactccgggtcgcgcaccgccgggtggtcgcgccccagcgtctccaccagcgtgctctcctccacgccggcggagtacgccatgtacttgagcctcatgtcctccgccggatcgccgaagtccaccttcccgatgtgctccatcttcccgtacggcaccacctggatcagcaccgcccccgtcggcaggaacaccgagttcgtcagccccgcgccatggacgcccatcagcacgtccgcgcggttcacctccttggcgaactcgccgacgtccacgttgaacggcgggtcgccgatcaccacctcgaacccgatccgctccgccgcccgcaccacctcctccacgttcatcagcttccgcgggtgccgccgcgagatgatcatcaaccgcggcctcaccgccgcggcattgtcgacgaggctcaccggcgcgtcgcgcggcaacgagaaggtgtcgcggaggaacttggtgaactccggcatggagtggcccgtgggatcccgcgccgggtcgatgctgaactccttgtgcatccggatgccgaccaccgcgccggggaagcaccggaccttgtcgtccctgtccatgtcgacgatgtcgtggcgcgacagccggtccaggacgcgcttgtacttgcccacgtaccacatctggatgttctccacaacgagctgcacctcgccgtcgaaccgccgcgcctgcaggtacagcgggatgagcacgtcggagaagtcgtgccagtagttgcccgtcagcccgcccatggcgaacaccagcgccggcaccggcgaccgcacgtcgcacgccggcgcctccgccgccgacgccacctcccgcaccgccacctccttgagcccgcccatgtgcttccgcgagtagggcacgacgcgccactcccgcgggttcgggttgctgccgccgccctcgatcggcggcgggatcacgacgtcgtgcgccgcgccgtggatgcgcacgtcgccgtcgatgctgcacacgtcggacgcccatggcccctggatgtcgcacgccggcttcttcgccggcgcgctctcctccaccgtggtggtgacgtcatctgcatcgaccaaggaaaaaaaaaacaacaattgctttaactttttatatttcttttgttctgattctcacaaggcaaaatatgcatcgaacacgtctctgctgctttccatttcagaaaaagattgaaggaatgaactttaggttggattttgcacaaaactaatcaaagatttgtactttatatttcataaatgattcgcaagtagggggagaaaagtaccagtgggcttctccttggtgtggtcctcttctgtttctttctgtatctctatctcttcagctgacggggtcttctcctgtaccaccgctgcatgctcatgctctgcctttggtgcttgccgctgctctgctccatgcaaaaggataaaaaagtgttagagatttagaagcgaaattcggatggattttggttgaattagtaagggaaatttgattttggtttgatgaaaatgattggaataatcacaggttaattaattagttggttggatgatcgatcagtttacctatgatagggggcagctgtggcctcttctcttccacaggcggggggatcgtcggggaggcgtgtcccggtgatgttttccgaattgctgcatcatgtgcagttcaatttgatcagtttcagtgtttaaatttcttttaaaaagtctgaatattgtaaggtgatgcactgaaaataagttgggagcttggattcaggatggtgatcggtgccctgattttgcggttacgtgcagaaacaagcaaacgcgtgcttagaatcccgacgaattccgcatgtattacatactcgtttgattcagaattattcaaaaaaaaatcctcgaaaaagtgatcccgattaaccatgtaatcaaaaagttttggtctgaatcatgcaggaagaatcaaaagaaaacctataaaactgcaccataattcagaattcagaaaacttgcaaatttttttttgctgaattatgctcaatcatgaaccaaatgaaactcaccgttgggtgcagcgatcgcgaactgctcggagacggtgaagtatgtgaggagaacaaggaagaagccgagcaagaagccgacgccgagatacttctgagctgcacccttcaagctcttcatgagcttcccatgatcgcctcccatctctcctccctctcctctctctctgaatgtctgaatccttcctactctttgcagctctactctttctcgtgataaatatgtgtgtgtgattgcctgcctatgcaggtatcctagagacaccaactccctgacatgggagatggagaaccttccaagaactcttctcttctcttctcctcaatagaccagttcttgatgatgtcctttatgcctggctgctctcaggaggacttagccaaactccaactctccctcgtgattgctacctctaatttactatattttccctgtataatgacgacaattatcatgcagtagttagcttaaacgtgcatcgtttgtaaggtgcaatttttttttttttggaatacacctttttttgactagctattggaggctaatttcgggaataaaaaattatagttatttggagtagttggcagaaggatttgtaaaatcctagttaagttttgtgtacatgattgggtaggaggtggcatgtgagagaaaaagaacaagtcttatgtgagctaggaatgaatgattgatggattatggatgtaaggtgtagaactaactaggtcaaatgcatggaatatttggttggaattggatgttccagtagaactcatgagctgtcagagcatgtcatcaagggccccataccttgcctaattcagaacctacattgcatttttcttgtgtacacactctctatttctttttttttgtttgggtataattcacatttacttataaatacaagttccttttggtttatactccctccatccaaaaatgtttgacgccattgacttttttaaaaatgtttggccgtttgtcttattcaaaaaatttaagtaattattaattcttttcctatcatttgatttattgttaaatatacttttatgtatacatatcgttttatacatttcacaaaaggtttttgaataagacgaatggtcaaacatgtttaaaaaaaccaacggcgtcaaacatttaggaaatgatcgagggagtagtagattatcaattatcgctcgtatgcttctgatgctcctaaacggtatgatatatctgaaaactttcttcatcgatatttgttagagaactttttaaaatcaaccattcaactttgtaatattttaactctttcgtttgttctctccaataattgtcataaactagtgagaatttgatgaatttaagtcggtcggtgtagacacgtacgtacggtatggttgtcaaatgtcaatcctattttcttgtgcctgttctgaaagcaacaagtgtcctgacaaactcgtcactcttgcatagttgcattttcttctttctcttggttaaaaaaaggtcgcattttatcttgaaaattgataaggatatatattgttatattttttttctctatcacaaaatatcactttcagccatgagagcgacggtgctatttgattgctaatttctccagggaagcagatgcaatgtcaccgattatttcattgctcatgataagtgactatggcctactgcaagtatatatatactccctaaaatacatggataatcaacacctttttagatcgagattc

SEQ ID NO: 4292 - DNA, 2788 bp, Oryza sativa
  unsure (1)..(2788): unsure at all n locations
nnnnnnnnnnnnnnnnnnnnnnnnnnnnnnnnnnnnnnnttgtcataaactagtgagaatttgatgaatttaagtcggtcggtgtagacacgtacgtacggtatggttgtcaaatgtcaatcctattttcttgtgcctgttctgaaagcaacaagtgtcctgacaaactcgtcactcttgcatagttgcattttcttctttctcttggttaaaaaaaggtcgcattttatcttgaaaattgataaggatatatattgttatattttttttctctatcacaaaatatcactttcagccatgagagcgacggtgctatttgattgctaatttctccagggaagcagatgcaatgtcaccgattatttcattgctcatgataggtgactatggcctactgcaagtatatatatactccctaaaatacatggataatcaacacctttttagatcgagattcctcttgatgataatcatgatcaatgaactgaacactacgctgaaatggagttgcctgcattgatgggcctcccattctctgaattctggtgcttatttttttcaagaactttctatgatgcttgttaaggagtagctctcaatgaactgttccgatcttctcggtgcaatgcagtacaactacagtgcatgcacggcagctctcaatattaatttgtgctactgtttagattttattctctgatcaagcaccgtcagttcagaagcgatggatacctgcattggccatcctggactccaatatttttcatgcagcaggtcattttcaggcctgcatccttaatgcaatacggctgccatttgacctgcaactacgcattacaatgggcttctgaactgaacagaaactgatcaggaattctccctggaaattgagagcacaatgcgagtatactatactgcaaaatggccaggagacgtaaacgaaacagagacgacgtgctggcttctttctgtccttgactagtttgccagtaacatgatttcgtccggacacggttatacacaacagtgtataatgtatactattttgtattaattagtggctaattaattataactagcaactacatatactatgtgctacagcctacagattacacgtagtaaagatcatgttagtgtagaacagagtggatgaggtgcgaccaacgactaagacgacgtggctgcagtacatgcgtagctacctaattgactcacctcgctcataaggagtatacatatttcatattaagggtgttgggaacccatctcccatacacggaaaacggaacggtccattaacacgtgattaattaagtattagctatttttttttcagaaatggatcaatatgaatttttttaacaatttttgtatagaaactttttgcaaaaaaacgcatcatttagcagtttgaaaagcgtgcacgcggaaaacgagagggtagcgttggaaacttgctcttgcacacacacccttaaggtggtttggcaacaacttataaacaacaagttctgcatcaacgctttgaagaacaacctcagcaagcttctaatctttccaaatctatttataccgatttttattggaattgaacactcaaattaggatcctgcattgattggtaaaaaacatctaaatgaacctaagccttgatgaatatccatgctttaagtttatgtggaaagaactcagaagggcgaaatctctggacgaaccttgcggaggaaaccctgggttttcgaggcattggattcttaccgatgttttgttactcaagcagacattctcacatccgcttcatcgaccctacttttgtggtggcttccctctaaggtggaacactcccctaccttgcagttgcttccctctaaggcttttgttactccagccaacattctcacttccactttgtcgaccctgcttttgcggttgcttccttttaaggcagaacactcaccaaccgatgtatattgagctattatgtactccctctgttttatattacaagtcgtttgattattttttcctagtcaaacttctccaaatttaaccaagtttataaaaaaagatatagttaaatagatatatttaatatgagatttaatgaaactaatttaatattttatatatggctaatttttttataaacttggtcaaacttaataaagtttgtctaggaaaaaaaatcaaacgacttataatatgaaatggagaaaaataaatatattatcaaaatatatttaatgtgagatttaatgaaactaaattaatattttatttgttgctgactttttttataaacttggtcaaacttaattaaatttgactaggaaaaaagtcaaacaacttaccctccaaaacctcgtagcttagcctagccgacgagcacttatacacactactccacttacactttcattctcgattcttgtaaataaaagggttaatccggaagtgatatggttggagggacaaacccttataaattagttccactcttgctaaactaacgagatggtactacacatgagcacacaaaaaacatgtcctcgtatgaaaacaagctttggttactcggtcagttggtgaaatggtgaatgctgcattgcacaggttacacattgcaggagctctactaacatgaattcggtgacatacatgtactctaccaaatcaatacaatcaatgtgcatgttcatacgctccaccaatgatgatggatatactgagccaaaacaaaaacaaaaaaggatgggttggacattctgtaccaaattgcgaccaa

SEQ ID NO: 4293 - DNA, 33258 bp, Oryza sativa
  unsure (1)..(33258): unsure at all n locations
nnnnnnnnnnnnnnnnnnnnnnnnnnnnnnnnnnnnnnnnnnnnnnnnnnnnatatgagatttaatgaaactaatttaatattttatatatggctaatttttttataaacttggtcaaacttaataaagttggtctaggaaaaaaaatcaaacgacttataatatgaaatggagaaaaataaatatattatcaaaatatatttaatgtgagatttaatgaaactaaattaatattttatttggtgctgactttttttataaacttgggcaaacttaattaaatttgactaggaaaaaagagaaacaacttacccttcaaaacctcgcaagttagcctagccgacgagcacttatacacactactccacttacactttcattctcgattcttgtaaataaaagggttaatccggaagtgatatggttggagggacaaacccttataaattagttccactcttgctaaactaacgagatggtactacacatgagcacacaaaaaacatgtcctcgtatgaaaacaagctttggttactcggtcagttggtgaaatggtgaatgctgcattgcacaggttacacattgcaggagctctactaacatgaattcggtgacatacatgtactctaccaaatcaatacaatcaatgtgcatgttcatacgctccaccaatgatgatggatatactgagccaaaacaaaaacaaaaaaggatgggttgaacattctgtaccaaattgcgaccaatgaggtggtgtatcatatctatcagcaactgtaacatctgtgtcactcactcactcactcactagctatgtgatggtcgaaggtgatcgaagccgccggcgagcgtggcggcaaaccgggcgacgttgatgcggacgtcctgcttgccgaggtagtactcggcgaccttgtcccagccgctccggtgaaccgcctccgggtccttcaccacctggtgctccggccccagcatctccagcagcgtgctctcgtcggcggcgacgctgtactccatgtaccggagccccatgtccgccaccggctcgccgaagtccgccctcgccatccgctccagccgcccgtacggcaccacctggatcaccaccgcccccgccggcaggaacaccgcgttcgtcagcccggcgccgtgcacgcccaccatcgcgtcgaacgcgttcaccttcctcgccacctcctccaccggctcgtcgaaccgcggcgacatcaccgccgcctcgaaccccgccgcctccgccgcgcgcaccacctcgtccatgttcacgatcttccggtagtgcgcgcgccggatcaccaccagccgcggccgcctcgcgcccgccgccgcggcgcgggggagcgcgtaggtgtcgcggaggaacgcggcgaagtccgccatcgtcagccgctgcccgcccggcgccagctccggcttcacgctgaactccttgtgcatgcggagcccgacggcgacgcggcggaagcaccggacctccgtgtcgcggtcgaggtcgacggcgtcgtaccgcgacagccgccgcacgacggcctcgtacttgcccagccaccatggctggatgttgctgaccaggaactggacctcgccgccgtaccgccgcgacgccacgaacagcggcaccagcacgtcgctgaagtcgtgccagtagttgccggtcaggccgccgagcgcgaacacgacgccgggcacgccgtgggtcaccgtgcacgccggcgcggcggcccggtcctgctgccgcgtcacggtcacctccgcgatgccggacacggtcctgcgcgggtacggctggatcttccactcgcggcggcgctccgaccggcggctcgccggaacaagggtcacggagagagccgtgccgttgatccggacgtcgccgtcgacgtcgcaggtgtcggagtagaacccgttcgagccgcacactaccttgccgttctctgttgcaccaaaaacagaaaaaaaattgattcatcgaggtttattagctcatttattaattaatcagttaaacgatcattaatttgcaaacagagagtaattagttcaactcatttattgctcattgatctaattaagtagagtattcatgtttgggtccaattggtctgtttttagatgatctttctaatggaaagtgaaaagcatggctttgcctttaatttgacagtaacattacaatgctagtaaaacccatgaatagtactagtaagtacagaagctatttggaatatagttgggcccacatgtcaacggcagtcaagagtagtattctgagaacatccatcatgttaatgcacaaatttgtaattttgtaaagaaaacaacaaacgttcatgcaaaattccaaatactagtactttcccaaacgtcctccaaagcttataatccaataaagtcatactctcaacataaatgaatgaatgcagttcgttgaaaaaaaatgaatggatgtactatattcacataaataaataaatgaaagcaattataatcagaaaccaacaaaatgtcactttgatctctaaataagaacataaaatcactttgtttttgggaacaaatattttgtgcttaccaatcggtttggcatttgtcgagtctcttttggagaactcttctgctgagacggcaccagacgtgtcctttggccgctgccactcctgctccctcttcttctctgcatttgccgaaagaattcacgtcagaaatgaatcggaacaccaatgtgaaaataatactagcatgcaaaatttgcaaacaaacagaagtaagtaaacgtttgtgcttggactgatcgatgcaatctgttagtaaaattggctgatcatgatcagtattaacaaagtatatcactgtattgatcagaagcttcttgaggtttcgtctcgatcttttcccagatttaattgatcgtcttccatccctaagtgtaccatgatccgatcgaacgaaattaaatactcctagtcccatcggagacacggttcgctcctcccaacatgttgacttcgatctcatccatgatccatcatctccgtttcttcttctcacgatgacttttgtgttcttagactgatgaagcagtcaagaaaaacacgatcaagatgacagaaatcctgtgctttctcacctgtttcaacgcgagccttggtcaccgactcattctcgtcaatcctcggcgccctgctagtgacagctgcaggagaaacattcagcaagaagcaagaacagatcagttcatggacaaaatgatgatgaccgacgacgacaacaacagaacagaatgatctttgtgcaaagaaagaagcttcttgcaatggaagagtacgtgatgatggttaggttacctgtgggagtttccatggcgaactgctgcgagacgatgacgtaggtgaggaggacgaggaggaagccggcgaagaagccggcgttgaggtgtcgccggaggccaagcttcgccggcttcacctcgctgcccatctctcctctctatctatctctgtctcctctactattcactcgtgctagtgtatatatattctgaacccaactctgaatctctctgaagaaggattgaattgttcaaggttttgggtcgttcgagaattgcaccgagctgcctccttttcctctcttttcttgcttgtttacatggagcatgaagaaaactatgcaaaaagaaagcgagagaaagagagagaaatggagtggtgtacttggatttctccaagcttagccagctcgcttttgtagagtttgcatatcagcatcaacttgctgttttgttaagcatactaatccatccatcagattctgattttgcagttacaccccccttcacatggtacgaaattccttttttttttttgctcgtgttgggtgcagatcagggtggactagcatgttaaactagtgttagtaacactaatcaactaattatctatagtaattaagtaattattaagtgtgcaaatggtggttgaccagtgactctctctgagagttctgattgggcctgataatcagaagacagcaggctggcattatttcattaactgaatgaaacagggtgaatttatttaacctttttattttgtttttcgcctaatctgacgccgatggatcgagttcgttcacatgcacgttgtttggtccgcgtaacatcccctttgattaacaagccccaaaaggtatcacagtttttttaaggactggctgctaatcaaggctcaatgtggaactgatgtttttcagatatgcattatagaatgtgtacaattaaaattttaaaatttcaaagataatgcaaatattaatatctgtcacatatagccacttcatgatgtattctgatgtggagctcttaatttccacaagttaaatacaattaaaaacagtcatgagccttgctagcatccagctaagaacacatgaacacccaagtctactagctagcttacccataagcaagccatatgcgtgttgccgttttgaacaagacgtggtatcacaatcaagtcgatttcgtgtcaggttgtcctcatcagggcaaacagaccaagttcttcatcgatttgtacagatcatgcacgcatgcaatggtttcttcaattcatcttttagatcaaccacccaacacccggtcgatctatttaattagctatacatttctagaatcattaacttctaacgtgaacacctctcacaaggcatgttctccccccatgtctaatcatttcttcatatagctccaaccaacatggtggcaactatcttgatcatcattgttgcaaacaaagtctgatcagctttttggaaaccatgtgtatactgtattacctagaagaaagcgattgtaatcgaaaaaaataaaaataggggggggggggggggtgtgtcatttctgcatttgactctgatatatttatatctgagtgtactgtctgaaaagtaacagaaattcagaaagaggcaaattataagctgcagattattattttgtgtctctcttcctgcattctccataaggtgataattaagggtttgaatgtgatttcaacaatgcaaggtgcatttctgcagaagcacatcacatcctaatcctcaagtgatcagtttcagacttcagtacagtacatgcatcccatgattgcatgattgtgagcgcatccaatctgtagtttattggttaatcatctctgtaggcctgggtggtagctagcccatggatccaactgttcaagtttaaacacatctggagactactagctagggaccagttccttaattgcaatcagtaaaataattaatcctaattgagtttcctttttattactgcttggatggaatcatggcacgtatagtggcagtactgcagcagtagaatattatggtcactgagtggtcaacaccaccggcagaagctcggctttaacattgaccatttttagtttcttctcaccctagcaatgttgttactctctcatgtttcctaattaattatactatcaggctgcagcattgttggcgatggaattgcatccttctgatctgttttgtctggatgcatggctcacgtgagagttcagagttcctcattttattttggatggcagaggtataaataagttgtgttaaaacaccgatggcattctgtctgccaaagaaaagtaaacaagatttgtcagttaaatgtacagtaaacagacttgttttatctccataaaagtactcatgatgatctcaaattcacaagtgctgctgaatcacacttgattttcttaattttggtatgtgtacaaaaaaaatacagtacagtttggtctcttttttttttttgacataagaaggtagagccagctttaccttatagccatttcattgatataaatggacggttacaaagttacatgacgagtagaaaaaagagagggagagaaaaaaggaaaaggagaaagaatttggtcttgttgatatctagctcgtgatctgtttttttttttcgggaatacacaataaacacatctttgtattaagagaagtaaagtttatttacagtgtagcctttaaatggaaaaaaggggaaggggacagggtacaggatcggacctagagaactaaggcctaatctcccactagattttgcgaccgccaagccatgctaggcagaggtagttcaggcactgtgagatgtagctcgtgatctgtgagatggcaaagaagactcacacgttgctagctagagtagcttggggacttgtggtagctaaatgctagtactccagcgagccaatctagtgactaatatcagagttcagactaaagacaaaggtacaaagctcatggggttattggttaagagtagtagtataagcaaatttgtgaaacgaagtcgagatccgagccgcagtggagcacctgattcagatgtacattacttgaaaaagaaaaaatgcagtcatgaacggtctctggatgctgtgaccgatccagattggagttaacttactgcaacttgcaatatggagcagtagtaattaaaggttagccctgaagagagtcaactccactcagtaataaattgttggtaattggaagctactgctaattagcttcttctgtgcaaaggccatatggatcggcttgtgagttgtgacatggacagaaagagaaaaagagcacataggtaccaacttggaacacctgagtaactgggctgagcatagagctgagtcgttgaccaatgcatggatctcatcttgttttccaaatactagtaggtagtgcaaactccactggcgacaggattaggacatgctgggtgaacagtttggcagcctaattatgaaatgaatggggactgactgcaatttactctcttagattagtcagtgcggagatggagagaaactcagaaaaggaagcccatgagtgaaaactaaaaaagtgagaagttagaattactagtatagctttatttccttatttttagatgttagtgaatttctatactgccgcatactactgtactggtatatctgaatttctgaagaccggtatacgaacgtaacgaacctctgaacttccaagttggacggagcacctgaatacggagactggatgggcccagtctagatcgtattcagtgttggaacccagtagcttacatgggccggactggatctataacgagcagggcaattgcgttggacggatcgggccactagaacgagaccttattactgtgggctgaatatgattgtttgcgtgtgatccatataattgctgggccttatctcttaaataagaaaaaaaagagaaaaacctatggtgggcctaatacctagatgcagcccatttaggaatggccagtcccgtccgtactagttcagcacgtttgagaattgaacagatagaaaaaagaacatcgtttttcatgcgcacgattcttgattttttcataaaaaaaagtctatagagaagttgctttaaaaatcatatattaatctatttttttaggtttaaataattaatacttaattagttatgtattaatagtttatctcgtttaatgtttgttctcaatcatccctattcttcttttctcaaacacagaggacgtaggagtgagtattccaggtacgccgctgtaggcggcacggcaggcagcgtcaccacctgcaccattgtttttcaagtactccccacaaaaataaagattaaatacggacatgtaaaagaattatgattatttaagttttaattattttaaatatagttatctaatattttaaagcaacttttatgttgaaagttcttattgtttagcaatttgaaatatgtgttaatgacaactgagataaaatatgtatcttcataaaaaaacgaacataacctcaagcaatacgtagcaaaataagtttgtcttagtttactactatatagtgctccctctatcccaaattgtagaacgtctttttttaaaaaaaatcaaacttggtaacttttgactaataatatggtgctaattttatattagttaggaatataatatataataaattattggtcaaaatatgtcattgaaaacctttaaaaaatatagttttataatttgagacgaagtactgcttttgttcttagctttttcgatcttgagatgaaaattacacaagctgaccaactccaccaaagcctcctaggacgcgagccggttgacccgatcaaattcgtggcgtgatttgctcccattctcgcgccgcgcaacatggatgcaacccatcaactttcaagacgtgcgtgcagcaacgtcatcaattttagcgtttagtttggcagttacaatgccgaccgcccgtttattaatttcttcttccacctccgatcctccccgctgaatgatacggatccatcaaaacggacaaaccgacgcacccgacctactccctccattctaaagaaactccttctaatacaataaatctggacgaaatgcatttatcatccattgtgcatgcatcaaataaaaaaaaccaagatttggaggaagagacattcctccaaacattttcgaagaataaattgtgagcgcgttggagattgaacacggaatcttggggttaaaactacacgtctcttaatgcagcactgtcaagagcaacaaatcaaaatgattaacgaacctcctcatatgttgctgtttggcatagtaatacgcgattgttggagaggaacaaaaatttccacgcggccaagactgttgtgctcatatctgaccctgataagctaccaaactcgatcttgacaggccgacatactactatactagtgtgtttatgtctgtgatgatcagccactacaaagtcagacagccatggacacacacaaacacaagcattggtcagagtttggtatccaagaggatcaattctaccaagaaaccaagctgcatgttcctcgggtctgacaatcaaaatgcaccagtctacaaacaaaattcggtagcgttcggcaatgcaaaaaactcatctcaatcaccaatccttcttcttattattattcttcttttagagtttgtagcatgcatgaatcatggcctagtttaactgggtcaaaccgcggcctaacttcactcaacatttgcataattgtgcaggtttattccaagcagcttctgcggcttcaattcacacacatgacttgcagggttggttggttcggatcctgactttctacaactacagtgttccacagtgatggggatggaccagcccaaccccaacacaaaaccgaaccgacactcgattcaattcacacacatggcagatatatggtgatcaacaattggaagcaaagaacaacaagctaatgctcctaagagcaggtacagtagcaggctataagccaggtgcaaacatattttaagtagataaatcaggagagagaagagcagcgggctacagatttgtagccagctatagcacggactccaagacgcagtgtgtctatgacaggtggggctaggtattaatagtgtagtatgtaactattgtatgaataagctattagattggctatagatgaattggagctagtagttggctatactattaaacttgctctaagaaggaagaatctggatggaaaggctggaaagcagacggtccatgctactctgcctgattgccattgcctgcctctctcttctcaattctcatcgctttgcagctccagtccgtccacagattaactttccaagtagtatcaaccttttactatattttactggtcatcacactcactgatcactactcacaatgctagctatagattccttgattgatggccccatgatccctttcaactattttctagcctttcttttgcctgccacctcactctcttcctctacatggctccagcctgccaaatgctgttcagtttaactcttgcacatggaacctcaagattgtcatgctactaggttataagccagcacaaaattaaaagttatcaaccaccttgttacgagtagtaaattgggagtatctgacacgcaaacagattatgcacatttggctgtttgtccatgtgtaggtatcttgcaacaaaggaagatcgtttatgaaagcatggatgcttaaactatttttacagtcgtcgacaaagagcagattccctgcagatcgacagacacgtagtttgcgagatatacttgttaatgcagtgattatctcagtgagatcaaaaactccatacacatggtactgatcctactctatgtactcatcgcacacagattgaaattggcttgtactgggaggaacacatcatcactcttcctatgaaattgtcggtgacaaatctccgattattgatcaaaaaaccaatcagtgaatgaatgaatgactgactgaatatgacggtagcaattgctagctcgatatatcaccatcagctgggccccaaatcgcacatgttgaaaatggccggatgattactgattcgaggacctgtctgactatcttgtttaccagtattactcatgcaacagcctgacagagagtgacagtctcaagtgatcatgcagtagtagtagcactgatactgtatagtattagcaacaaaggtgtatacatatactactattcaaaatcgatcgattcaacaccaatcgatttcgtatgcttgatcaaatgaatgaaataattggtggtccaaagctagcacgcagacatagcgtgagatcatatcgatccccattacacgggccataccatatggtccttagcctgtactaacaattagtactactccagtgtaccagtacaatactgtaatggtatagcgatattgctagtactagatagtagtatcagtcatcttacaatttcttgctattgctattgcttcaccaaccatttggtcgtctgctcctgaacactagtacattaggtgcttagtactaattgctactatgatctgattagcaaaaaccagtacattcgttatggttatcatcagtagtactaactgcaatcttcaattcgtactttggaggtttaagaccattaattattgagtgatctgtaatctttttttttcagatgcattttgcaggtccattagtacgtcttactctgattttttttttttggcaatttggaactcgaggactagctcagcagcaacgtgcaagctgcaactgtgttggagctcacgttcctggtccatggagatggaggccaccgacgattcataccttcaccgttgcttcattgtttgcacgatctcacatgcctttctcaggtttattttatacaatttttcccagcagaaacctagcttggcaggagcatgtgcttggttaaattttagttaagaatgcatgcattaagcatgctgattgctggactagtcctcactgaacagtgaaccctgctccatagattcatcccattgattgatttttaattactatagcagcagtagcaagtggcaagatggtaaacctgacatgtttacatggagcagttcaccaatccatgcaatagaaatgcgagcttaaagaaactttattgtggagtacaaagttttttttttattagaggatgaacaaccataattgaccatccaagaccagttatgaagttactgtagtgttgtccttgcttaattgtccgagcagctaattacatttcgatagaatgagccatctgaattacagtaggagtgtacaactatctatgtacatatgtccttgattctcgtataccatatcatcatgtaatttattaataaagtatcttttttgaccgtacataaataattctatgctgtactataaaagaaaaaaagaagcaaagaacagttgttacattatgagatctggggaaacaaaccataatctaattaagcctcgtacacttttttgggttttggctactataggagtatacatgatcaactcaactaccactcatgaaactcatcttccaatcgagataaaaaaaaaacaaagagatgaatatagtattgctgctgatctcctcctctgaaatatcatacatttggtcgatctgctagctgctacagtctacttttacttactagtgaaaagatagtaaaagaagaagaaaagattaaaagatcaagaagatggtgtacattgatgcatccatggcgatcgatcgaagaaaaattcgaaatggctagttgtgtgtggtgttattgttgccgctgttcttgcggaggtgagcaatggccttcttgaggattggtcggaacctcttcatgtcgagacgaacatcctgcttgtcgaggtaggcttccttgagagaattccagcctttggacttgacgccatcggggtcggtgaagatggggtggtctcgcgggtactgatcgatcagcgtgctctcctccggcgtgatccggtactccaggtaccggagccccatgtccctggacggcccgcggaagtagccggcgacgaactccagcccgcccagcggcaccacctggatcaccacgccgccggtggggaggaacaccatgttcgtcagccccgcgccgtgcacgcccaccatggcgtcgcacgtgttggcgagctccgcgaacggcgccacctcgtgctcgccctccgacaccaccacctcgaacccggcgcgctccgcgcctcgcacgatctcgtcggcgttcacgaaccgccgcgtgcgggcgcgcgcgatcaccaggagacgcggccgccatggccgccgcggctgctgctcgccggacgccgggaacggcgcgtcgcggggcaggcggtaggtggcgcgcatgaagcgggtgaagtccaccatggagtagccgttgggcgcgcgcgacgggtcgatgctgaagtcggcgtggcatgtcaggccgacctggacgtggcggaagcagtggacgcggcggtcgtcgtcgaggttgatgaggtcgtagttggagacggccttgaacaccggcaagaacttgccgagccaccacatctggaagtcggacaccagcagcttcacctcgccggagtactgcctcgccgtcaggaacagcggcaggatgacgtcggtgtacgcgtggaagtagttgccggtgtacccgcggtcggagaacacaagcccggggacgtcgtgccgctccgtgcacgccggcgccgccgcgctcgccgccggggcgggcagcgactgcaccgtcagcacgcggacgtggcgcatggcgttcgggtcggccttgcgcgggtacggcttgatgtgccacgactcggcgcggaacgtgcgctcgtcggcgggccccggcggcgccaccagggagacggtgccgttggcgccggcgacgcggacgtcgccgtcgagctcgcaccagtcgatgcggcggttcgaccagagatcgcacagcggcttccactccttccgccgcggcgccgcctctgaatcttgggaggaccatcaatcaatcaaaccacgttgcatgttaattatgacccagaaatgcagcaagaaagattgtagattcgcaaccaaattaagaacacaaaaaacaatgttgttgtagaccctacgagatgagaaatggtgagatgataatcaaatgaaagacactagaaaatgggggctatcaataagctaaggccatgggatgatgatgctttattactcttaaattgctctcctctcaagaaaggtgaacaaggcacaggatgaaaacaaaaaaaggtggtccagaacagaacagcaagaagaacgttgggccttgcgttgggataggcaagacatcaaaaatgtgtgtccaaaaactagtctccacaatccacattttgcaactactccatgtacatgcctttgctacttgcaacgagaatttgtgctcaaaatctcaaatgtgttctactgtaggtttcaaatgtgtagctaaaaagaccagcagtatgccagtagtacttggcattttcgcaaataaaaaaggcatctttttttagcacaaggaaaacacaaggaaaagtaaggaggaactagatacctgtcttaaccactggaaatgttggaatctgctgaacaggaggaactttggcctctggaacagctggaatttgctgagcaggaggatcctttgcctcttgagtaggaggaatctgctgaacagggagagtagcagggtcggatggaaccacagagggggagctgccattgttgctgctcttctccggagaaggattagtagtagcaggagcagtctcctggactttcagctcctcatcctcaagaactgaccaagaagaagaagaacaaaaaaacagcttgttaaaaatcctgcatttcccatttctgacagaaatgaagaggggggaaaacatctcatcctggttacttcagagaagttcaattggttgtgttttttttttttttacctgaatcctgtgtgatgtttgtgggttcctctgatgacaagggaggaagaacagcaccgacaattgcgtcatcatccttggcaagagcctcatctgtggaagcagacacgcttgcatcaccgctatccttagcaaaagtctcatctttcttcttcccctccaacgctgatgcattgtggcccaaatctaaaggggaaaagaacgaaagaaagaaaacaaatctttttcagattgtctgaactttgcgtgtgagccagtagaagtaccaaagcaacacaccaaattcgaattcgatccatgcgcaagcaaaatgatctgcaaatgattgcgagttggagttgtttacctggccccaaagaggaaatcttgtcgtcgccgtctgtgtcgagcacctgagccttgctcccttccctggacattgcatctcggtccaaatctaagcagggaggagagatgaacaagagacagttcgtcaactcctcgattagtacagcgagtgaacctgtcgggacgaatgaatcgccgcttgctcacctagctgctgctgattggagccgtcagaagaagcgttcataaacccagctgcattcttggctggagagcttactgcaagaatccatggcgacaagagtgagatacacaggtaggcatggagatgcgtgaggaggaggaggaggagatgggcgggcgtactcatggcgatgtggatggcgtcgaacttggcggtggagaagtaggcgcaggtgacgatgaggaacccggcgacgaggccgaggccgaaccggcggggctccacccggctgaggttcttgagcagcttggcgtcctggtggtggtggtggccgccatagctgtaccccgccttgccaccgccctccatggccgccgccgccaccgctctcgacctctcttggcaaacagcacggcacactctctctatatagtaaaactagagctcatgtgtgtgagcgtgagagtgcagcggtgaaggattaactcaccggagcttaagtagagtagataattggagtgctcgtgagcttgcttgcttgggcttggcggtgatggctgaggtggggggagctaggagggtgtcagcatgtgagtgtgaagaagagaaacagaggaggaggtcgtggaggccacctccatttattatttctccttaactcgtggctttctgttcttttccgttttttttctcctctccttttcttttttttcttttcttctcgtcatcttgttttctggcctactccctccgtccaaaaaaaaaaagacaaaccctgggtttccgtgtccaactttgactgtccgtcttatatgaattttttttataatttgtatttttattgttgttagatgataaaacatgattaatattttatgcatgacttgtctttttaattttttttataattttttcaaataagacggacggtcaaacgttagacacagaaaggatttgtcttttttttttacagagggagcaagtacttccgttttttcagtgtgtaaaggatggagaaggctgacttttttttttttgtagtgaacgaaaccgtttcatctcgccggcacacgctttcaaaacctctaatatagagtagcaattaaagatgaaattagccctaatttagtaagtacgaatcagcctgttatttgacctaacctaatgatatgaatttggacaagttaatacgtagtaatctggataggtaatcaatctcatcctagataattacctgcctagtttgtgatagtgttatcccatccttaattgctactacaattctgggatagatgaagtatgtcttaattcttgtagaaactttatatataatattgatttctcataaaattattttaaatctattattaactttatattatttaattaatgtatttgtaccatcaactatttattacaggccatatattcagctattcatccatttagagagaaaaaaataacgcatataaatagtaagggcccctttgaattgcaggattgagaaaacgtaggattttgatagaaatgtaagtgtaaaatagatgattgtaaaacgtagaaaaaacataggaatgaccatttgattgaaccgtaggaaaaacacaggaattagatgagagagatagactcaaagaaaatttagtaagaggttgaagctattcagaccatatattcaactattacagaccatatattcagctattcatccattcagagaaaaaaaaaagaacacacaatagtataaatcaataatgtactgacgaagtaatatgaagtaggggatgcagcgcgcaacttgtggctctgactggatgcatagtttctgcacggcgtgattgattggcaattggcaccgacgagagcatagcagccggatctcacacgcacagtcaagatctgcaactctgagcttctgatgaagttctgaactgatgaattaagattataacaggggaatctctctgctaactagtactgtagttcccatctaatggcctggttgatctctctattaggagtatctgaggatgatgctagtaccatctttccagtgatgagtgattgaatgattggttagtacacatacgcgcccatctgatctgatacggccagcagaatctgcttctgtactgaaatgctgctggtactggttacagattgattacagataattgtcagtgtattgcctcccatagatgactatagtaaattgcagctaatcgtgtgactcatcggtttcactgaaaaagctcataggaaactggctgtctgaaaggcaatgatcagttagttaacacatgcgtgttgcattagtctttgttgggctgatccatccatccacagattacggcggctgaagatgctaaaggaaggagaggctgcctccaaagctgctgcttccttccgtgctttctgtgtccgtttccacatgggtccaactccaacgtaagggaccagatggatcagtcagaggcagcaccacacacaaaaggaagcccatatcttgtgttcttcatcgtcttgcacctcactcaacatcgcccagtgaattcagtatttgagtgatacgataatagctgaattacatgcagattttacaaagttgtgagcaaaattcagttgtaacaagtctgaaatattcttctatctttgtgatgcagtttgttgtttggtccaaattcgtaggagatcgcttctgaatctcagaatctgcattggtgttctcctttcgtggttagcagttgctgtcttatcaacatttccttgctttgcgatgtggtcatcaaaactattctaggaaggagttgatgcatggttctgcaccccgtgaagtcatcactgtccactaaccgttcgttcggttctttgttttcagaagcaacttgtccgaattcagtctgtaaaattttcacaagcagtttgtctgaattcagtatgtgcaacttccctacaaccaatgggcacctacctacccctgtcaacactggcaaagtgctcaaccagctcactagtagattaatccaattacatacagttacagtagtcgttttgcttgcagatttactcaacagctagctttcctggataattaaaaacttgatgtgtcaggagatgacaagcagcaacaagaacaaagaggtataatactgcacagtactgtatactactggtactcatactagtatcatacagtgccattcttggtattcaggcttggtgaatcagagaaaaacaatggaatcaaatcagactagctaggagaagatgattgtgtcactagatatggtaagtaagtacaatagacaagaacaataaatgctgcaaatcgtagcgattcaggaagtggttgctacgtccattcatgaatgatccggtcgcacttgcacatcgccaacatgttgaatcgaatggcatcttgcttgacacttccctttcgttgatctctgaaggactgaaacaagcttgtattaagggcccaatgcataaacaatcgaggcttagtcactaatcaaatcatggcgagaaaaacacattcgcggcgtgccaaaaccacaccaacgacgaaaatgaaggaattggggccaacagctatgcctgaactatgcatggctgctggctggtttatcgggcacaagagaacaagtgtttttttatcttaataggaagaaaacaagaacaagtgttaggttggtgcaagaagaagaaaaagaaaaaaaggttcagaactttaggctgttcaaatgtaacgacatcttcaatacagtacacggcctaataacggaatctaatgaggttgatttgtttgttgtgatccaatcggcatcagcatttacatgaggttaggtacaataagcgctaacttgttcagtttaaaaaaatgagcgctatttggttggaatgtctcataaatacaaaacctcctgctaggctgctacaatataactgacctgcaatctgaagtttctgtgctcaaaatgtacaataagaggctaggaacttgggcagattagtcatgtaaatctcttggatgattggaatttagaaattatatatagcggcatggtacaacagacatactacaggagaggagtgccatgtagtggtagtggtactgtcggcagaggcagcagccatacatacagcacagagagtggctagcaagtggtgagtggggccacttgtcagagagagcataatttgcgtcgaaatggcgcctaaccctgcctaaattcgccagtggatggaccatctcgttctcgttcacgttcagtcagacaacctacgaacaagatgcatctactggaaattggtaacgaggtgaattgggtttgggcttttctttcaccgcacttatctgggctggccgggatgctatcacatttttttaggaacagttccttcctctaagaatagaagttcagagagattcctataaaatcttaaattcatcggctcagacttcagaagttcagagctacacactgaatctgttataccataactaccggttaccattcagtttaattgctattagaataagatcttctagttaacctaaacacatttaaccttacatctcacaggagaggtaagcaaaacaaagcgacacatgataaacagctagtgttaaccacacatgataaatttacagtacaggattcagtcctccaactgctgctcatccttggcgcttgcttctcctctcttcacaaaaaacaaaacaaaagatgtagtctgtcaaacattgtgatttaaaactgatctcagtgttgtatatctaggacaaagctagaattaatcatattgtttgaataacacttttaataacatgatgtaacgaacaatattgtccatggatcaataaatctaaatcgaagtactagtatataacattacagttaagataaaactagtaaagttataccgtgtggtcctgtaggtatgagctgaagtcagtagcaatgagatagggtgtaagccaccgcaattcgccgtgttgagatatcttcgtgaaagacaggaccttgttctgcagaatgtcaaagcggatcatataattggctttggccaccagtcgatccccaagaacttggccgaattcattaacgtgatcaggtattggctcctgaaagatatcattcagaacggcatacatgatcccatcttcgttcacgctaagaataggaatcggcataacatgtggcaacccaatctcgttgaagctctcgctcgcccagctgtctccgacagtcaatgtcgtttcctccttccagtgcttgaaatctggggagagtgaccatgtcttgagcttcacctcgttggcgggacaagaagcttcttcgcagtagccgatcaaggcgacgaacttgatggcaccagagacgcagccgatggaacggtgctcattcgggctgaagcaatggcggggtttgccgtggacgtcgcggcagtggggcagcgggacgaacactagctcggggccttccggcgacgagacgtggtcgcaaatcaagatgcccttgaggagatcaacccagaagatgctgccttggaaggagaaggccgtgtcgacgtggaagaagtaggtcgggccacagagatgtggagggagagggagacgaaccggcggcgtctcggcccactccgacgacgacgagcacacgaagagcttcgcgtcggggagccctgtggtggaggaggtgacaatgtcggcgaggatgtaatcatcatcatcatcgccggcggtgacgacgacggcggtgcggccgaggggaaggaaggtgggagagcatagggaatcggggagtgggggcatagcggtaaggtggttgttggaggcgtcgtagagaaggtagtatcgatgggcgtagatgacgacgatgccattgtggatgctggagatctcgccgatcccagccagatgcgagtactccggcggcagcagcatctgcaggctgcttacttaaggtgggtcggcgagaaagggaacgggtttcatgtccggcgccatccgccactccatctcctccaccatctgcactctactccaactccacccaccgatggttaactctttcccttcgacgaaaagcactatgcgatcgagcaacacgcaaggaggcctcgggttcgccatgagattgttgcttgacctagcttgacgcgcggctagggtttgctttgcttgaacaacaaagagaaggaaggaattggggaattgaattaaggggctctctctctctctctctctatatatatatatatatatatatatatatatatatatatatatatatatatatatatatatatatatatatctgtgtgtgtgtatgtgtatatatatatatacatatatatatacatatacgtatctactactacttaaaaaataagaggtgcttccatcgtccgtcaaaaaaaccgggtgaaaaaaaaccggaacgaatccgattcgtcaacgcggtaaaagaatatgtccgattccacaaaaataggaaacaaactcccatctgttttcgtttgagctgattaggactttgtttctgtttgggcgaataggacttggtttgaattataccaagtcctattcggttagcatcaccaggagaacaagtgcatatatacatacatagtataaaaaatcatagcacataacaaagaatcacatgcagccttatagcactttgcaaaaaaacaaaaaattagatcgaagggggtcgccgccagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccggcggcggcggcagagggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgctggtggtgggggagggtgctgccgccgccgctcgcgggaggaggggcgccgtcgccgtcgccgccgctcgcggggcgcctcccctcccgctagatccgccgccggtggtgggggaggatgccgccgacaccgccgtgggtggtgggggtgccgccgccgccgccatcggtggtgggggaggggcgccgtcgtcaccgccgccgctcgggggcgcggaggagaggccggtgaagtgagatggcagggagggaaatgggctagggttccgcggctgagagggagtgggttttgtttccccactattgacgctcggccgtccgatcaaaaccctagagatcggacggccggtgtcgtccgggccgaaatcggcccaagagggatcgagagtgaggcctcttttccggcccaagcccaggttgcggcctgggggaggaaaagtgcgcccgcgcatgcgcaagaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataaaaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgagtttgtattttaattaattgcatatttttctgatctgtaaacttcccggtgcaacgcacgggcacttttgctaaaccaaacaacacttttggtcaatatacacactctgtaatcacccagtgcaacgcacgggcacttttgctagtatatatatatatatatatatatatatatatatatatatatatgtatatacatatatatcttgtgatagaaaatcacagctcctatcattcgaattttagactattggatatgctttaagatttgtgcagacccatttaaccctaagtcatctcctcctccctcgttcagatcgcgccgccaccactccgcctcccgtccccgcgcgattcccaccgccaccgccccatcgcgccaccgcaggcctcgccggctggccgaaaggagtcaacagtgctagcgagccccctcccccttccccctctctttctcctcgaggcggcgacgatgaggtgcccccgccccgccgtcttccccgtctccggtggctccccgccgccggatccacagccaccgcccccgtcgtcgacgccggcccaccgccctcctccatccccgttgcttcggcggcaccgttgccgccttgccgcccgctgaagaccaccgcccaccgccggtcctctgccgcccacggccatccctctaagccccgaggaaacactgaccccaaccctaacctaacccgtatgttccctactagagttggggtgtcaccggcaccggagaagaaggggagcccgccggagttggaggagagaaatcgatgcacgaaacttggtatggatctaatggtcaaaaatctaatatgtaagatttcatccccaaatttcattcgaatgacatatagcaatctcgttgaattaatttccttgttgtcgatgagaaaaatcatgggctcctatatatggcccatgtattaactgctgcaaaggaaaagcccatgtgttgagtggggccggttgttagagagagtataatttgccatggaatgacgcctaacccgaattttttttatttttgtttttttaaaatatttacagaaataatctatcgtcagaaaaatttacaaaaatagaccctgccgctctagtggaggacggtaagctgacgtggcagacggcggctcgacggcgccgtgtgcgcattttacgctttggtccggtaaggggtgaaatgcaatttgtccagctgaatagaagcattaggctggtattttttttttgcatctaggccataatgcttctatccagctctgttgataatggcccttcccggactggcttttttacatggaggcccctagccgccctggcagtgggcggcatgggtgttaatgcaaaaagttcaactttttcaatcggccgtcaccgcccgttttttcacatggtcagttgtatgtcgcattgtcaatgggtgtgtaaggcaaatgacaaggattttggcacagccgaagaaagaaagtagaccccatagagaagatcactaggaatatcgtgtataaagacgttcttgactagtgagcaaaggtaggctcgcatgatcaaaattaatttgaaaacataatatagaaaataataaattgctgatcggagtattaatcaccaacatcctcttgttttgtacaacatgccatcatcattcaagtagtatattgtgtgattatcttctccataccatctcgtgttacatgcgtcagtttgcatcgggctgataacaatactatatgttaacacgcgtgtctctctaaatatgcacttttgccatcaacaaattttagtagttgtgccacgtagatcatggaagaagacgttaatgagatgatcaacaattgctatcttgttatacattgtgaaactattaatttggcatctgcttcaaatgaaattgttatttgggtttatattcacattctcgtgctacgtgctcaatgggcagtggccggcgtgtgctttgtgtgacaaatagaaaaaaagatttttttttctaagtgcataggccaaatgaaaaaaaatgaatggaattgacctaaaggaacatccaaattcacgacatgcagaaattatattttcttgtactctatataatgtaattgcactaatatactttgttttctatgtattatacttgtgagagattatggtacacctgaataatgaaaattgatgttattttttttgaggtagtattgtatagtgttttatttataaattttatttgaggtcaaatatcaataaggttgtgttcgtttctttgaggtttccaacctccactatatcgtttcccgacggcgaccacgacggctctcggtgacgacaatcacgacgcgcagctccgccgcttccccttctcccctccccgccgctttgtgggccctgcgtcagatgcatgcagtttcaggcgagactctcgttgccaaaatgagacaaaggaagcaaacaatggtcacggcctcatctacattttcgtccaccgcagcgagtatcctatttggctgggcgagtctatacatcacgtaggagcgtggtgaatggccttagggtgtgttcggcaacacaggttcccaactcctccccctcgtgtaccgtgcgcacgctttttaaactgttaaacacagtgtgttttttttaaaaaaaaattctatacgaaaattgtttaaaaaaatcatatggatctattttttttaaaaaaattaatacttaattaatcacacgctaatagatcgcttcatttttcatgcgtacgagattagttcccatctcctttatccaaactcagccttagaacgctgggttgtgtggcaatccatcgatcaatctaaaaaaatatcctagctggagctggagggggttggaaatagccaatgtgcacctggtccaggaagaccttgtgcacgggtgtgtgtgttgagggttggcgtccgtgtccagatctacagacgccaagaaggaagtaattccccaaaccttagatcgcctcttcttcttcttctaatcttgctgttggacccgacgaagcaaaccctagcctcctcctggagtaggcagcaatcatggcagaccaccccaggcctcctccctgtgtgttgctggaacgcgtggtgcgtttcgtggaagcagcagggttaaccagcggtggcgccagcagagacccagatgttgcggccataatcgaggtcggcggatggagctggagcacagtgcaaatgatgggttccgtggaggagatggagcggctgatggcgccgtccgtgaaacccgtcgccttcctcggcgacccacctcaagtaagcagcctgcacatgctgctgccgccgccggcgagcctggatctgcttgggatcggcgagatctccagcacccacaagggcatcgtcgttatctacgccgataaatgctacctcctctatgatgcctccaacaaccaccttaccggtatccccccaattcccgattcggtgacctctgcccccatcttccttcccctcggtcgcggcgctgtcctcgtctctgccgccggcgccgatgatgatgattacatcttcgccgacatcgtcacctccccctccactagagggatcaaccccgcgctccccaaagccaccatcttcgcgagggtgaagaacggcggcgagtggatccagtcatcgattcctcccctccctctccctccacatctctgtggcccgacctacttcttccacatcgacacggccttctccttcgccggcaccatcttctgggttgatcccctcaagggcatcttgatttgcgacgacatcttgtcatcaccgcaaggccccaggctagcgttcgtcccgttgccccactgcatcgacgcccacgacaaaccccgccattgcttcagcccaaatgaacaccgttccatcggccgcgtctctggtgccatcaagttcctcgccttgatcggctactgcgaagcttcttgtcccgagaacgaggtgaagctcaagacatggtcactgtccccagatttcaagcactggaaagaggaaaccaccttgactgtcggagacatctgggcgagcgagagcttcaaccagatggggttgccacatgttctgcccttctcccctgtcctcagcgtcaacgaagatggcatcatgtatgccgttctgaatgatgtcaagaaggaaccaataccgcgactcaatgagttcggggacagtcttgggatgcagctggttcctaaagcaaattatatgatccgcttcgacatgctgcaaaacaaggtcctgtcctccaccaagatttctaaaaaggccacttcgcggtggcttacaaataccttccttgctaccgacttcagtgcatacctacaagaccgccaggtactttactagtaactgctaccccactctacttctctggcttcatcccaatcgtttgttttactgctttactttgtttcagactcaattgatgcttatatttgtcacatcaagttagtttcacttgtacaactaactagtaaaaaatattgacatcttaatttggccaaccattaattaacattcaagtattgaacaccgcttagtgtgtcatatgtgcaccagcttcccttcatgaaccaatgagcattacaagtctcatgttaaactttgctagtaatattttttaaattaagaattggtatcagcctaagttcattcgatgatttactagtatgcagtatgcagaggctcaaatttaaactgaaattgaaaaaaaaaatcagcaacttccgtagccttccgttgttatttttgacaaaaagtacaatacccttatcaattatcccatttgcgtttatggctcactgttttggcgcaatactatttttaattgacctttcttactttatagccctgtgctatgatgctttcaacatattccaatctgagacaagcttaagatatccatgcttccggaacgctttcttttctagaaaattatttttacagtcttctaagtttcacttcttcaatacaaacctgagtgaattgtctaattagttacttaatgaatctagagttttcaaaatcaatttccgaatgtatacacggttggtgttatgttttctttggtgtagaattatttcatagtggtttcacttatccaatacaagcttcctttcttttgtcttaaccaatgaaaattacctggctcttgttgaactttgatagttgtaactttcaaattaagaattattttcagagtccctcagtttagtattattttcagagtctccctgagtgaattgcctaattaatgaatatagagaggttttgaaatcaattaccgaatgcattattggtacaagcctaagtagattctaaaagatgcagcattctgaagtgcaagactaaaaccaacagtggtcttaactgctgctggcaacagtaacaacctataaccacgtatattgatgccatggctactaacctcattagcaacatgccttgaagtactgctgactggacactacccctcttcttaagtgttgaagaattataattcaagctttggcatagataaaactagggtcagatttaaatcataatgtttaattgacagtcatcttcattttgttttggcagaatgctgaagcagcaggcaaggttggagcaagcgccaagggcaagcgtaagcggatgagcagcaggcaagctggtaggagcaagtgccaagggcaagcgtaagcggatcgaggagtgctgaatggtactccctcagttaaaaaaaaaaaacaatcctgagtatgaacctggacacgtgtgtgggctcatacccaggatttgttcttttctttttaggacggagagagtagtatatttctgttgcttatcatgtgcgcctagcatgtcgcttttttggcttacatcctgtgagatgtaatgttagcatgtgtttggtttcgggactaagtgggatgggatgaaaccatccctgattttggagttgggatgattccactcacatgtttggtttgtaggatgggacaattctaattttttgtttggttgaaaggatgagggagaaatgggatggacgccgtttgccatcaccgtcaacgaccgtcgcctgcgccacctgcatccacgcgtggaacaaccggatcaagcacagcggcagcagcaggacggccaccaccgccggagcacccaacccgctggcccaccgtcgtcgccgcggctggatcgggagatcccctgcgccggatccgccgccgccgctctccctacctccaagtttcgccgccgccgagtcccccttctctggatccgccgccgccgccctccctacctccaagcttcgccgccactcgagcccgccgcgtcgacatcaccgcagctgccgcaaccgctctcgtcgagcatcacgatgagcggcgggatggcgccgagcatctcgctcgcggcggcaaccggtgttaaggcaaggggtcgtggaggagcgccggcggtcgcagaggtggtggcaggcggtcgtggcggagcgccggcggtcacggaggaggcggcgggcacgggcgcggacgagcgcctgcggtcgccgaggagacgccgtgtgctccgtccaagtgggacgagctcgtccggccgattttgccggatggatttgtcccggatctaggaggaatattcctctctagggaccaacccatcccactcgcccctcaaccaaacacctctaaaagtgggtttgtcccatcccatcccatcccatcccaccaaccaaacactaccttaaatgtgtttaggttaaccatcagaccttattttagtcactatcagactttattttaatgatatcagcctagcagttaaaactgaatggtaaccaatatatgatgtatgatcatcgtggatttatatcatcatatgctatgtggccaaaggtttggtcgtggtgctccgtggactatcagccccatcgtttggcctaaacagccaaagaataagccaaaatttgaaattttgaatttaattttgaagttgattttgaaatgcttttaacgtaatttttgttaattttggcttttaagtcgctacgaataaatctacaaaagttttacttataaactaattttaattttctaataagccaaataagccattttaggtaaaatggcaaccgatgggatcctatctatctgtgactgtgagtgactcggaatggctttttattggtttcttgtactttggtacaagttccactatctaatactagtagtaatttacctgtgctaacacgaaaacaatatttggtaatgcaatcaataaactaaagacaacgcatgttttggcaattaagcatataattagataaatttaaaattcacacaaatattaaaaaaataaagtaattttattgttaaatttataagatgtgtgcaaaatagcatcgctttttatatctttgaaactatctaattcttggtgcactaagaaattattttataactgcgtgaatattattttccgaatgatgcgcaaaataataactgcaagctactcttatggaaaatgttccatgatgagtcattgctatgtaggtaatggatccacatgccatttaaaggcaaatagtgattttatcccattatatttgaatatgtaaataatcaaaattgcattatcattcagaaataaaataagttaggtaaaaggaaacgtaaaaataaacacaatatccatccatcaaggtgtgactgcaagaccaaccgaagaaaaaaatacattatgtccgggtttagcaatggtgacgatccgacatcggcggcacacgaaggaaatcggtgacgttgagcagtgccgaggaggaggttgccggagcagcttctatcgatgtagggtcggtggccggggttcgccgcagatttggatctggccggcgagtcaggtgcacagccacgagatggcagggtgttggttgcgtcacggttggcgtgatggagctggagcctagagggaggtgagcagcgaggacgacatgatggtgaactggggcgacgaggagagggaggacatgattttggggattggcggtggagagcgacactgtgtgacgtcgaatgtaactcatcagatctgaatcgttgtatgtgtcacaaaatgaataagtaataaaacaagttgttgaactataccgtgggctaactcaggtccatggacaccaaggccctgggtccgccacacgctatgcctcttggcgcccctctgttgatcgcttctcggccacacacgcattaatggcttgatgacgaaattaatttacaggccagttgattgcaagagagattggttttggcttataccatgtactgatttatgggtgatagtcaccctctcggttcattggtcagacggtccaaccgtgaacctagaggctgaagcgcggttcactaatgtacttactccgtcccataaaaaaataatttagtattagatgtgacatatcatagtcctacgaatctggatatatttctgtttagatttattgtattagaatatatcatttcgtttttttaggatggagagagtatatatcaggtactccatacttaacacacatccggatggtacgatggctacaggagttgacttgcaaccgcgcaccttttagttggatatttgaaaaaaaaagaggctgcgagctagtgtggcccaaaaaatgagcctacgaactaacacggccatcatgtggcccattcattcattgacttgacttagagcagatataatagcagactataagccagctataaacatattttaaagagatactcccttcgtactcgtaaagaaagtcgtttaggacaatgtttaagtcaaaccttgggaatataaatcatgaatagctcttaagttgttgagtttgaaaatgtaaaaattatatgaatagatttgccttgaaaaacattttcataaaagtataaatatatcactttttaataaatatctttatagaaataagaagtcaaaattatgttttggagaccgtgtcgctgtccaaaacgacttcctttatgagtatggagggagtactcccttcatctacttttgatagtcatatttccaaatctgaaaattttatttttgataggcatatttcagttcaacaacctatcatcttaatgactttctcggatttaatgcatgattctccattcttccacacaacattggctacattggcttgtttacgaggaatgactagtagcatatttaaatgaatgataagtagaattacttatccttggtctatgtgccaagatgaaatatgactatcaaaagtagatgaagggagtaaaagaagagagagaagagcagcgggccacagatctgtagtcagctatatcatggactccaaaacgtaatgtgtgtattacaggtaggaccatatattaatagtatagtgtcgacgtttgatgtcgcgattccggtatttgcacagtatggggatcgttggtactaggatatacgcgagactgaggtaaaagagacggagacagggatttttatacaggttcgggcccctgaattgtcaggtaataaccctacatcctattgggcgaagccggtattgctcttattcaccataatcacaccagtacaatatttggggtagcccatctaactgctgtcgatatgacggtctgaagttctgactcgtagtcaacaacagggtagttttccttctcgaatccgcatccggcgagatcagagacaacgctatgtctctcctgacggtagccataggtatcgtaggggactagccatgcctatctctgaagtcgatatctggtatcttgtcttggcgtatgttggcttatatgttgatcttgcgtcttgatctattgttccgtgtcccctctcctcctagggggccttgtatttataaccataggtgtccccttgtctaagtagaactagggaaaccaatatggatacaatccgagtagtccttgtcgtttccatgtagaactctagtcatgcttccttatgtggaactcctcctatatccgaaagttgtttccgtataagacatggtatatggtgggtcctgtcgagatttagtcaactactattaggtatgtggtatccacaaccctgacatatagtaagtaactattgtatgaattgactattacattggctatagatgatttggaggtagtagttgactatactattatacttgctcttagtacggtccgaccgaaggcaatttgtgactcatgagacaacgaacccaactgtttacttggtcgaaatagctaataggcgatcagtcgccgcgcgaggagaggggagcgcgggcagcatgcggtttcttttttnnnnnnnnnnnnnnnnnnnnnnnnnnnnnnnnnnnnnnn

SEQ ID NO: 4294 - DNA, 2082 bp, Oryza sativa
  unsure (1)..(2082): unsure at all n locations
gccctccctcgctctacccgcgccgagcccacgcgccgccgctctctggcgaactccagccgcgccgcgccgccgctcccgtccaccccgcactgcgccgtcgccctccccggcaccgcagtcgtcgtgcacaccccgtccaccgctcctcttccccaatccaccaccgcaacgccgcttccacctccaccccgagccaccttcgccattagccgcctccatccgctccccgccggcgagcgccgcctcgcccggccgtgcttttgcctccaacggcttcgccacgtcacaccgtaccccggcatccactccgtcctccccttccacccccgcagcaccattcccaccatgcaagccgaaaccaccgccattcaccgcctccagccgcccgctactgcagccctatgggtcgccgcgccgtgccgtttgtgtcgtcggcatcgctgtgccgagctctacccctgcccctactccatctcccctctccgcctccggaacatcgccgcctcgcgcaccacttttctcgcgccgccgccatctcgcctccctccgtcggccgcctctctccggcgtcgccccgtggtgagcaccccggtttcctcctcctctccctcctagcgccgtgcgctgccgcttccgtgcatgcgtcgccgccccgcgtcgccgccgctcgccgctgatggtcctcaggccggtgcgtcgccgccgcgccgtgtgctcgaccggccggctgccgctgccctgctcgcccgggccgatcggtcccctttgccgcgcctccctcgcgtgcaccgccgctccccgcgccgtcgccgccggtggtcacattgccgcgcgccattgctcggtcgggccggcataagccgtgcccgtgcccagccgcgccaccccatggccgcccgatcggctttgggtcgatccgggccgtcggttcccgtggaccgacggtggaccgcctcggtggtctcggtccacggtggaccggcgcccttgtgccgctgaccggtggggcccgcttgccggcgctgcccctcccccttgatgacgtcagcaaccccgttttcctttggaaaaataattaacaattgcatcataaatcatatttaattctagaaattcatttaaatggctcaaaacttctaaaattcatatctaattcattcgaactccgaatggagccattcaacttgcaaaattcatctaaaattgagctctacatgtttgtttagtttttatgtactatttccttggtttttattagagtttttcctcgttttgcgtgcaagcgtgtagtttccgccgtttcggaagatcgcggtcgtgaggataagagtttggaagatcaaagtgaagaagcaaggcaagtcacacattccccttgagcatgttgatcccaatttactaatgttttaccgtttgcaaataaatatgcatgttttgctaattacatgggatccggttattacctatctgctcgcttgtaccatgtttacttgatatctgtcatttgtcaaccttgggcgataaatcgactagctcatgttacttatgtgacctagctagaactatatgcttagccatgcttaattaccactagctcagttgatgggataattgcagtattagacctttttagtatctgaatgagctgcgtgctcgagacatctggccatgcttcatggtcgtaattatccaactaaaatgcgactgaatggtgggctgtgggtgcatggttttgctagtcgcacccatggcaattaaggaccggttcgcgggaaaccctgcaagaattcctcgtacttaccacaagccagcgtgggctgtgggtgcatggtttacgctttatttacgtttggaactgtatattacttatcgttttgtgtatcctggctggtcctggacagggatttaatacacaaaatagtctggaaatttagggctaaatttctgggcgtgacatatattttgtatacatacatatataaacttttatatacgtcgcatacaaactttgtatatgacgtannnnnnnnnnnnnnnnnnnnnnnnnnnnnnnnnnnnnnnnnnnnnnnnnnnnnnnnn

SEQ ID NO: 4295 - DNA, 1078 bp, Oryza sativa
gatttgaaggcaatttgaggatgattgttttgggattttggggacgggatagggttagggtgaaatcaatatattaaaaataataaagagaagaaaataataaagaagcaaccggatctgtctcaaccgggactaaagataaacaccaaccgggactaaaaatcgatttttactcccggttatctcacccgggactaaagatcgctatctttagtcccggattcgtagtctcggttggaaaaccaggactatataggggttatgaaccgggagtaaaatccacttctccaccagtgacacgttttaggtacaaaaggaaatctgctgcattcacgtgtggcgcgcccgcgcatgccaacctgttcgagccattcgcgggtacgggttaacgcgaacgttcacgtattaggtatttcgtagaaggaacgaacaaacggtcatgctgcccctaacgtgcgatcagtcgcgcttcccacgagccgcgcggtcagtttctgaccatatagtctctctcctctactagatgtatatatatatataaagtttatatgtatgtatataaagtttatatgtatatatatatatacatatgtatattttctaatatgtatatacacatataaaatgtttgtatacgtcatatacaaagtttgtatgcgacgtatataaaagtttatatatgtatgtatacaaaatatatgtcacgcccagaaatttagccctaaatttccagactattttgtgtattaaatccctgtccaggaccagccaggatacacaaaacgataagtaatatacagttccaaacgtaaataaagcgtaaaccatgcacccacagcccacgctggcttgtggtaagtacgaggaattcttgcagggtttcccgcgaaccggtccttaattgccatgggtgcgactagcaaaaccatgcacccacagcccaccattcagtcgcattttagttggataattacgaccatgaagcatggccagatgtctcgagcacgcagctcattcagatactaaaaaggtctaatactgcaattatcccatcaactgagctagtggcaattaagca

SEQ ID NO: 4296 - DNA, 1181 bp, Oryza sativa
  unsure (1)..(1181): unsure at all n locations
aggtggaaaccatccagcgacatgggggcggcatcaaggggcggagtgaaggtggctcggtgccgtttttctcgggggaagtgggggaagagggggaggacgagggcggcgaccgcgcccacgtatgcgcgggaaaggggggtcgcgcggaaggggcggcaacgtgggcgtatcgggcggccatggcagttgccggcccaagctggaggaaggggaaggagctgacatgtggggccgggtcccacatgtcggccggagagagaagagctggggggggttttgtggactttcaagggagaggaggcaaatgggccaacggcccctgtaaggggggggaaggagcggtctgaaggaggggaaggagaggcttgggccgagcccaaagagaggatggagagatttatttggttttctttttacttaattgattaaatgaactttgtggcattaaaattatttattgagctccgaaaattcacgggaaatttcagagaatatattagggcacaaagaatattacaaaatattctcagccaatgatttttatggggaaattttaattctctcattatttcacttgattaaattgctttaaattttatttaatttttagaaaatgcattatttaatgatttttaatcccgaacgaaaatcggggcgtcacaatataccatctttatatacgtgtgtgtgtgtgtgtatatatataatttgtacgcctatatataaaaatttatacacacaaaatttgtatacaaactttgtatatgtatgtattaaaaaaacaaaaaacaagaaaaagatacggaaagaaaaaaaacagaaaaaaaacgcgcgccacacaaaaagtaacgatactgaaggaagaaaagaaaaaaaaaagaaaaccgcacgcataagggcaagttttatagtggaggtgagtgtcacatctaatttacatcatatcatcttctcattaattaagtggtaacaagtacaacatgtcacttctagtacacaaaccccagtattagtttactctcatatcatcttatatttttcttggagattgtgtggaggttgccccttgcatatggggtggttcattctctctctcctaacttctctcctccaactcatcatctaatcctatatgtcaannnnnnnnnnnnnnnnnnnnnnnnnnnnnnnnnnnnnnn

SEQ ID NO: 4297 - DNA, 615 bp, Oryza sativa
  unsure (1)..(615): unsure at all n locations
nnnnnnnnnnnnnnnnnnnnnnnnnnnnnnnnnnnnnnnaaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaatagaaagcactgacgttggtccggtagtcggagcaagtgaaatctccgcgccaggaggagacggtttgtacgactacatcgagcccgaaggttgcaagacatgcaccctcccttgaacaatttaatcccagtagttagagagttattttggtagcgtactcgtcctttggagtacgatagactgcacgaattcttttaaattaattatattactattattgcattatattttctgttgttgttataaacaccttaatgagccttagagtataacaaacttaggataaaatttgagaaacacctaaacaaatggttaattatttaacatgctattgatttaatatggatattattactgcatatgaaaacatg

SEQ ID NO: 4298 - DNA, 692 bp, Oryza sativa
  unsure (1)..(692): unsure at all n locations
nnnnnnnnnnnnnnnnnnnnnnnnnnnnnnnnnnnnnnntcctaagtttgttatactctaaggctcattaaggtgtttataacaacaacagaaaatataatgcaataatagtaatataattaatttaaaagaattcgtgcagtctatcgtactccaaaggacgagtacgctaccaaaataactctctaactactgggattaaattgttcaagggagggtgcatgtcttgcaaccttcgggctcgatgtagtcgtacaaaccgtctcctcctggcgcggagatttcacttgctccgactaccggaccaacgtcagtgctttctatttacgcaacaatcatcaccataataaataacagaaaagcaaagataaccaaaagaaaatagtatcacaaactgcaacaatgggtgaaaaggatttaaagaaataattttagggatttttggaatttcggtgaacggcgtaccctagggctaaaattagggtcgcgacaacgggtgatcggattgcaacgaaactgatacggttggattcggaataattctaggagtttggaataggtctcggattttgatttcgagctcaaacggatggtcaacttgataggaaaataaaaatgttttttcttatttatttttcaacaggaaaatcagatttcctattcatctcgttctgtgcacgggagccggtcgg

SEQ ID NO: 4299 - DNA, 35389 bp, Oryza sativa
catcctagttattgggttagaaatggtctaatcatgagatgtacgatactaaacgtctgttcgcgttccgcgaacgttcacgtattagcctcacccgctgctcgggcggtgctgcgagaccgcatctgtctcgtgccaacagaccgcaaacagcgtctctctcgtgccgatgttgtggcgttgcggggccgtaacaacgtcacccatttcgcaccacgacaccgcccatgtcatgactccgtcacgcgagcaggacggagctagaactagacagagagatgctgctagcttaatttattttacttaatattgagtttaaactgacatagatacttatatttatattgagagggtgcatatatagcgaaaatagataagatatagttataatttttttttcaccgggttactaggaaccccctaattactctacctccaccctgcacgcgagaccgcacacgaattcagcacgtggtcattattttcacgcaacggtcgagcaatatcgtgtcatgcccttccactcagcgacgacggggtgtttagatccacgggtgtaaagttttggcgtgttacatcggatattatataggttattgtatgtgttgttcggtcacttaataaaaaactaattacagaatctatcagtaaactgcaagacgaatttattaagcctaattaatcctcattagtaaatatttactgtagcatcacattgtcaaatcatgaaacaattaggcttaaaagattcgtctcgcaaattagttacaatccgtgcaattagttattttttactctatatttaatactttatacagatatttaaatgttcgatgtgacagggtggggttctaaagaggacagacgacatggaaaaaatgcatcctagatatttctgataaaaaaataaatgaactgtatagtttcaaatagatgcatgcctcaccctatcaccagcgtagcacgtccttgaggccgagtttgcttccaaaatttttcttcaaatttccaattttttcatcgtatcgaaatttttctacacacgtgaactttcaaatttttcgtcacatcgtattaattttaaccaaatttacaatttagcgttaactatgctttcctgttgcacgtaaaagcaaaagcaaaagcaaaaccaaaccacaaggcatcacagcacatcacatcaggagtagccgtgctaggaatagctacagctgctactccaccagtacatcgatcccctccaccagtacatcaatccagcctgcgccctgcggctctgcgctgcgagatggtggtttggtatggtggtgttacgcgcgcgcccttcaaacccaaccaaaactcagcagcttttttttctctcttttttattttgatcttgaaaacaacagcaactaggtgctttcccctgttcgtgcaagcgaggtgaagacgtgaagtccattttatgtgtatggcctgtcccctttcccatcaaactttattctgcgtcctccatttggcggcccaacgcgggagcagctgaagccgtccgatcgaatggctggtccagattaatcctgacctaaataaatacacctaaaacctaaccctaactttagaattcattccccccattgcccccgatctcccccaagcgatggagccccctccccccccccccccaaagcataggggtgggcacatttagaccgaattgaagaaccaaatcgaaaaaaccgaggccgaaaaatttagtttcctgttcggtcccaaccatcgaaagactgaatttatttcggtcaattgggttattgggctcggttaaccgaattaaccgaaaatgaccgaaattttggcccaacagacgaagcccaataagcccagtagttatctaaccctagaagtgataccataggcgcacagcagtcccagtcacgccgcattccccatcctctcggcctctgcctccaccgcgcgtgtcagggttatggataccacatacctaataatagtcgactaaatctcgacagggcccaccacataccatgtcttatatggaaactgacctcggatatgggaggagttccggataaggatagacaaccagagttctacatggaaacgacgaggactactcggattgtatccatattggtttccctagttctatttggacaaggggacatctatgggtataaatacaaggccccctagaaggagaggggacacaatcaacatacacggaacaacagaagccacaacatacaagccaacatacgccaagacaagacgccggatatcaacttcagggataggcatggctagtcccctacggtgcctatagctaccgtcaggagagatatagcgctgtctctgatctcgccggatgcgaattcaaggaggaagactaccctgttatcgactacgagtcagaccttcagaccgccatgtcgacaaaagttagataggctaccccaaatattgtactagtgtgattatgatgaataagagcaacgaccggcttcggccaacaggatgtagggttattacctgataattcaggggcccgaacctgtataaaaatccatgtctccgtctcttttatcttagtctcgtgtatatcctagtatcaacgatccacatactatgcaaataccggaatcgtgacatcaaacgtcgacagcgcggtcgcgccgctgccatccaccgcgcccggcctccacctccaaccctccaccgcgccagagccgcctccgcctctgccctccaccgcgcaagagccgcctcgcctccgttctccaccgcgccggagccgcctccgtcctccaccgcgccggagccacctcgcctccgccctccaccgcaccggagccgcctcgcctccgttctccaccgtgtcggcatccatcgcgccacggccgccgcctccgccttggcgacgacggctacatcctagttggctgttcatgtacttatttactactgcttgatcacaatttgtgaacctagttggctgttgcttcttgcttgatcacaatctgtgaactactaaacttatttactactgcttgtgcttgatatgtgatgtaatgttactcatcaacccggaacttcagttctgagacctgtgctatttattcttgtatattatcttgtatttttgtgatatatatatgtgaaaaaatgtctcaaaagaggggaagtgctgtcaaaatttttcatttcaaacttactactaaaaatttcggtcagatcgagactgagacccaaaagaccgagaccgaatttaccggtcctgagtttttttggatgaaattcggccctgagttttcgaagactgaaatacccgaaagacagaagaccgagaccgaatttttcgatctgaccgaacgcccacccctacccgagcggctgcggcagcgcggagcagcgaccgacaagcgatgcccctgatcctctctctcaaggcgacgacggtggcggcgtggagcagcggccggcctcctctccctcgccatggggccccgggagagctcgactgtggcagcggcagcgcccttccctcagctggatccagcgggaggggaggcggcggcggcggcctcccctccaccggatccagcgggaggggagccggcggcggcggttcggtggtgacctccccttcggtctattttttagatatatttgtgtgtatatgctttctccgattttatttgtgtgattgaattccgatttggattttttttttgggggggggggaggggtgattgaattccgaatgggattttaggggcggagggaggggggcgacagacgaaaaattggcgtactgacgaggtgacgaacggaaaaatatggatcttttaattagttaagatatgtaacgaatcatgacttggatatgacgtttgcttgtatattacggaacggcctaaagtctaggtttgataatgttgtaaagtagatttaggaaaccgataccatattggttaaggtttctatcttgtaataatgccccacatcctatataaggtgggcactgggctggaagccttctaaggaatgattcacaaacagatcgtcagatcaatactacacccggcggattcgaatcctcaaacaggagtggggtattttctctcattgagagggcctggacctgtctaaatccttgtctctacatccatctacttttaggtctcatgcactatccctttatattgtcgaaattttgtttggacacatatttttgcctctcttttcttgttcgatcgctcacttccatttcggggagccattactgcacggccaaacagtttccttttccgtgaaacgaagcctcccgaggagatggatcgatgtcgttcgctactaatccgaactatacgcgaatcccatcacagatgccgcatatcccgtccaaattatctatatgcggtcctacttcataatcgcatcgcggttttctttttatcatttgttatttttaccaaaggaccacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactaggctgatccaacagggtcggtgctgtggccgctaccccgatttggcgcagctaccgtcgcccgtcatgggtaagcgtcgtcgaatcgcgcctccgtccactagctccccctatctgcctctagccctctaccaagaaacaccatcgttgtaaccttcgccaagccaccgtgtgtgcgggtcatggggtgggttgggagggaaagatggagagagagaggaagaagtacatagattgacatgtggaacccactagctattagattggagagggtaataaagagaatgttagagtgaaagacaaatttgactctaatattttgtaagctagccaaatagagatttaaaaagttaaatttagagagaccgttaaagatgctattatacactcgggcaacagctgcatcatatcattgccttgatctcctctaggaggaaacaccacatggctttgtctggtgctctcttcacattaggcatgaccgagctagctacacgcaaatactcccttcatttcatacttattataagtcgctttaattttttacataatcttttaattgtttgatcaaacttaaaaaaaaactagcaacatctaaaataccaaattagttctattaaatttaacactgagtatatattttgataatgggtttattttatgttgaaaatgttattgtattattcaataaatttggttaaacttaaagaaaatcaaaacaatttgcaatatgaaacgaagggggtagtatatgcgcatatatcatacatgaaccatattgacaagtgaggatactcgcaaaaatacagacatttattttttaaagccccaggctcagtatggtttttgatgaaattgatggacgacggaatttctagatatagtagtctgttagtatttgttaattgttactacaaagattagggttgaactctgtgtgtgtgtgtgtgttttgtttgaaggagagaattaggatagactagatcaaatctacccgttggagttgaactctaagggggagagagagaagcagcatgaagaggggagagggtagggccgggtaacacagtactatgcatgcagcttcttcttcctccctcacttctttctccactgcagtagttcttgggtttgtgagactcccacagagagcatgattcactccggcggccgccgccgccgccaccgccgcggcagcaaagggccgtacgagcgcggcggcgacggggaggtggacggaagcccacgcgaagccaagggctgcatggacgcagcggcgacggacgcacaggcaggctccactttgggcagcggctgctgtgctgctatggctcacgcatggatggaggagtttcccggggacaaggtaactcttcttgtacacgtcatccgtggtgtttcttggttctgtcttgtgtgtctccttagatctacttagggctccctcacaaaatagacctattttctttctttcttgttcaaatatacctcctccccgcctgccttcggatgcgaccgagaatgaaatctgttgttcccaagtgtgatgcaaacatgctgctgctaattttttttaatgcattgggttttgtcttattaacatgattttgggtaaagatggtacggcgcttcgtcttactaagatcaatctcatgttcgttctgctatatgctattgtttatgctcttttgttgattcttttgtttgggttgtcttggtaacgcaggaggaggtgaaagatgtcttgcttgctcaagtcttcggtaaaaaaagaaccctctaattttcaagttaggcgtaaatttgtctacttttccaactcacggtttagttataaagtatgacataatttctttcttttttgcagctaagcataaacccattgaaagagactgacatgattttgcttgagaggggattctgccactgtgagaaggtttgaaccacatcttctatgatttagttacgggcattctattttgtatatgctctttaacttctcgaggttttcaagtatagcttcccatgctaatttaatactttgtctcggggatgttttgttggaatcagacattatttcttatgcctgcacaattgatgactgatgtatcctgcacacacctcttagttaagcaatgtgtatgtacataattaacatgtaatgccgtatcttcctctatttcaaatttgttatagagatttattttttctctttttagggggaagaactaccaaaaaaaaatcaacaggaaccaccaccgcatcaacttttacagcagaagaaccatcagcaatgtcagcaacaagctgctcacactccaaagtcgatggtgcagaagcctgaggtacgttgctactttaacaccgtgaaatggatcgtatctggtttgcgtccaatcgggtgttgcgagtagcgacactttgaacgggacgtgcatctcttcttcttcttctgtaggctgtagctagtaactcgtgatggcgatctaatcctttccccatttcgttcgcccagctgttgcttctgggatcaccatggcatgtcatgtatggtgctggttttcttctttgttttaaggagagaatttgcatagactgatcaagtctactgtgagggacccacgtttcacattttttataaacttgattaaatttaaaaatgtttggctaaggaaaaagtataaactacttataacatgaaacggggaaatattgtttatgctcttttgctgatttcttccttttggttgtcttgactgcagtggaacacgcatgaggaggtgaaggaggtccatttgaaacagaatgtccctgaaccatcttcttacctgcataagtcctcggtaaaaaagaccccctctaattcacaagtcagccataaatttgtctactttcctttaggttgtcctgaatgtagtagaacacgcaggaggaggtgaaggaagtccatgtgaaggagaatgtccctgcaccatcttcttacttgctcaagtcctcggtaaaaaaagatcccactaattctcaagtcaaccataaatttgtctactttttaggcccggtttagttacaaagtagtatgacctattttttttatttctacatcgaaccataagtatcttggattttcaatttttaacctagagagaaatgttaaatctaatccgaatacatgattataatctgtaaacatcttaaagtaatgtgtgcgccacttcttttaatgcactgttgctcttcatcttaagtaatgtgcacgtacataattatcttcatcttaagtaatgtgcacgtacataattatcttggattttcaatttttaacctaaagggaaatgttgaaactaatttatgtacatgataataatatgtagacaacttagagtaatgtgtgcgccacttttaatactgcacatcaacttactaacaagatttattcaatctcgcattcaaataaatcttgcattcattgtttgttgtgatatgctgttatttatgctcttttgccgttatttctctgcaggggttaaaatcattatttgtgaaggcttctggtgttagtgtatccatacaagtagatgtatctaacacaaaagttgattatctgatcaattctgcctgtgaaaagttaggtgtcaaagctcaggatacctatgcagtgttgtgcggtaaagttttagactatgataaatcattgtcggagtacctattgtatcaaaactcaaccgttgaaatccgctatcgaggaagagctggacagtgagtattatctatttaaaattgttaatttttttatttgtacatgtctataacattgtaacattgtgttttgctgtaggctaaattgggatcaaaaattcaatgttaatgatacagttctgtattatgatgttaacttagatccagctcttcaaaatgctggaatccaggcattccaatatgcacggtttttctcggatttttcctcatacaatatattcagaaggtgttgatgcatgttactgaacaacatccgtgcagggtggagttatgatgggggttttaatagccagaacattatctttcatgatggcgcagttagtatagaaaatgtccctgtagtggcatttgataaagatccatgtgctcgggattatactagtctctacaatatattctctacaaggtttggaccagtgtatccagtacatttcgatcatctccttgaattcctaagaacatgtccttgtggggtgaactccagaaacgatgcaatagttgcgtttgtcacaaatcatcctagtattgaaacatatgttgataggatgaaacaattgatgattttagacaatgtggtacatagacaccctgcacatcttcaggctaatataaaagctatggcagcatatgcttcacacgctagtttaagagctagtatgggaccatatgcatatgcttggaaaggttctgcgcagcttgttcctgaactcaataatgttcttatctatcaaccatccgggaaaccattacaatggaaaaatcccttatatactgataatgcaaaaggttgtcttcattttgccaataattttttgaagcatgcaagaaacagggttagtataatacttactccattattttttcactagtgaaaacatatttatgtctaacactgttttttcactaaacagttcccagaagaacaaattgaggcagcatttgctctacacatgaaaaatttcctgccaaagatattacagggactagctgaacttgctgatcgcaccccaaacagacaatacatcaatgacatgtaagtggatctcaaatcttgacaaaatctttctcaacctaaaatatttctcaatcaagtttaaaagatgaaatgagattatttttgtaggctttcaaacccactggcggatataagcacgggaaattagattcggagatgcatgtaagacaaattgatcaaaaattgacttaatattttattcttcatactatcattgcattcttatgtttagtatgtaggaagcaacaatctggagatattttaattggaaagctgtgaaggaatgtcattgtatcggaatgtcattgtatcttgctcaggcctcatggaggcatgtatcttctctgtttctttggaccggtgttgattgtgttgcagcatggtgggatggcgtcatgctggaatgcaaagataaacaaccatgttagaagctatttaatttagctagttattgtattgtatgaacatcactacattcgctcttaatttagtagtactagtaacttgttgtgctgaggagtactactactaccactactactacatgtgtgtatgcctgtctgtttggattggtttggtttctgtttggattagtagccgcttgctcagctcaaccgaaccagagatgagaggccctgccggagcgcgggcgatctgcttgcatgcatctacgcgtgcagtacagcgaaagtcggaccgagaaaacgtacctcgcgagtcaggcccgcttctcgctgtcgaccacgtctctcgacatggcgcccgagtcgtcctgagctcggccggccatctgcggtgacgaagccaccagatccggcgcctcccggccgattcgtcgcaatcgcctccctcgctggatatgccggccgcaaagctcgcagccgccggatgcccgtccgctccgaggccagcgtcttcctcggcggcctccgttagctcctcccgctccgaggccagcgtcttcctcggcggcctccgttagctcctcctcctgctcttagccggccgctaccggcgacaaacacaagaagctgctccccctccattttgcctttccttttctttttcttctatttttttccatcggccttgcgctatttatagaacgtactatgacgtcactgtcaaacggtggtgacaacatcattttcaataatattctaaaagagaacaatgccaccctcacttctttcatggagtactacaaaatcattcctatgcatattgttcattgttgttatatgtatgtactttcatctcaagtttatcagatatccggacggataagtttagtttcacgggtaaattttttttcctatcatatcgaacgtttgaatataagtacgaagtattaaatattgaaaaagaaaactaattgcacagtttgcatgtaaattacaagacgaatcttttaagcctaattgcatcatgatttgacaatgtggtgctacagtaaacatttgctaatgacagattaattgggcttaataaattcgtctcgcagtttacatgtggattatgtaatttgttttgttattagtctatgtttaatacttcaaatgtgtccatatatccgatgtgacccgatattttttttacggtggaaccaaacacagccttattctaaaagacctcacaattattttggggactaactatctaacatgttatagaaaatcccctaaatagtataagtatagtgtactccctccgttccaagatatttggatagatgtggttgataatatgaagcatcacattcgtccaaaatctcttactatattctaagacggatggagtatttacagtgcaactagcatataattacagctgtaattaggatgtaattatagtacatctagagtgtataggtcacatttgacttaaaatcttggtgtagctttagtggtagagatgtgtgctagtatgccacagttggtgggatcgactagtcatcgcgtgtatgatttttatttgttttattatgtatattacacgagtctttgtgcatatcggacggtcaacactaatctcaaagaacatccaactgccaaaatagtgcaagacatagccatcaattttctatcattagactagtagtatgtgtgtaattcatacttcaccctagcaaagcatgaatatttgtgtattcatggttagcaagagtaattaaacagcatccccatatactagcccacatgcaagtaaccaaacgccaccctgatatattgtttaacatctccaacctcactcaatatcacccactgcccactggccactatagctaggctagtatttggtttgcttcaatgctaaattttaacattagaaaaacctaggcaagttttgacgttgtcaatttctttcacaatttatatgtgctgttggcatatttggtagcaaattaaatactagtattaaagtaccaacgatttgatagcgcatattttagctccggaacaaaatgcctccctcagctctttttttttctttttttcctttggtatagatttgtgctccaagataccctaaccctagaccagtccaaaaataaataaataaaaagaatggtgcccagaatctcggttccagtgacttcacttcgaacaactgtgcaattaaatatgttctctatttctagcattaatataatatataagtttccctttaaaggctgtgtgtagttcagcgcaaagtttggattttggttaaaattggagatgatgtgactaaaaagttgtgtgtgtatgacatattaatgtgatggaaaaggactgaaatttggatccaaactttggatctaaacacagccttaataaaaatcatctgctaggtttcgtcctttaaatttatttaaatttcactcattttgagtatgagattctaataattggctgtaactttttgagcaaaagtcggaatgctctgttccattatctaaaaaaaaatgtgtattaaagcgactgcaatagaatgatataaatggattatacgagttgtcacattgtacctgtgcttatgtagtgggaagaatgagaggagagaagaaaaaaaggggttattacatatttatagccagttatagcactggaatggactccgataaataaattatgttagagggacaagttagttaaatattaaattgtgtaatggtatatatctacaactaattttaatttttgaagctaatgcttaacttgtactataagctttgctgtccgatccgggggttagactcgtgtcaatctgccgcctcaggccaccctgcacgcaaatctcgttcgtccacccctgtgggttcgtcacagtctggagcaacgcgcggctgcatgccaaagggcaaaggcgccagctcgtcaacccaaccctatcgacacccggtgaccggtgttggtggagcccatgaccatgggggaggtggagctatgctttgacgcgtcgtgtcgtgcgggtagatagatgccacgcggcgatagatggcgcatgatgatcactagtggagtagtcatggatgcggctgtgtcgtgcggtgcgggtgggccacgcggcgatggcacatgagcaggaagcggttgagagttgagacaaataatgtcatggaggcgtgcggctgtgtactgtacctccgcgcgcttgaccgacgatgtcagtgactgacgcggaagaattaatccaagggcaaagtatatactccatggagttgaaggagcaaatgagcgtggaatatgatttgttcttaagcttggattaacgagcatcgtatttacgcggctcatatactccctccgttttttactttgactttttttctatagtaaattccttttatgtttgatcaaatttgtaatagtaaaatataataacattttcaacataaaaaatatattatatttaatcaaattaatttaatattttagatattcataataaaaaattgactaggaaaaaagtcaaagcgactatagttgaaacggagaaaatatttatctttaatatggtcaaatatactataatagatctcttcacccggtagtcaataaaataattaactatttaaaaaaatgggattaacaaagtcttgaataaatgtgatttagaaattatgttttttacaaacatattctgcatcttaaaaagtttccaaatatgtcgtgttcaaaagacacaactttattaaggctgtatccttccccagttttctcaactcacatctctcattttccacacgcacgctttttaaactgataaatgttgcgaaagttattttaaaaaatcatactaatcattttttaataaaaatagttaatacttaattaatcatgtaataataaataattaatcatgtaataataaatgcttcgtttggcagcctgaaagtgaattcatggtgtgttcgacaagagagtaaagcagtggtggattgagaatatatgcaaaagccattggtacataattaattgtattaattattttaaacttgaaaatatatttgtatgattttaaaagtaatttttctatctatatatttttttgggataataactagtttagtccctaaagtttctctataggatcagtttagtccctaacattttaaatggtccaaagaaatacttaaactttgtcataaggtgtagaatagttcttgggtccactaaaatcattatatggatatgccatgtcatcattcatgcaaaatctatgatgaattgtccaatatacccttacgtatatcatagaaaaataaatataagggtgaattggacataaccataggaaaaaaatacttatcctttttttcacccttttgaggtatatttttgctcttacattttaccttttgttttttattttcctatgatatatgtaaggttaaattggacaaatcatagattttgcataggaatgtaacatggcatatccatgtggcgattttggtgggaccaaggactatatcaacccacatgacaaaattaaaggacttgtttggacaatatgaaaaattaaggactaaaatgagccatgagcgaaactttaggaatcatattagctattctccctatttttttaaagaaaaccgtttatcagtttaaaaacatgcaagcgaaaaattaagaaatttttctttgccatgccgcttgtctaaacacagcctttcgtatacagcatatagataacccacacagcacatcgtccattgagctatttcaaacagattaatccaattagcgattttgttctataggtgctattaaattgtctatttgatcatcttttttaattaacagttagtaatttaatattcctattctctatttctttcattctatacaatagtgatattcttacgatgactcagcactctaaaatgacactcatgattaattaacaatgaagcatgtgaaatgaaccaaattactactactacggatagtataacttgttgttagtagtacgtggatgaaacatgagccacgggttttttttaagaactcatgagcgagctgttgtttttgcctattgtacatcactacattggtcttgtttgtaatattgctatttaggagtattaaacgtatattattaacaaaatctattttataacctctaggctattttacgagacaaatctaatgttgtatattaatccatgattaacagatgattattgtagcatcactgtaacaaatcatggattaatatacctcgttagattcgtcttataaaataaattaggggttataaaatctatggctgtgtttagatccaaagtttggatccaaacttcagtcattttccatcacatcaacctgtcatatacacataacttttcagtcacatcatctctaattttaaccaaaatttaaactttgcgctggactaaatacaacctatgtttaatatttttaattagtactaagggcagttttgaattgctaccaaaatttgccataccaatattttggtagcataaatagtatccaccatttgtttggattggtgccaacattttagtaatgcccatctcaaatttggtagcaatctagaactttcttcactatgatatcacaatttggctagattttggtagcaaaccaaataagatgaatacaaatttattctaccaaataattggtagtgccaaaacttgcctatgttttggcactaccaaaaaattggtagggcacctatccaaacaagccctaagatttcgaagggctataataacatgaggatccaaacagggccattgatttggctctcctaccgcctcgggatgattttgtttggcagggtccgagtggacgtgtcgtaattcgtactactacgatcgtagcctctccatctccagtgtccagtcccatcccatttccagtccaagccgcttccaccgactccagtaataataatactactcgtactagctctaaataaagatgtcagaattgggcatcgtcttggaatcgtcttggaatttggaagatgtggtggatgtcacaatgaataagcgaggtccggcgacacgcaaccacccttggggatttaaggcgatagccagtaggccaccatagagtagaggcggtgcatatcacgggagttgaggagtgtgtccgagtagtactacacaaggagatggtaaggcctcgttgacaaaaacttttaggtgtgtttagttagggctttgcaaaagtagatagaaaggtggacctatgcaagatggtaatagtagattgaagatgcaccacaatgtatatatgtgtagagtgggtaataaggtgggacccatctgaaaaaaaccctaaacatgagccatgccacaattaaaaaataggtaggatccaccacaaagtgctataacctggtagtaagcttatgacttggcagtagctatttactactttcacaatgtatcttacctagtagtaacaatattttaatccctaatacccacttctccactacattgtggatgcccttacacgttaaaattagaagtttgaagaaattaaaatgatgtgataaaaaagttaaaagttaatgtgtggcctggtttagttcctaactttttctttaaactttcaacttttctatcacatcaaaactttcctacacaggtctgctttagtttccaactttttcttcaaactttcaacttttccatcacataacttttctacacatacaaacttcctatgtgttatcacatcaaaattgaaagtttggttaaaattagaatgatgtgatggaaaagttggaaatttgtgtgtaggaaagttttgatgtgatggaaaagttggaagtttgaagaaaaagtttagaactaaactcggccttccaacttttctgtcagatcgttctaattttactcaaactttcaactttggcatgaactaaacacacccacacacaaacttccaacttttctgtcacatcgttccaatttcaatcaaactttcaattttagcgtgaactaaacacaccatgtatagaaaagttcgatgtgacgaaaaagttggaagtttgaagaaaaaagttgaaatctaaacatggcatttgttctgcgtgtcacatcgaatatacggatatatatttgaagtattaaacatagtctaataataaaacaaattacagattccatcgtaaaaccacgagacgaatttattaaacctaattaatccgtcattagcaaatatttactgtagcaccatattatcaaatcatggtgtaattagggttaaaatattcgtctcgcaatttatgtaattaattttttttctacatttaatactcatacatgtgttatttcgggaactaaacaggtactaactcctgcatcgtcttgcatatctaaactatagattcaaccacaatactactcgtactcctttaatgtcaaaatcataaatcttcctatttccctccgattctataataattattgacgttttgacaaggttgtaattaaacttttataactttaaccgtcaatactaattttaaaaatatttagtttaaagaaattagaacaatgtatacagaggctgtattcggaacacagggttccaacccaatctgtccgcacggaaaacggagcggtccattagcgtattattaattaagtatttgctattttttcaaaaatagatcaatatgattttttaaagcaactttcatatagaaactttttgaaaaaaaaacacaccgtttagcagcttgaaaagcgtacgtgcaaaaaagagagaaaaacgtgcgcgcggaaaagagagatgtaagttgggaaagtggaggaatgaactcagctagatttgtctttcaaaacactataataacaataaacatatatttatttattgtattatactaaaaaataaggtcaaacatatatttgttcaaaacgtcaataaaaatgaaaccggaggagggagtaccttatattttcatcccgaaatcacaagacatttaattcacactaaggcccggtttagttccctaaatttttttcccaaaaacatcacatcgaatctttagacacatgtatggagcattaaatatagataaaaataaaaaataattgcacagttaagggaaaattgcgagatgaatcttttgagtctaattagtccatgattagccataagtactatagtaacccacatgtgctaatgacggattaattaggctcaaaatgttcgtctcgcggtttataggcgagttatgaaattagtttttctttttcattggtttccaaaaacccctttcgacatccggtcaaacatccgatatgaccccaaaaattttcttttcacgaactaaacaaggcctaagctgagttttgcgtgcacgcttttaaactaataaacaatatattttttaaaaaaattctatacaaaagttgcttaaatatcatatttaattcatttttaaattatttttaggtaattcttaattaattatgcattaataaactaccaggtttcccatgcggggaggcagagttccaaactccagctcccaactccctctttttttcatgggataagtccatttgacacccttaaactcttcgtttggtttaaaacgcaccctcaaactttgaaaccggatatgtaacaccgtctaactttcaataccgtttaggccccgtttgacacacctctagctcccaactccaacttacctggagccggaactgggccaaacgttccagatcctccattttttagagtggagttaacagagctactcctaaaaaatgaactagggggtggagcaatgctgctccagaactccactctatcccaaaagacccactaccatttaactttttagactatatacacaaaaataccactcaactacccctccacacctcctctcctcccgttctctctcctcctcccatcttcctctcgatctacgggcagcggtggcagacaacggcagaagtgtctacagcggtaggcagcgtcggcgggaagcagcgggcaacagcagtggcggcggcagcaggcgggacaacgacgggcggcacatgtggagacgacgcgcgaccggcggcatgcctggggatggcgaatggccggtgactgggtttcttttttttcagatctagagctgaaaactaggcaaacattttcaacaagtctccaactccaacaggagctagctcttactggcgctagcgatgaccttgagcttcctctcccacatcacacccctgagcaccgacgaggttgatctttctctccctcatgcctccctgttgatgaaaaatttgcgctcggtcgatggtgccggatttgtgttggcacgaactaagtcgacgaacagaacgtccagggagatctgcttagctccagtgtaggtccaaaatattgatgagatacggacatgctagtcagtttgtcttgcaatttacaagatatataaattgaagatcaaagaaaaaaaaatccagcctcgcaaaaaaaaattgaagatcaaagagccgatcggctgacaagtcgatggggggtaattccaaccgatgctgatattagccgatgtcgatagggttttgagcaatcggctatatgtccaatgtagataatgatataaatacaatcggttggtgataatgtaataagagtagaaaccaatcgactaataatgatatgatagaataaacactaatccgatggttaaaacatacatcggctggaggtttattgtcataaaatccaaatgattagataatcagtgaaacctttgttgcaatcggctaaatccaacttaattgtaatccttataagccgatgcaacgttcagataattcattggctgaatgtaacagccctaaaatttgacaactttttaaaaccgatttagtttgctttgattctctaaaaatataaccgtcgaattagacatttatttaaaatattattttccatacttatttttgatgtttcttttctcgtttaattttgtcgcaaagtgcatatcatccttcaaataattcctttgaatccaaatttaattctatcccgaatgtcgaattctatatattttaatcttccccatattttccttttccctatttccaccttaattttctttttccattttttttcctttctctttccctatttctctgtttttcttccgctctctgtttttccttttctttcttcctctactcggctaggccgagccagctcgtgctgcctcgcgccaaacccgtgccgccttgagcccagctcatgccggcccgcgcatgccacacgctcgcaagcgcgcacacgaggacgaacgacgaacgaatgcccggacgacacctccagcttcctgcctccataattccgtcgttcctcaactagaaggctcaagaccggaggcaaaagaagcgcaatttcaacctctttcacctcctcaaatccgcaccaacccccgctgactcaatcatcatcaccggaggaaaaatccccgaaaccctaattttgcgccattcacagagcttcaaaattcgtcgcatacgttgcaaatcttctgaaattgaaggtaaaaacggatttgacgtgccgagtactcccattcccttctgttttcccatccaatccgacgccggagtgccgccgtttccgcctcccggcgtcgccgctctgttcggccgcctccagccgcacggcgcgccgccgctcccggcctccccaggctgagccgccgctaccaccacgctccccttgctccactgatgctcaccatatccgccgccctcacctgagttcgccggaaccaccgtcgccatggccgccgccgtctccagctcctggccgccgtcgccagcctcgccaccggcgcttctctcgccgcagaccacaaaaacggaatcggctcgacttatagatcgcaaaaccggcgccccctttcccaaaaccggccatcttcaccgctggcgccagggagttgccgaccggctcccgtgcacagaacgagatgaataggaaatctgattttcctgttgaaaaataaataagaaaaaacatttttattttcctatcaagttgaccatccgtttgagctcgaaatcaaaatccgagacctattccaaactcctagaattattccgaatccaaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaatagaaagcactgacgttggtccggtagtcggagcaagtgaaatctccgcgccaggaggagacggtttgtacgactacatcgagcccgaaggttgcaagacatgcaccctcccttgaacaatttaatcccagtagttagagagttattttggtagcgtactcgtcctttggagtacgatagactgcacgaattcttttaaattaattatattactattattgcattatattttctgttgttgttataaacaccttaatgagccttagagtataacaaacttaggataaaatttgagaaacacctaaacaaatggttaattatttaacatgctattgatttaatatggatattattactgcatatgaaaacatgcttatggaactatttatggctatatgctgagaattgttggcaccgcatgtgagcgggtggtacacataatagagttcatgtgtttggttttatggacctgtttatggtcgtgttgaatatatggatatatttatggctatttcttatttaaaattgatataataatcaacccccttatgtcaataagaatgacatagtttcgccatccacacgatcgagttatcgaacctggccgtatattgctctaattgattaaacttctgcatgcctttcggtgtactggccattagctttcaagtgtgtgaagcaaagtgacatggttcatgtttatatgatttatatatgtgggctcgatgggccccgagagttcagaactgccctattggcccatgaagttctgggctgcccatcgagtaacgaacaatggtaagtggatgtggaggtaggttggcacacacctcggactggatcactccgagcaacatctcgagcatcctttaacttactaggcagaagggagagatatatggagcaatattacaccttgttacttttcagcctggccagctatgggtatcgtgtaggtaaagctgggcagacgctacagagtcgttgagtattcgaaaacgccgtgctcccgattagtggagatgtgtctatgggtgattccagattatgggcacaagttaaactaaatggctattaattaatatggttaacttatttattacttgatggtctattcaagttatttataagtaacatttatatttttatgctcattattactgtttaaattaaatgttcaatagtgatgtttatatcaaatgtttattaagataggctctatgaaataactgttaaggttagggtttaaaccttccagctcttaatattgcatgttttatattgcaattattgtatttgttatcataagcatgtcttgctgagtaccttttgtactcataaatgggttcagatcataaggaggaggatgcttgtgaagatcatgttgatccgttagagtgggacagctatggtttctaggtcattctacgctcaggcagttcctgtggtggagtctagcagtttatctgtttgtagaaataaggctttgtaggccatatatgtaatggtttgtatttgtgttctgttgtgaactaagtgacttaagtattgtataattgaagtttatgcttttatatcatttcatgcataactgaacatcctgggcagttacgtattcgtagggcaccatgactttatcaggtgtccccacactgaaaccccgataaaacccttattggcaataaaaagcacgctagagattatgattctaagcattactagaaaaagtaacaatttcggcatttatatattacttagattgatgactccatcttttcaattatacttatgcttgttcgtatcgcttattactaaaaaaaatatgggtaaaactttttgtgcatgtccttaacaattgaaaaacaaatgttgcaaaataaactatgataaaaaatacaaaatttggcttatatgcataagcaaaacgataaagatgttagggagagtggagaaggagagattgtattggaattgtcgagtgaaatgaaaaaaaaaatctactacaaacaaacttacgagtgtattccaatgaaattttacaattcaaaatctatatctatatctatgcctaattaaaaaataagtaagacttccgaaacgtttttgtccgtcgttgtttttatatgtgtggtacgcgatttttcatttggccaagcagactctactacacgagatcgccatccgtatcctgtgcaaattccaatatatcccaatagaaacacataaattgaactttcagttgaattgaataaagatcaaagaaccatacgcatagatgggaatgccaacaaaattattttcaagtattttcttgcattcgctagcatttgatcctaacaattcaaatagaaaataggaaaaaaatcaggcaaccatttggaaactcaaagttgacgacaacaaagatgaggacgacggctcgtcctcccatctgcctccgcctcaacccaattcgcttttttttggcgagggggggggggggggggggcatgttgttctccccgatatcggtgctcatagaatcaactagccgcgcggaagcttcgctcgtggtgttgctcacgaagtcgaggggagaggaagaggaataatgtagggtcagggattcagcatggctatgtttatctaaatcacgacagaccatcaccgtttgatcgaatacggcgactctcagcgcacctacgccgacttgagccgtagcctaccacgtaggtctgtgcacttaacagtcgcggtgtgaaaaagatatatggcagggtcgtgcttctaattgtgggcttatttatgttttgcttattccccattgatttagatatttttttcaccaacaaaattagtgtaattagcacgatttgagccattaaaaattgctgaaatttgatatagtttttccttcttcatattaaattattcctacctaaatggagtcaacaaatagtataattatatatttgccacggtatagagttatttcttgaccatagttgtttgtaatttcatgtcattatttttatgactatattgaattatcatttatgtccagcagtatcccagctaatttccgtgaaactcaggaaccatgttggttttacctttttttttttaagaataattagagtacgtgtttgattttagaaatgatatcacatgttttccatgcgagagttgagagagagagagagagttatcagaatttgagtatatccatatgcaatagtgtttttttatccgttctatgagtatatcaatcatgcgctaatatctttctttctttgtgcgtgttaattttatcttcatcttcattaaaaaaacaccaacttactagttcatgtggggtattagaggtagggcccataactagagaaaattaatgcagtatataaaacatccataggaatctcaccaaagatatagcttgcaagtaagagcatcttcaacggagttgccaaaccactctccaagacaaaatttagcaaatgtggaagaaaaatgccctccaacagcctctccaaccggctctccaagctatccaactgggccaaatacacctctccatggccaaatctggccagcctcgtcgacgtcgccaccaccaccttcctcttctacgccgacctttgtcacgacgctgcactggcaccggcacggtcctgcgttgcatcccctgcacggcaccggcacgttcctcgctggcactgcttcctccgtgacggcccccatcattttccctccctcgcctccggctctcctgataccgctgtcaccctagctcctcccgaagggggaggaccgccggcgcccccgtcgtcgaggtcaccgtcgccatccgccgctgcctaggcatctttcccatccccctctctatcctgcatctctgccattgcggcctccccatccgccgccatcgctgccgccagtgacaaccaccaccatccactgccacccctgagaccaccttttaccttttctactttttatttatcatccggcggaacttggcacctgacgcggggatgcatcggttttcgatctctggcgaagggataagtccaatgttccgccggcccagacaattgtattggatacattggcgtcgttcaaggctgcatcagtgtattcaacctcttgggttgctccggtttggttaatatatttgcctgcctatttatcatatgtcttagtaatctagttttagtatctcaatttagctctatcggctgtctctagctttatggtttctgccggtatcggctaaattgttttattagattagattagctaaggcatctatcaccctaaaaattagtcaagagcttgattgtctagatattatgtttcttttcatacttagtgctgcatcagttaagtttgatctactaagtcgtgcttagaaccataatctctagcctgatagttgattgccaataaggttttcatcggggtttcagccgatgagttatctaaacgttgcatcggcttacaaggattacatattagttggatttagccaatgataacaaaggtttcactgtttaatctaatcttgtggattttatgacatcggacctccagccgacgtatgatttaacctttcggatcagtgcatattctatcatctcattattagccgattggtttctactggattacatttaggggtgggcatttggtctaaccgaaaatttcggtctcggtcttcggtctttcggtcttttcggtctttgaaaagtgaagaccgaatttcagcgcaaaaatgttaggaccgacaaattcggtctcggtcttttcggtctcggtctcggtcctgaccgaaattcaacaacattttcatatatgcaaagaaataatggaaattttcaacacaaaaatcacaaaaaaatttcataagcacttatgagtaaagactcttgttaggttgcatgcctagaagaagtagagatgtgaaaattagagtttaatcctattaaacatagtggattgtaggttgcatttagacgttttttgataattcggtcttttcggtctattcggttaaccgaggagactaaccgaattgaccgaataaaattcggtctttcactacctaggaccgaattgatgaccgaatttctcggtctcggtcttttcggtctctgtctcggtcttttcggttcggtctttttctgcccacccctatttacattgttatttattattatcagccaattgtctttatttactcaagtatcaagatctacattggatatatagccgatagctcaaaaccctatcgctatcggatggtatctgctatttgtatatcttgtcagttgcagggtcaaactgactggcacgtccgcatcccaccaagatttggacctgcaagctaagaagatctcctaggccgttgctgttgtcgacctagtccgcgccaacacaattccggcaccatcggccgagcgcggatttctcatcaacacgggtgtagggatcatcgcagttgaagcacaaccccttccgccgtcgctcatccatctccggcggcgtcagacggcaaaccgtgcggctggccacctgagcggacgattggcccactgaagatgtcgtatctgagaggcaaagaggtaggcgcagccgatgatgatgccagcacccaagcgtccctgcacggcatggcgcagcacgcatggcgaactcacggcgttcataggaacgcgctaaactcatggcgacctccaaggtggttgggtattgaagctgcatgtcgatgcttaacggttcttggagaccggtggtgaagagatccatttgctagtcctcaatgaggggaccggcgcgagcgagcaggtcgaggaagcggtcgatgtagacagccaccatagtcatacgccggcaggcggcgagctcgcccagggcgcctagcgcaggggcgatccgaaatgcaaattaagaaggtcggagaagcgacgccaggttggggtacccaggtcacgttcgacgcacatgtaccattggcgtgccgcgtcgagcagatggtaagacgcgagccaaaccttctcctcttccggcgtacggaaatggagcgggtcgccctaatcgtcgaacttggggaaatcaatcttgtggtagcgcggtggccgatcaccgtggcgaccgtcgctgtcgcggtccccatcagcatcacggtcgccagggtgctgatgacgttcgcggccagcccgttccaggcgctggatcgcaatgtgatgcgcttcctgctggttgtccaggtcagaaagtttcccccggatggagtcaaggtgatcaaggaccttagcgagaccctttttccagttttcgccgacgttggtgacggttgtcatggcgcggcggcggtgttggtgagcaggatcgtggaagtctgataccaagatgttaggaactgggccgaaacggcgtagggcgtagccgtgctcgacaggacggcgaggctgcacacctcgtcgccttggatccgtggtggaaacaacgagaatttagggataacttgttgcttacttcattactctgatcgaatggtatatataggtggtgttcttttcttctaaagacgaagattaagattaagttttttacacaaaatgaggtggtattaacgtatgattgattgtgttttaattattacaaacttgaaaattagattaatatgattttttagaacaactttcatatataaagttttcgcatgaaacacaccgtttagcagtttgaaaagcgtgccatgaaaaccttaatcttcatcttattggaaaaaagaagggaccatagccttacaatggaactaatctgctaattaaaagggaataacaaactcctaaacaaaacacctaacttctgacgaactaatccaatccttgcgatatcactgtgcctgcgtcggcttctcgttccttcccttccgcttaaacgttaatacccacataacatgccttgtgttgaaagcctccaggttcgtaacactatgacgcacatagaaccatatacagggtgtgtttagttcacgccaaaattaaaagtttagttgaaattaaaacgatatgatggaaaagttagaagtttatgtatgtaggaaagttttgatgtgatgaaaaatttggaagtttggagaaaaagtttggaactaaacaaggccacaaaatggagcgtgatgcacaatcaatcagaattaatgaataatagtgaaacctggaataaagaaaaatagaagtataaagagatacctgctcaaaattagatatgccagagaacttgatggacacggatgcaccacatcaggtagggttttgcatcagtgcaacagttgatttctttggtgttaagactccagagaatacagctccagtattatttggtcgttcaacaccttgttggaagatcaacatggagggttttgctcattgtcaaatcctccttgcgtatatgcgactgaacagtacacaacagaagtccagaaactggaaaatagatattaataaatatatattggctgtgtttagttcatggcaaaattgaaagtttggttgaaattggaaagatgtaacggaaaagttgaaagtttatgtgagtagaaaagtttgatgtgatgaaaaaagttggaagtttaaagaaaaatttgaatctaaacacggtgattgttaggtttgatagtacttttgtggtgcaaactagagtaaccttgcatttcaatcgcttaaaaaaagcttctcatcccgtgaaaattgtattctgagagaacaaaatcattgtaaaatgaaaactatgatcacatgcagtagtatcacaaaagttgcatgccaacaactacaaatgctacaaaagaatggaaatttacacatttctaatgtctcaataatacctacaactactcagccaggccttcaacgaagatcgatggcaacgctggatcgataatcaggtccttgccttctgtttatctaggtataacattaagaatccttccaggcacataaattctcttcctgatgcccttcccagtcaaatatttggagagtttctcgtcggaggctgctatttggaatgcatcatcctcagagcactctttgtcgacaagaattgtacccctggtcttcccattgatttgcactggaagcacgagctttgattctttcaagtactcactttttccctgacagaaaagaaaaaattcgctaaaatttatggtaatccatggaaaagtttatatcatacccataggtagaacttttaatatcagacatgtagaacaccatggaaggtttgcacactttctggctgatgtgcagaagcatggaatgtttagggttacctctggaaattgctcgtgggccaatgatcttgagttcccaaggcgaaaccaaagctcctcagccatgtgtggtgcaaaaggcgaaagcaacagaataaaggattcaataactgactttggttgggtgtcccactgtaagaagaaagcacaatgagagaagtaaaaaaacacgtctaccagagtacaggttttgttgccaatgccatgttaaactgatctcatcttccattcttttgcacttcaatttgaatactcaagacatcctattgggttttactgacatcaggtttataaattgcaagaggttctgtgccaatttaccaagtgctaagcagaaaatgaagaagtacaggcacaaaagttcttaagcacattttaagccttgctgcacgaaagcacatatataagcttgcttggatttgaataactgcagtacaaacaccagctccatattcctgccttaggctgtattcttttcccctctttcccaactcatttccctcgttttccgcgcgcacgcttttgaaaatgctaaatagtgtattttttgcaaaagttttctatatgaaagttgctttaaaaatcatattaatccatttttcaagtttttttaggttagtacttaattaatctcaccataatcgtgtgcttcgttttccgtgtcagttgggaaccttgcctcctgaatacaacctaatcattgactagcgatgatataacaatggagacatacggtaaaataatccgagcaaaatattttggaaattccaggcaaataacttgaattttaacaaagcagacacattttttaaacttatgttcatatgggaacagtgtatacaaaacattatgctggttatttaatagcaaagtcatctggcatggaacttaaatagataatgtgtaggcaactacaaaatggatatgcaataaaattatataaatgacggcaacaacttcatttaaaagtatgaaactatgcatgtaaacattacttaaggttaccttgtatgcagcattcacaaattccatcattgcagaaattgcagtgttaaatcttgtttcttgaatttcctctgtgacctataaaacataacaatacattatagtcatcaatcaccaatcacatcagcacaactacaggaaaaaaattatcagtgcataatcatgtttagcagtaaggagaccctgagaattgtgtgatgatacaatcttgaaatagtcagtacataggcaaagcttttcacagggtaactgataggggaacagttgcaaagtaccattacaactaatccatctcaatattggaagcataaaaggtacaaaaataattgaaatggtggcacaggctgtaaaattaattaatagaatttatattccccaaagggcatgtcatgtataggaattatgtgccgggaacttggtaaaactgtacaaatttccaaaccaaactgctagtaaacctaaaattttgaatggctttcatttcagagtgaattagtgaaaagatgttatgtgatcatgctgtcaactgtgacgtactcttgcaatgcatttgtgaagaactcggagctgatccaaggttggttcctcatcagtaaccgtagttccaactccatatgatccatctggtaatggtgtaccaactacgagtctccatgtccttcctagaaatctatgcacaccttcaattccaccagtgctccatgtttttgaatctctgtgtacatcagatattctgtcagctttctaaaatggctgtaacttcatctgtaatatggatgcatacctcagtggtcccatgaacatttcatataagcggagagaatcagcaccatattctgaaaccacgtcatctgggttgatgacatttcctcgacttttactcattttataagcacgagcgtttagacgtatgtttgcatcatccttcagtacataatgatctccaacttttgtgacctttaaaaacatagaagaaagaaaaaaaatcaaactaaaaaacttttatcatgccaattgaataaagttataaatgtaccagagcccaccttatctgcaggtactttttcttggtagcaatcaatcaaacttgagttggaatctgcagaaacccatctccctttattgtctctatatgcagtatattcaacctgttatgatattacctgttaggaacacatgcacaagatagtaacgaacatgggcaacttttggaggtaattagtttcacctacttctcctagaatcaatccttgatttatcaggcacttgaagggctctttagtggaaactacgccaatatcataaagaacctaacatagaaatcagttagtttgaagataaggaatgccaaaaggaaccagtagatttgcatgctacagagtacagaaataaaaacaaattaatggcataagctgggaggaaaaacaaatgcaaataagtttactcaaaagaaaaaaaaacaatgcaaacgagaaagtaaccgcctgtacccggatttcttaagaataagtcagtcccctcgggaaaaaaatcatattaaagcagcaaaatctaatacaattgaacaaacagacacgatcaacaagataaactaaatggtttgtatatatttgcacgtcaaaaacttgctagtagcatccgatagaattatcaaagagcagatatttgtccatggaaaaagagaagtcagaaccttatgccaaaatcttgcataaagcaaatgcaagacagaatgttcagcaccaccaacatagatgtcaactgggccccaataactgcatgatgccaaaaaaagggaaaagaataagtaacagaatacatgatatcccttactgaggtcatatgaaagaaggagcacctctcttttgccttgtcaaccaacatactggcattttgaggatccataaatctcaaataatacctgaaaacattgaaatgttagggtttagaagccacttgtaaatttaagagcatatttcaacatggcaataaagattttcgagtgcgatagcgttagcaattgatatatctataactaatataaatattcgtatttttccggtcgtcacatctaattttcgtccgtttttcgtccatacacaatccgattcggttagcaatagccatggaaaaaaaattgcaaaaaaaaaaaaaaaaaaaatcggcggccgccgacgcctccaccgccgccggagggagaagagaggcggcggagggagcgccgctgccagatccgcccgcggtggccgccaccgccgacggatccaccctcggacgaagccaacgccgtcggcgccgccgttgagagggcgccgtcgaggccgacggggagagggagagggggagggagggacggccatctccgccgtctccgccgcaccccgccatcgccgtgccgcccacaccccgcaccccgcaccccgccgtcgccgtcgcccgcgccataccccgcaccccgccgtggggcttttaactatttgccactcttacgaatggtccttaacgatttgccactaggcccacatgtcatagacacatgagggcccacgtgtcattgacagagcgtggcaaatcgttaattgccatgtcacaagagtggcaaatagttaaatttcccccccgccgtcgcccgcgccatgccgacgagagggagagggagcggtccaccatcgccgccgcaccccgccgtcgcccgcgccgtgccggtgggacggaagggagagggggagagggagcggcaccgccggaggggaggggagaggaagcggcgccggtggggagaggagaggaagcggcgccggtggggagaggagggggagaggcggcgtcaggggcgagggaggcggccggctcggctgggggggagggggccgcctgaggggaggggagggggagagccggtgttgggggcggtggaagcggccggctcggctaggtgaagggggagggggagggttagggttagggtttcatccatttcaaaattatctgagccgtccatcaaaatgaacagctgagatcgatcaagggtttgggccgcaccacttgggccgcacgcgggccaacagtctagcaagcgagaggaagagtatagggatataaattagactttggtcacttgtaggctgaagaagaaagtgggccgaaaaaggcccatagagataaaagaatttttatttagatttttatttaaataaatacttaaatgatgtttgtattatcaaaattagcaattaagctacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattacagaaaatttatatttcatttaattagaatttaatatgttctaattcaattttatctttttttctttcacgatgcgagctaagcaggaatatttttatccatcttgattatcattagcgcaataaataatttacctatcttggaacattattatatacatgttaacggtgtactttatagaatttaacagttcctttacccgtagtgaagcacgggcattttgctagttaaaacaaacattgatagacgcagtctatttggagtcaattatgtaaattgttataaaattattgaaattgtgtcatgaataagttaccagcatgatccagcccattgtggcatggtgcttgtttcccttctagcaggcttcccagacaaaggttctacggttttaacctaaaaaggcagcaaaaccttttaatagatttgctatgtataagcaaaagtaagggggactaaaacctcaaaacacatctccatgccaactttgccgaacatataaatataaatatactaacaggtagtagtttaaattagatctcatcattcaattccgatatgattgatagaaacatactgactaggagtgttctcagtcattacaaaagaagcaacaaattgttagtaccaaactgctaacaacacatacccaatctgttgccttggtcagaggaggctctccagtaccagttggagtgaaatcatccaattcaggaagagttaaaggcaactggttttcttgaaggggcagcatttcattggtatcatcacggtaaatcacagggaaaggttcaccccaataacgctgtctagcaaagagccaatctcgaagcttgtagttcacctgatagttgggtttgcttaattattttatagtgaaagaagtagcatgaagaaggctgttacatgatgaagtgggataaagaatgcacctttttctttccaaagccattagcctctacccattcagtaactttcaaagcagcatccttggaaagcataccatcaatatttaatccagatgaagaactggatgagtttatcatgataccatcatctgcatatgcctcctcagagtcacaattgccattgagtggacttacaaccttaatgattggaagtttatatttcaaggcaaattcatggtcacgtgagtcatgtgcaggcacagccatgatagccccagtgccatagctgcaaggtagcatttaaaatttagagcatgcaaaactaacaagtataaaagtaggtttttcatttcctcagataattgttaaatttactgcgagtgtgggataacaccccgcaattgggtaccgagctcgaattcgcc

SEQ ID NO: 4300 - DNA, 9522 bp, Oryza sativa
agaccccttcacatgcatgtgaataaaagcaaatctaacttccaaatgaagaaatggtttaaaaaatatatactaatcataacaaggaaaatcaaaataatcttcattgagaacctaaagcagagaatgtatgtgacagctccacattcagactgttctgtttaacattacagtaagtagcataaagtgtgtatttattttaagatgttgaattaccatgccctctggcaacctacagtgtagagttaatagcatcatttttgtttcgaagatgaagatgatgatgcacaatgtaacttctgggtacacaggaggcaaagatgttttgacaaaccttcctaaaacataatctgccacccatattggaactatctccccagttgctgggttcttagcataagaaccactaaaaactccagttttttccttctgaagatcagttctttccagttcactctttcttgctgtgagttctatgtattcctctacctgcttttccagttagtctatattatgcttctaaacatgataatggtaatggtgagaaaagggaccaaaaaaacatacatgtacacgttgttcctcagaaattagagatgacaatagagaatgctcgggtgccagaacaacatatctgcaacagaaaaggtgtaatttaacattgaccatctaagagaagactaataattttgtgcaaattaaagaaaggatccagaatacacacgttgcaccaaaaattgtgtcaggtcttgttgtgtaaactaacaaattagcacctagatcgtgcccttccttgtccacagctgagaattcaagctcagcgccttctgatctccctatccagtttctttgcatttctttgatgctctcaggccaatcaagttcatccaaatcttcaagaagtcgatcagcataagatgtaatcctcagcatccactggcgcattggctatacaacaaaatataaaaatcgatcacagtggtatactttattttccatacaggttcttagcaacaggtactttgacacgaaagagtatagatggaagaaaaggctaaactgacaatatagtgcagattctaaaacatacctttcgtataacaggatgaccaccacgttcactgacaccatctattacttcttcattcgccagaacagttccaagagcagggcaccaattaaccggtacctcagcctgattgtaagatagcaatgccagcctaaaaatcattgaaaaccacaaatacaacactaagaacataacagaatcctaaaatgaatggtacagagcagatgatcagttcaaataaaggagatgcgaaacaggaaatgtatcaaacaataaacatgacatgtttgcaattcaaaaaattggacaagcaaggatactagtagcattaacctgataggccagtcctcttttcagtagttgaaggaaaatccattgtgtccatttgtagtaagtcggttccgttgtggaaatttcacgatcccagtcatatgaaaaacctaacgatttgagctgcaacaccagaaagcatatgctccaaataaacgattggtaatcaatgaaggagcaaattagtggcaaactaagctactgatgcaaatcaagtatttcttcagcactgcattaggctctcaggctatgaactatgggtattcctgatgagaattaatcagtatggtcaatcaaagcaagcatcagaatgtatgatttacctaattattttacatcatataacctgcattttatggttgattagtattactccacctttgcaatatggatgaactgataaagcattaggaactcagtagcagaagctaaatgcagcaaacatgctctatttttttaacgcaacctagtgaaaaactaccaccaaaatacagtagtaacatatgtaattgctaaccaaaaatgaaagcatgatggcttcagtttacttgctaccgtgacatcaattaaaaaggtttcaaaatataaatatgacacctgtgagcggaatcgattgatgttccgttcagtggtaatcttagggtgggttcccgtctgtgcaaaatgtaaatcggtcagatcatagcaacgcatcagcacgctataaagaagaataggctaaatgaccaagtcccacaagaaagagtaaaaacctcgatagcatactgctccgcaggaagaccaaatgcatcccatcccatcggatgcaacacattgaagccttgcatgcgcttgaacctcgacaggatgtcagttgccgtgtacccaaggggatgcccaacatgcagcccagctccactgcacaaaaaaaaaaattgcacaatcatgtacaacgaacagcatgtatctaatccaatcatacaattttcgatgagtttatgcatctaattgatccaagtaagaagtaatccaactatccaagtttcgcactacatggtctcagatcaagcttaacccgattacaccattgcagagccaatgtagcagcacagaaagcatagtaagctgaagcaagtgaagcagcaaacctggggtaggggaacatgtcgaggatgtagcacttgggcttggaggtgtcgaggccgtggccgatgtccggggtgcggaacgtgcggtgctcctcccagtgcctctgccacctcggctcgatctcgtcgtacgggtacgccctcctcgcctgcgcctgcgccttcccggcgtcggcgttcgcgcagcagcggcaccacccaccacctcgccgcggattcggcggcgggaacccgctttgcaggcggcggcggtggcgggcagcaacaacggccgggggccgcggctgcagccggagctggagcggcgtctgcatcatcgctaccgccatcggggttgggagcggaggagggagaggagtcgtgatggggaggttggggcgtagccaaatataagcgggaggtggaagaagaagacgagtttaggataaggtttcggaatttcgttcccttttccaaataattaggatgaaaattataaattagaccgattttacttacaagtgtttttctcttcttctttttcttctgctaaattcacacaaaaaaaaatctgtcatcgaagactgatcaattcagaacaacaatctgaagattaaaccagcaaatctaatctagtacaatttcctggatataattcaggaaaaagacacatatagtccatggtggtacaggaagttacatatagtgatgtgacacgaaatttagcatagaactaacagtgctttccaaaatattacatgtaattactctttgtctaaacatagattttttaaaaaaatcatttggtatcagccttctgatttcactgaatgtttgcctcttcactcctctgacaaattccaggtgccaaatgcatgggtaaaaagaatcatagactgacactgtaggagactttggtgaggcctttcttgactcttatgtttgtgacctgaaacattgcaaattagatcaatctccaaatccaaggtttatataagggcaaggtacaaatcacaaatattcagtcatctgccatagaaaggcagcaccaaagtaatggtttgcagaaaacaaattaaggacagatgaatggacacgaagatcatcgattcatgcatcaactagcaatatgcaaaaaaaaaaaaaaaaaaaaggtagtactaattaaatacatctgaatgcacagatgccactaaactgttccagtctttgtgctggatggtttcaaactgataatcatgattgattaccatttttcactgctttatgatttgtgattaagccttcaggaattttgtaaaactctgagaaaatccaaccagtgaaaaatagcaccgaaatatacaccatcaataagcattacctttatgttgttgatgatagagatatcggcaacatgtgtaccaccacaagggccaccaggataatcaccaaatttcacaatgcgaggggtgctatcctgaaacaaaaacattaggccacaaacaattataataattcatgaaataaattagaaacaaaaataaaggtgacatgattcataacactactcagaatttatgatataaagaaaaagaattggaacttaatagtatcacactatcatttcgttatttcagacagtttctatgatagttcatgatgggttcacatataggacgaactcaacactccacatttaaggaaatgtttctgcaactgttgcgaggaaagtaaactggaataactatggagaatccattagaatatacaaaaactaaccatgattttgagcgaatttataattagtacaaccaaaagtccaaaacaaatgcttctgaaaaaaggaacataggactaacttttgaaatgtagctaggcagagcacctccacacaattgagctgcctcctcataaggtaaaatataagctaatacctgcatcaagtgtaaaaaattgaagtcacaagataaacattataaacttcaacaagaacagcttcgtgtgtcttacttttgctcctttagtaattaactcatttgcttctttttccaactcgtttttcttatcctgcaactgatctggtggaatgactcctttatactcaacgaaaggtctgcagtgaacaaagaacacttaattgtgcacacaataatctaactacaaccaaattagtttgagaacacatgataagttggacgcaaaggccaagagtaatcaattgttgttatggagcaacagaataaagcatccaaaacaagcaaccatacccatcagggaaatgatgtcctttcccagggtcgaaatgtgataagccaatattgctcatgcagatgtctatcaaatgccctgcagaatgaagcctgcaagcaaacatcacaggttcagcacgacgattcaacaagaagctaataggtctgcaaatgcacatagcaattattttttttgaaaggaaatgcacatagcaaataaaacatgatgaaacgatgatgattaacgcaaacttcttccatgaggtattgctgatacaacatcatcccaacatagcatcctaatggaaattcatatccaagtcactaaaatcatgcaatagttatcatgccagcaattaattaacagcgacagtatgaataaatgagaagatgtagtttggttgatatggagttatagacttcaagcttgacgatttcaagcaaacatcacaggttcagcacgacgattcaacaagaagctaataggtctgcaaatgcacatagcaattattttttttgaaaggaaatgcacatagcaaataaaacatgatgaaacgatgatgattaacgcaaacttcttccaagaggtattgctcatacaacatcatcccaacatagcatcctaatggaaattcatatccaagtcactaaaatcatgtgatagttatcatgccagcaattaattaaccgcgacagtatgaataaataagaagatgtagtttggttgatatggagttatagacttcaagcttgacgatttcagtaaaatttcttggcgtctcaatacaagtttacaccgtgcacacctggaatttaagttgcggcgttccgcatcgacttccaagctaacgctctgcccttcactgaacccggaattgcatccatctccagcatcctcaaatctcccatagtggaaaaccttgatttaccagcacaaatactcaattagcctaaaaaaaataaatccaacatcctcagcaagcttgtatccttttcgagttctcggttctcaccactccatccttcatccgcacatcatcgacgatgaacctggtgccgccgccagcggagatgacgccggtgtcggccggctggccgccgccctgcgggtagaagacggtggagtccaccaacaccgctcgccggcccccctcctcctgccgacgagacaccaggggcttagtctagtcaggctctagggttttgcgcgcgctctacagtacggccgcttgttcgtgcacatggatggggcaagatcctgaggagaggagaggggaacctggaggagggagacgacggtggcggtggagctgagggcccacatgtcatcgaagtacgcgagcttggtggggcccatggccctcgccggagctgcggcctccgttcccatctccgcgggggtggagatcaccgccggtgggcagaatggagcgccgagtcgttcgaagttcgaactcccaaatttttggaacaaccttgggtgagatgaaatgaaatgagatgcatatttatagcctcatatgctacaagtcaattcaaatacgcggatcgaaaagaaaaggtagtattcggttaaaaaaattagaatgtcccagcatatagttgaatttgaccaaaattatagtgatctttgcaaaggttttcagaagaagacaaggaagtagaagtaagccggcagctgtggaaaccgtatataattccatacgaagtttccaggagctaactgcttccaataaccttcgatcatctgctcaaaaagttggatgctttttaccccttaaatttaacaaatgtaacaaaagcactactatacttgttgttttcagacatgttatctgcgtgttactcatatctagtactaatcagaaaatctatcgtatggtattccgtggagacggaatagtactactgccttatctcctgttcccctcttccagtctcttcccctccactcactctctctctctctcttttcccctccactcgatccctctctctgtaactaccacccatgagcacggaggcggcgacgacggtgacgacgacggcagcaacgacgacgacagcgacggcggcaacgacggcgacgatggcggcggcaacgacggcgacgacaacgacggcggcgccgtcaccaccagcccccgcgaacgacctagacgacagccagcggagctcccgaccaccacgggcgacggccgccatcgagaagcctccccatcaagctcctcaaggcgctcctcctcttcgtcgttcttgtcggtagcttccttgccgctgccgcctcctcctccttggcggcgctggcgcctcctacggtcggagagcggtggacgcggccaccgggggcgagcgcttggcacaacatgagcgacgaggagctgctctaggcggtgtcgatggagccacgggttcggcggtttggagcgaggcacgacgacgagcgacggaatggcacaaggtaggcaccagatctatcgcctcctcttcctcttcctccgccgccgccccgctgctcgacttccctaacccgcgactcctcctcctcctcctctctcttgggatatcacgctgatacccaggtaccaaggcctgatacctaggtatcagctcgatacccagggtaccaggtatcagtcaatacccaggtaccaaagcctgatacctaggtaccaagccctgataactaggtatcagctcgatacccagggtaccaggtatcagtcgatacctaggggtatcagtcgatacctaggtaccaagacctgatacctaggtaccaaggcctgatacctaggtatcagctcgatacccagggtaccgggtttcagtcgataccagggtgtaccaggtatcggtcgataccagtgtaccaggtaccacctcggtaccttatccaagataccagggaggattggataaggtggaatcgcaggatagcgtgggcctccccacgaaattgatgatgcgtattaaatctctcgggattttagttatcccgtgactgctaggagcaacggaataccgtggggtagcagccctcactactatttcactactacagtattatgcaacaatcagcactgccatcacatgatcttcgatggttccagagaaaggcattagacttccatgcttccaggaaaatctgtgaaagccgccgggttcagtaatcacaaggggatgatggtcaattatctcataatatactccatatgctttgcatctatgctcaatcgtttggcattctataccaacacaatttacaggtacaggcagacatcatcgaactggtatcattttcaatacttcgtttttttacacatgtagaagatgaaaaattatctatacataaactgaactgaacatcctggaatgatgactgaactgaatcttcagagttcatggaacacgcttacatctgcaccagtaagccactccccctcctctgccttgtgccacagcgatttcctcatcaacatagaaccacacaaagaaagggtcctttgtgctcggctccctaccatcattgccacctccgaggctgatttcgagggggccgaaagggccgacctttatgcgaacccgctcgaagatgaatgcgagtatcttcttcttccatgacagcctcccctcaaaggttaaggacccaacaggccccaaatacacgccattctcaatcctctttccctgtacaggttcaggagatgtggatgaataacacacagtatatagcagataacagtagcaaacatttgcaaatttcaagaacaatgaagccttttgcagcaaattcaggttaagtttgtcggttccctgtctttatcagtatcaaatagttaccacggtagtatcacagaagatggtttacaaagggggtttcttgcagtgttcaggaaacagtaagcagtaaaaacattaaactacaacatctgtgctgtcaggttcgtgcatggtgttgggccaaatttccctccacatggagcctttgctctcagcccattgcagcccaaaagtccaacaaatgtgagccattgattcatgtgttgattaatggtggagattgcctcatcctttgtgatgggaagaaaaaccgtagcctccattaagagaggttagagcagcagccattgaggaagtgaaagaaccaacaaaacacaagagagggagaggagagtggagaataagagtggcagtttgttcagcttggggctcttacccgatcttcatcaagtcagcgattggaggctcaaacgtggttggattagcaccaaacttggtgagtttgttcctcactttaagcactttaatttgattagtttgtgtgaggattggttgagtagagcaccggatttgagtggtggtttgtcagctcgagttactgcagttacagcttgcacaacagttggtagaatgttagtttgagggatcaaacggtgtccgattgggctgttttttttttggatatcttggaagggactcatagaccatcatttttgccaagtttagtgcaatttgcatctgtggtttgggagatctcatctgagaaccgaaaaggacataatccgctatttctttgcttatttgttgatatatctcttgttagctttgatggttgatgttgatgatgccaaatgtgtaacttgatgttatagctgctgttgtgatgtgcctctagatgttctagagaagactccatatgtacccattgttgattatggtggaagcttggagtggactgttggtctcgtggtttttactcctcacaccgagtatgtttttccac

SEQ ID NO: 4301 - DNA, 2351 bp, Oryza sativa
ggattgattgtgtgaaatatgtttgccagttggtgaattgtagtttgcacatgaagtgatttggttcagccccaacaaagtggtactagagttgtaactgcagtaactcaagctgacaaaccaccactcaaatccggtgctctactcaaccaatcctcacacaaactgatcagattgaagtgctcaaagtgaggaacaaactcaccaagtttggtgccaatccaaccacgtttgagccttcaatcgctgacttgatgaagattgggtaagagcccccccaacttgaacaaactgcaactctttttctccactctcatctccctcttttgctggttctttcacctctctcaatggcttctgctctcacctctctcaatggaggctagggtttttctttccatgaccaaggatacgccaagctctaccggtgacccacacgtgtacccatgcctggaagccgctgggccgtcgcgctgggatcgcctgagagcaaaggctcaatgactttcggaaggtagtgaggtgcttcatgatgtcgggagggggagtttgttgggccaaatttccctccttatggagcctttgttctcagtccattgtagcctaaaagtccaacaaatgtgagccatgattcatgtgttgatcaatgatggagattgtctcatcctttatgatgggaagaaaaaccctagcctacattgagatgtgagagcagcatccattgagaaagtgaatgaaccagcaaaacacaagagagggagaggagagtggagaagaaggccccgtttggcacagctctagcttccaactccaacttacctggaaccggaactgtgccaaacggttcagatcctccatttttgggagtggagttagcagagctactcctaaaaaatgaactacgagggtggagttgggtttttgctgctccacagctccactccaacctaatagacccactaccatctaattttttaacatatttacacaaaaataccactgaaccacaccaaactcacctcctcacccctctctctctctccctcctgtaaccctcacctctcccacgacaggcgcacaggcggcggggtcgacagctcacggcttggaggcgcacggctgacggcgcgtgcggggacaacacggcgacggtgggtggcgcgtgggggacggtgcgcggcccgcgaccggcgacgcacacgggacggcaacctagggattcacgagagataagggattgttttttttccatttttttttaatttcagatctggagctgaatactagccaaacacttttcaactggtctccaatcccacaggagccagctcccattggagtgggagtttagagctaggagttgtagtttggagctagcagttggtagaatgtcagtttgagggatcaaatggtgtccgattgggctgttttttggataactttgaagggactcagaccatcatttctgtcaagttttgtgcaatttgcatctgtggtttggaagatctcagctgagaaccgaacaagacagaatcttctatttctctgcttgtttgttgatatacctcttgttaactttgatggttgatgttgatgatgccaagtgtgtaacttgatgttatagttgatgttgtgatgtgtctctagatgtagaagactccatttgtaccaattgttgattatagtggaagcttggagtgaaccgttggtcctgtggttttttcctcctcacaccgaggaggtttttcaacgtaaatcaccgtgtcttgtatgcatgtgtttattgttgtttcgttgctgatttgctagttgaaactatactcaaagtttatggcaagatgaggggttgattgtgtgaaatatgtttgccggtcgatgaattgtagtttgcacatgaagtgatttggttcagccccaacaaagtggcaactgggctgctaaagcataaagattctattatcatggcaagtaacgaagagagcttactgcagcatcaaagcgctggactgcggtcactgggaagtactgtcctttctccagccgaccctgcaaagacattttcagttctttcagtttcaccaccaactaagcaaccaagcacgattttttccattttctttcagaaacaccaaaatggctgctcctctcgcgagcaatgaggcgcatgttggtgaccttagcagtgaagatgagcatccatgtcctgcccggggactgtgtcccaccgagggtctcgaagaaggtggatgtgtcgagctttgccttcttgatcttggccaatgccgcgagcaactccggcgacggcaccttcctcgtcttggccgcctccttcagcaccttcacgctctccg

SEQ ID NO: 4302 - DNA, 11453 bp, Oryza sativa
  unsure (1)..(11453): unsure at all n locations
nnnnnnnnnnnnnnnnnnnnnnnnnnnnnnnnnnnnnnnnagcttactgcagcatcaaagcgctggactgcggtcactgggaagtactgtcctttctccagccgaccctgcaaagacattttcagttctttcagtttcaccaccaactaagcaaccaagcacgattttttccattttctttcagaaacaccaaaatggctgctcctctcgcgagcaatgaggcgcatgttggtgaccttagcagtgaagatgagcatccatgtcctgcccggggactgtgtcccaccgagggtctcgaagaaggtggatgtgtcgagctttgccttcttgatcttggccaatgccgcgagcaactccggcgacggcaccttcctcgtcttggccgcctccttcagcaccttcacgctctccgccacggcctacgctaaatccacatcaaaaaaaaccaaaccatttttactctttcaccaatcactaggaagagaaattgatgggaaagaaaaaaaaaggaaaaaaaaaagagatggggatctttgcaaagggatactcaccgacagatcaccaggggatttctcctgcggcgagggcgagggcgattgcgagggctccttctctaagtccggtgaggcggcggaggaagcggcgagcgagaggcggcggccgcgacggcggtggggggagccgcggatggcgaggtgctggggcggcggcttgcggagtggcgagaggacggggacgaaggtggaaggaggagggagcaaggaggcagacgacaacgccgccattggcgagagacggggagctcgcagtcgcaggtgtgtgtggctgcagtgctggggaaggaacgagaggccatggcgacgagcagacgtggacagggttagctcgcccagtggccaccacctgccacttggtcactctcattctgaaaccaggattagcatgttgaagacaagtcagtttagttatgcaaacaaattcatgaaatcattctagcaacttgatcggcactgggaaaaaaaccaggaatttatagaatttatatggtttctatgaaatttctactgtggttatatctaacacatggacaaattttactttgctccatagcaggttgaaaaattaaaatatcctcttcgttcaaaaaaaaaatcttaattgaagtgtagtggtagtttgtatgttagttcatttttcctcaacctgtataagataggatgtgcttattttaccctgacgataggatgttgctttcttgtttatataaggagttttttgatgataaaaaagatggcgtaaagtctataatctaataatctcataatttttcaaatgtatggaaataattgaacaacctgtgattgtgattatgtttaatttttattcatctacatattatgatgatatcttcactttttttaataagcaacatgattgctcatctttgtattaaaagaaataatttatgtgcaaaaccaaaaagaaatgggggagagggaataaaaaaaagaaagaaaagaaagactgcctatgatctaatctcacgatgactttaaaatgaccacgccatacagttattacagcgataaggtcgacatcggagaccaggatatatttgcatttgctttagagtttttaacgtatatgatgaattagtacctacgcaaattgtaataagtaccatccttcgttttacgttagcactctttcatccttactatcaaggtgaaggaaaccccaaacacaattatgatatgagctgatattgttattcatctcaacttttctttttgaatgcgcttataatttctttcctctagttatttatttattatagctagacaaaacaataaacacaatcagattacagcttccctgctgtttcgttttctaattctgggatgcaccttcttttctttctgaagaagaagaaaaaaaaagagaggagaaagaaaagaaaaaaaaaatttctccaaagaagaagagagcgtgtacaattcagtctcctcctacctccccggagcccgacgagatcccgccaccgccacctctcctcctcgccgcgcccggcgacctcctcctccacatgctcctccggtcggcgccgcgccgcctccaccacctccgcccgcaccacctctctaccgccgccgccctcgcggcggcgccgccgaccccgaccgagtggaccacggcgccggtcgcctccgtcggcgcggccaccgccgacgcgtccctcttccacgtctccctcgacctctcctcccgcgccgacctcctcgcctcccacgtcgccgccggccagttcctccccttccgcctccccgccgcgccctacccgatcttcctcgccatctcctcctcccctcccgcgccgggcctcgcgacctccttcgatttcctcgttaagcgactccccggcaccccctccgcgtgcctctgcgacctgcgccccggcgacctcgtccacgtcggcggcagcgtcgtcggccgcggattcgaggtcggcaggatcgctgacgcgcgcgatgtcctcgtcttcgccaccggatccgggatcaggtaacctacatgctcctctgcgacaagggcttcctcaaatcctcgtcaaaattcgctcacactagtgacctaaaccgattatagatgcccttgtgagatgtaatggctaattagaatctgtgcaagtcgatttcaatagatttatagatgatagaaatgatagtccccaccgtatgcatttgcatttcagatgatttagttgctgaatagctgcagaatgcatgtctgttttatgctgccacatgccaaaagctgtatctttgatggccttgatttcattttccgcatcggtagctttgcctaattggtttcataatctgcgctcttgcttacaaagcacaaatcaaccctgtttataagaaatcatgactaccctctctatcgtaccaattacacaggaaaaatatatgtatacaagacattcgaatgttattgcattgaagtgtgtaatcctgatcacattatttgttctacgtatgttattgcagtccaattcggtcactcatcgagtcaggttttggcgaaaatgagaacattgatgtaaagctcttttatggggttagaaatcttcagaggatggcatatcaggtaaatgtcaagtcttatgtgtgcaactcgtaagttcacttctgtatatatctcaagaccctactctgacaggagagattcactaattgggaatccagtggaatcaaaattatacctgttctctcaagacctgatgatcaatggaccggcgagcgaggctatgtccaggtactgttatcattttgcatctcggttatttttacctgtttgttcgttgttgtattcttatagctggttctgcatttagcagaatgctttttcaaggatgaagaaggttgtaaatccttcatccatgggggcaattttgtgtggacataaacagatgtctgaggtatgattacatttccttctgttttctttgatatgctgaagttgttgacttgatacaaccctcagaccgtgtcatacattaaatgtgttatgatttttttttgtccaagtgtttcaatgctttatgcaattttgattctgaattattctcttctattgaccatctatacataaaagcatagccttaaaggcttcaaccactaatactctccaacaatatgccttttcctgatatactggaacatggtttacatttcctcatatgaaactgtcatataaaatacagacaccagtgtggaattgctttgtagctaatgctcaatctgaggagatgaatgaattatctaccttactagtttgcgccagagagcaacaagttactgtaccgctaagatttgcatttaactgcagaataactatggccaatttatcttcatggcctgatagtttctgtggtaatccgtaatcgccaggggtgggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggcttctttttccaattttcctgcacgatgcaacatgctgcgctgtaatctggattttgccagcctgatgtatcaatatcaacacttggtgggcattttcgcatttgaaccgaaaggccctagttcatacagttttgtacctcctgaaacaatacccccttggaaggtgttgatatactccaaattacaaaagctagctcaataaaaggggtagagatgagtggcctcatgtatttgccttataaaagaggtagagatgagtggcctcatgtatttgccttcagttataatttgtcttcagttataatttgtgtattatttccccgcaaaaaaaataataatttgtgtattagaaggctataacaggatcagttttgaattgatttgagatgcgtttgtttgtatgtatatacaactgttcttcccactatcaacaaaataaagagtaatgttcttttcgatcatacataaatttatatgcatgcaacaaaagcggacgtaaagcatgcatgaaaattttcatgcattgacatttactaatgtactagccgataacccagtacctgtagcagtcattcgagttgatttctacaattcagcatcacaacggtaaaacatagcacaactgtgccagtactaagcagaaagcatctttagttctcattttttgagcagtcaatagaacaattcgaaccaccgactgaagttcaaattagccaacacagatgaaacgaagaaacgacgagacataaaagtcacaatcaccgaaccgactttgtatcagtacaacgtcagaatccacaacgttggaataaagagtgaccaacataaaagataagacaactaaaattcttttcacgcgccaaaaaccaattcaactagtgccgctggagtttaatcaacgttgccaccttcaagggctttctggccatcttgccgcttcttgtcattaggttcagaagagctacggtgatcatgatggtgatggtggtggcggtggtggtgacgatggtgtccggtcttgtgaggccttttaccatttctcaccttttcatattcaccggcagctgcatcatcggatgactcctccagggagcgactcctacggtgcttatggttgttggaatctgatgttgcatcctcatcgcttgatctatgatgtttcttatgtcttgacctgcccctctcctcagactcagaccctgagtcatcaccagatgatcggtggtggtggtgcctgtgactcctggaactggaatggtccttcttggaagatctcctctcttcatcatcgctgctatagtctgaagcatcagaatcagaccttgatgaatgtcggcgatgctttctcctgtgtgagcgcttcttccttcgattttcttcttcagacccactatcatattcatcactatcagtatcatcgcttgagtctgagcttctcctctttgatctgcgcttgtgcctcttggcttcatcggaatcagagtgaccgtgtttcctgtgccttttgcggtccttcctcttcctgtgcttccgatcaccatcactgtcggaatcactttcagagtctgaggaagaatggcccctccttctgtgctttcttgacttaagcttcttttcctttgcttcagcatcagcttttgccttcgctgctgcttcgagcttttgctcccatttcagtggggcttctttcttctcaaggattctcttctttttctcttcaagcagctgtaggaacttcttggagtccatcccgacagatcagctacagacttaaaacctgtagggccgtgaaatgatgcaaggaggtgcatctcatagaagagacaaaatcactgttagtttttgaaatatctagaataatatagcatgataacagacagcaaaaatataagctgaacccaaaatagataaaataaacctaggcaaaactgacatccaaatacattggaaatcaggcatacatgaaatcgatccccccaaaatacaactatagaagaatagaatgtcttgtttaggcttcacgtaaaaagcaaagcaagcttatgcggttcaaatatttgagcaaacttccactaagcatctaaatcatgttgctagtagcagcagacttgcagcttctcagctttctgagttcatatagctatataaacaagagactttggtgtaatatttatccaaaatgatgagaaaagactacagacagtcaacacagatggtgttaatatgtatccaagaaaaaaaaaagaattggatatggcgccagtttaaagatggatgtaattttgaattccagagacatgtatagggtacaactccttacacgaacacggatggtagaaacagcttggtagcagagttgttgttaactaaagacgcgcataatgtgaattatatacactttcttaccttgtcgtccgtaagcttcaaatgtccagaaaagatccctcctttttccccttttactgagccgatagttcacctgaaacaacaagagaaaatgtgtgaattcgtagcggatatgacgtagctttcagcaagcaacttctcgagtcgccccctgatctcgatgggaatatatatgcacaaaaaagcatatcggggcatagccatagcccacaggtagtctgggcccaattcccatccctagcgggggggtgttcgcggcaacggtgaggcgacggaatttgaaaaaccgaagccccacgaagattccagcgacgagtcagatctgaattgcgagggaaccctagaacaaggacgaaccgcgcccaaaccctagacgcacagcacaaaaacctagccacccactcagaatctcccgcggctcgcgcgtctatacgtacagatccggagcctgagcaatccgcaccacgcgatctaagccctcaccacgaatctatctagtaagaaaaaaaattcaaaaaaaaagttggggaggagagaagtggatggatgcagcaagcggtgcagaggaggggggggggggagaggagaactcactggattggacgggagacgccgccgcgaggggaagagaagatctggagcagccgccgcgtcgaggaaggaggagaggggtaaggcggcgcgcggaggaggaagagagagagagagagaggcggagtggaccgagcctaccgactagataaagaaagagcagagcgcgtggcgtggggggggggatggcccacacggcagtgacagcgtgtggaaccttgctctttgcccaactcaagttgccgacgcctttcttttttttttcacttttcgttttctttcgaaaaaaaaaatttgaaactggggtggtagaatgttggtattcacaggaaccgttggatcgagaacgtgcgataaaaggagacaagcgaacgcatcctgcctcccaactccattccgagtttctgattaccagatggatttactgggcaaagccaatgggatgccaaaaatgacaacactcatcgaattttggcatgatgtagagggatggcatttcatgttgtacagttcagttcattgccatccatacttctatgcaaggtcaaacagattggcagtctcatacttctatgcaaggttaatgttttacttgagcaacattggagaacgttaatgctttacttgagcaacgtaggagaccgcggataggtaaggttgtatttccggtgcaaatcgagctccgaaatcccagtgcatcaaactaccaactgctagcagtgcgttcctgcttggggtacaccaccatgattcatgtttccgccaactcttcgtcaaagcttcatccgagtttggtgttaatcaagatcaacaagtcatattagtttgatgataatcaaaagaaatgcgatgtacttgtagcaacgaccaaacgaacaaagacacaaagacaagggcaatattccagtattactaacagcgccaaagtttggacaaacttaacgagtagcaatccagtgtgcaatggagtaactgcaacaacgaaataacatttgacataacttaggaaaggtgctattgccctgaagcaggtcctaactccaaaattttacgagcatttgatgcgcaaacagtcaaacattcaaccatgtttcacaggcttatctcagcaatggccctggacagcaaaaaatctcaccctagcagtccacatctgaaagcagacggcttcagttgcgcctgctgctccaggttgaggaagatgatgaacttgagtatcttgaaggtcgccatgtgcctggaggaccatcttggcgggctgggggagcagcatcgcgagcagggggtgcctcttggcggagcggacgcatatcaggacgtgggcgatcatcccgtgaaccccaacggtcttgctcaggtgccacagcaggtctctggccgccagcactactgccaccatcaccacctcgtttaaacttcgggacatacttaccagcagctggtgcagcagcggcagcagcagcagccggtgcagctaccggctgagctggctgtgcaaccggagcagcatcaggagtgcgtgcaggctcagcagctccagctcctcttcccatgagagcttccattctctgtttttccttcttctcttctagttccctctctctctgcagctgcttggctgcaattgcatccagcttagccttcctctcagtctcttccctctttctcctctcttcctctgcagagaaggtgaaatcattatcaacaatatgtataagctagaatttgatttcattgcatcaggcaaaaaaaaaaagatccgcaagataattatgcacaagcaaatcacactttgatgccaaataacattttaagttttaaagctatccattgtctaagggcttgttcactttgatgccattttcaatcttaccaaattttgttaaagttgcaagaaaagtggctacatttagtttgttgccaaattttggtaactatataagaaatcctgctaaaattttggcaagttgccgaaattttggctatgccaaaatttggtaaggttttttttggcatcaaagtgacaggccctaagtaacacaggtccatactgcagtaaagtcacagtaattcaacaagcaatgttcactaattctcaagaaattccaaaattagctggacgatatatggcagtgtaaattaatctaatctaataaggtaagataagaacaagtatttcaaagcacaaagtcatgaattcttgccttcacgttttctagcttcctcttcctcacggagcctttggaggcgctgctcttctaagttaagatagtacattaacttccgcactgtatccctttcacgcttccttgatgatatcaattgactagtcctttcatccctctctttcttaagacgactaaactcagcttcacgacgttggacaattctttcctggaaaatgttctgcaagcaaaaagggcaatttaaaatatgtgcgaaggagagaagacagctgtctattccctgacaggaacaaatcgcctggtgtattcaaatgtctagtgctcaaatcatgtgaacacacacatagccaaagaagacatgccaatattagattctcagcaagtatagcacatattatatgttaaattaatctgtatctaatcagacctttgcacagataatatactaagtatttcaactgttatgcttggaattgcaaaacatggtttcggaaaaacacaggattaattacagtgggacatttggtccttcaattaactaaaaagaagatgaaatagtgcaagaatatctggtctgaatacagatatgtatttgcttaccttatgctccaacattcgagaaagtctgttcttctcctgcaggtcacctgcatggtgttgcttgctgagctcaatctctctctacaagaagagattaatagtgatttttgtgagcttaagtaatcatatgctattgtaatgtgacaatcaaggaattgtgagaaacaaaccagctgctcttgctcatgaaggattttctctacttcaaggcgtttttgaaaagcttgctcaattagaggtgcctcttcctgcctttttgccctctccaagtaatccatttgcttaccagtcttctgtagttttttctccatctcttggcgctccttaaactgctcattcatagccaattccatcacagcctccttagtaacttcctgcaatgaaaacattcaaagtataaagggcctgtgtggagaaacaaatattaagctgtaattggcttgggatagtacaactttatagttccgacttcggagaagacaatcaattcttaatatgaaacaagagtaggacactacagaatataaagattcaaatatcatctgcgttctgcgttcttgtagtctataatggttagccacaaaacataaaaaacagcatattagcacaccctctactactccactagaatttctgagcagttaagacaaaaaagaatcaatattggactgaacaaacagacataactaataagcatattgatgaaacagaagtcttcacaacaaatataatgccttacacaaaaagaaatatataatgaaatatcgagcaaatataaattgagcaatacattaaacagaaaaaaaaacattatcaacaaataactagtcagcgtaataaataaaatataatgattggaaactaattattctcaccccctgaaggacaggtttttttcctcctctctttgctatctcctttatctgtttctgaagcagttcttctgcctctatcttttctttttcaaccaattgtcgacggatcctctcctgttccctcaattttacatcattgagaagccttatcctttcatcttctgcagatttcttgagaacactcaatctctttttttcttcttccttttcctggaaaagagagaatatgacataagcagaaattcacagagttggccactttgaacagtaccaaatagacaccttttccaatatttggcgctcaagatcttctttgcgtttttcaataattgatttcctcgcaagaagacgcttgtgctcattctccactactgcagcaagactcgttaagttttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4303 - DNA, 684 bp, Oryza sativa
  unsure (1)..(684): unsure at all n locations
nnnnnnnnnnnnnnnnnnnnnnnnnnnnnnnnnnnnnnntctggtttgcgtccaatcgggtgttgcgagtagcgacactttgaaacgggacgtgcatctcttcttcttcttctgtaggctgtagctagtaactcgtgatggcgatctaatcctttccccatttcgttcgcccagctgttgcttctgggatcaccatggcatgtcatgtatggtgctggttttcttctttgttttaaggagagaatttgcatagactgatcaagtctactgtgagggacccacgtttcacattttttataaacttgattaaatttaaaaatgtttggctaaggaaaaagtataaactacttataacatgaaacggggaaatattgtttatgctcttttgctgatttcttccttttggttgtcttgactgcagtggaacacgcatgaggaggtgaaggaggtccatttgaaacagaatgtccctgaaccatcttcttacctgcataagtcctcggtaaaaaagaccccctctaattcacaagtcagccataaatttgtctactttcctttaggttgtcctgaatgtagtagaacacgcaggaggaggtgaaggaagtccatgtgaaggagaatgtccctgcaccatcttcttacttgctcaagtcctcggtaaaaaaagatcccactaattctcaa

SEQ ID NO: 4304 - DNA, 262 bp, Oryza sativa
taagtctccaggacacgaagaacatatgccataacacggggatgtcctttataaggaggggtaagaaactccaatgcttgtgtaacagagcatggagcccaatgtggaagttgctgtaacaatgatgaattttcatctactgcctttggagtgatgaaaaagggtaatgcttcaggaattgtacggagttccaatatatgtgtctacagggacaagagagcattgtaagacataacagcatatggcaccctttttactgaaa

SEQ ID NO: 4305 - DNA, 414 bp, Oryza sativa
gggttctacaagtcagcaagacatgtacgtgatggtacaagaacaagattcactcagctggaaaggggtagtttttatgataattagctggcgattattgtgtactaaatttcccctggatgatcctatgttggagatcagaaaacaagaatatagatgatagcggtatgaaattcagcagtgggttttattcatgcttgttgtgcctgaatgatttgcatacttcaactgaaaggggctcagtcaacgaagcatgtatactctgtagtctctccagattttttttaaaaaatgtcgatttagaaaaaaaaaattgttttagacgagaacacggtatcctaaaaatgactctgaatatatgtagggctattaatgaatatatatgattatactgaagtaattttcaagattaat

SEQ ID NO: 4306 - DNA, 764 bp, Oryza sativa
cgatcattctccaagcctaaggctgagttcgctatgggttgttcccaatagcacggaaaacggaacgatccattagcacgtgattaattaaatattagctatttttttcaaaaaaggattaatttgatttttttaagcaacctttgtatagaaactttttgcaaaaaaaacaccgtttagcagtttaaaaagcgtgcgcgcgggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatg

SEQ ID NO: 4307 - DNA, 566 bp, Oryza sativa
aattcacaatcatctggacagtccactagcaaaatgtcttgtgcatgtctacataatagtgcctagtccacttaccagaaaatgctaattttatgaaagtttttatcgagagatttacatgtaagatcttcatatatcaacctaaatatttaaaaagacattgatactcaaaagttaaaagtttgagtgcatctatgcccaagccgacatgtatttgtgactggcggtagttctttttggccttgtgcaaggattaatttgtaaaagctagaatctgcagtttttgaagagagaaggatgagattatgagaaaaatgttcaattttcattttcatcattagaagtttaacttaactggattattggactcacataccagtggctttctttatgaaatgttacattagataaattgaattctttaagtatgaaactgattttctttttgctttattttcaggggttaaagctacatatctcctcgcagttgctttccttgagatattgcgctttagctgcaatggcggcatactttcagccacctctacattgaataaatcaaatag

SEQ ID NO: 4308 - DNA, 353 bp, Oryza sativa
ttacactttctgtggcttgtcttagctggtcctgcaatgcccgctccctacaaccatgaaaaactaaaaggtaaaaaaaatatgcttcagacaaaaaaaaaagcattggaaacatgatgatcatagagcagttatatttctagttaccattaattcacagtacctgtctttcagggcttcaagagttttctggctatcttctgccaaactcctctgcttcatttcaaccatctctctgactttttcctccatctaaaattattaaatggaagaaagaatattgcaaaaagaaaagaagaacttgagaacaatggaagtttggcgtttgaaataaattggaagaaatcagcagg

SEQ ID NO: 4309 - DNA, 593 bp, Oryza sativa
aaagtcaacggcgtcatttgttaaaaaacgaagggagtactctaaattagtgtctaaatacaaagacttagttaaatcctgatccaaaccccaccgaaatgagaaaaaaggaaaagttagtttttacatgtttttttgcttgtttttctcttcttttttttgggttagttcgagagagccagcagctcgagagaacagaattaatgattggtgtggcgaagacaagcaaatatactgtcgataatgtgactttggacaagttgtgtagtactgtgtttggtgaatcctgttcaggcaaagctcatcaggtctggtttgtagttttcggagtaaggagcattagagctgaaccactaattcctctaaaaagaattagaccactagaattgtagtggatgttctaagcattaaaatttttcatttgaaaatggtagtgacaactttgatttcattactcaagttgtttgactttatccttttggcatttgtacaaccatcattatcaggcgtgcattcattttacccacagaattgacaattagtgatacaacagtttacataataacggctcaaacgcacgaccacgcctcatc

SEQ ID NO: 4310 - DNA, 316 bp, Oryza sativa
ccacctccttcagcttctcctcgtagtcctccttctccgccgtccgtgcgccgacgtcgttgtcctccagccactccagagcctccgtcagggcggactccatcctctccctgtcgtcgtcgccgatcttgccggccatgccgccgtcccgcacggcgctccgcatgcggtacacgtagttctcgaggcggttgcgcgcgtcgacgcgctcccggacgcggcggtcctcctccgggaactcctcggcctcgcgcaccatccggtcgatctcctcctggctgagccggcccttgtcgttggtgatggtgatcgactt

SEQ ID NO: 4311 - DNA, 554 bp, Oryza sativa
  unsure (1)..(554): unsure at all n locations
nnnnnnnnnnnnnnnnnnnnnnnnnnnnnnnnnnnnnnnnnnnnnnnnnnnnnnnnnnnnnnnnnagcaaattggtgaaacgaagtctatatcctagccgcaggggagcacctgattcatatgtacattacttgaaaaagaaaaaatgcagggatagaacatctggtaatactggaaccaatccaaatgggattgaactgactacaactggggatataaaacaggggtaattaaagggtaaccgtaaaaatagtcaactgcactcaggaataaatgggtggtgatgaaaaactactggtaatgtgcttctgctatgcaaaggcgatatggatcgggttgggaggtgtgacatggacagaaagaaaaagagatcacataggtaccaactgggaacacgtgagtaactgagctgaacatagaggtgaggggggaccaatgcatggatctcatggttatgttccaaatactaagaagtaatgcaaactgcactagcgacaagattaggacatgctggagaaacaggtgggggacctaattatgaaatgaatggggac

SEQ ID NO: 4312 - DNA, 531 bp, Oryza sativa
tctccatgtccttcctagaaatttatacacaccttcaattccaccaatgctccatgtttttaaatctctatatacatcacatattctatcaactttctaaaataactagaacttcatctataatataaatacatacctcattaatcccataaacatttcatataaacaagataaaatcaacaccatattctaaaaccacctcatctaaattaataacatttcctcaacttttactcattttataaacactaacatttaaacctatatttacatcatccttcagtacataatgatctccaacttttatgacctttaaaaacatacaataaataaaaaaaatcaaactaaaaaacttttatcatgccaattaaataaaattataaatataccaaaacccaccttatcttcaaatacttttttttaatagcaatcaatcaaacttaaattagaatcttcaaaaacccatctgcctttaatatctctatattcaatatattcaacctattataatattaccttgtaaaaacacat

SEQ ID NO: 4313 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnntggattataagctttggaggacgtttgggaaagtactagtatttggaattttgcatgaacgtttgttgttttctttacaaaattacaaatttgtgcattaacatgatggatgttctcagaatactactcttgactgccgttgacatgtgggcccaactatattccaaatagcttctgtacttactagtactattcatgggttttactagcattgtaatgttactgtcaaattaaaggcaaagccatgcttttcactttccattagaaagatcatctaaaaacagaccaattggacccaaacatgaatactctacttaattagatcaatgagcaataaatgagttgaactaattactctctgtttgcaaattaatgatcgtttaactgattaattaataaatgagctaataaacctcgatgaatcaattttttttctgtttttggtgcaacagagaacggcaaggtagtgtgccgctcgaacgggttctactccgacacctgcgacgtcgacggcgacgtccggatcaacggcacggctctctccgtgacccttgtttcggcgagccggccgtcagagcgccgccgcgagtggaagatccagccgtacccgcgcaggaccgtgtccggcatcgcgaggtgaccgtgacgcggcaacaggaccgg

SEQ ID NO: 4314 - DNA, 1421 bp, Oryza sativa
ccgtggggtcttcaacatatgccaatatcggtattaattgccaaaagtacccgccccgattcacaaagtaagtttttgcccgaaacgcaccccaatacactccaaatatgtccaaaatccaagttttggcgctttttaacttttttcattcgggtcaaaaacatcgcacccgtggggctcaataatatgccaatattggcattaatggcaaaaggtccccgcgcgattcacgaagtgagtttttgccacgaacgcacccaatacactccaatatgtccaaaattcatgttttggtgctttttgaactttttcattccggtcaaaaacatcgcacccgtggaggctcaatatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacacgccaataagtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggctcaacatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgaatcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacacttcaatatgtccaaaattcatgttttgatgctttttgaacttattcaatccggtcaaaaacaatcgcacccgtggggtctcaatatatgccaatattggcattaattgacaaaagtcccgcgcgaatacggagtgagtttttggccgaacgcacccatacactccaat

SEQ ID NO: 4315 - DNA, 917 bp, Oryza sativa
  unsure (1)..(917): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacatccaaacatgaattttggacatattggagtgtattgggtgcgttcgtggcaaaaactcacttcgtgattcgcgcgggtacttttgtcaattaatgccaatattggcatatgttgagaccccacgggtgcgatatttttgaccggattgaaaaagttcaaaaagcaccaaaacatgaattttggacatattggagtgtattgggtgcgttcgtggcaaaaactcacttcgtgattcgcgcgggtacttttgtcaattaataccgatattggcatatgttgagaccccacgggtgcgatgtttttgaccggattgaataagttcaaaaagcatccaaacatgaattttggacatattagagtgtattgggtgcgttcgtggcaaaaactcacttcgtgattcgcgcgggtacttttgtccatcaatgccaacattggcatatattgagccccacgggtgcgatgtttttgaccggaatgaaaaagttctaaaagcaccaaaacatgaattttggacatattggagtgtattgggtgcgttcgtggcaaaaactcacttcgtgcttcgcgcgggtacttttgtcaattaatgccaatattggcatatattgagccccacgggtgcgatgtttttgaccggaatgaaaaagttcaaaaagcgccaaaacatgaatttnnnnnnnnnnnnnnnnnnnnnnnnnnnnnnnnnnnnnnnnnn

SEQ ID NO: 4316 - DNA, 739 bp, Oryza sativa
  unsure (1)..(739): unsure at all n locations
aagtgagtttttgccacaaacgcacccaatacactccaatatgtcaaaatttcatgtttggatgctttttgaacttattcaatcggtccaaaaatatcgcacccgtggggtctcaacatatgccaaatattggtattaattgacaaaagtacccgcgcaaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacaaagtgagtttttgccacgaacgcacccgatacactccaataagtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccagtacactccaatatgtccaaaattcatgttttggtgatttttgaactttttcattccggtcaaaaacatcgcacccgtggggctcaatatatgccaatattggcattaatggacaaaagtacccgcgcgaagcacgaagtgagtttttgccacgaacgcacccaatacactccaatatnnnnnnnnnnnnnnnnnnnnnnnnnnnnnnnnnnnnnn

SEQ ID NO: 4317 - DNA, 1255 bp, Oryza sativa
cactccgatatgccaaaattcatgtttgggccttttgaactttttcaatccggtcaaaaatatcgcacccgtggtgtctcaacatatgccaatattggtattaattgacaaaagtacccgcgcgaatcacgaagtgagtttttgccacgaacgcacccaatacactccaatatgtccaaaattcatgtttgggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtctaaaattcatgttttggcgctttttgaactttttcattccggtcaaaaacatcgcacccgtggggctcaatacatgccaatattggcattaattgacaaaagtacccgcgcgaatcacgaagtgagtttttgccacgaacgcacccaatacactccaatatgaccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacactccaataagtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccagtacactccaatatgtgcaaaattcatgttttgatgctttttggactttttcattccggtcaaaaacatcgcacccgtggaaggttaatatatgccatatttggatta

SEQ ID NO: 4318 - DNA, 1158 bp, Oryza sativa
  unsure (1)..(1158): unsure at all n locations
attaattgcaaatgtaccgcgcgaatcccgaagtgagttttttccacgaacgcacccaatagactccaacatgtccaaaattcatgttgggatgctttttgaacttatcaatccggtcaaaaatatcgcacccatggggtctcaatatatgccaaatttggtattattgacaaaagtacccgcgcgaatcacgaagtgagtttttgccacgaacgcatacaaatattggcattaattgacaaaagttcgtcgcgcaaatcacgaagtgagtttttgccacgaacgcacccaatacactccaatatgtccaaaattcatgtttggatgctttttgaacttattcaatccggtcaaaaacatcgcacccgtgggctctcaacatatgccaacattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatttgtattaatggacaaaaatacccgcgcgaatcacgaagtgagtttttgccacgaacgcacccaatacactccaatatgtccaaaattcatgtttggatgctttttgaacttattcaatccggtcaaaaatatcgcatccgtggggtctcaacatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacactccaataagtccaaaattcatgttttggcgctttttgaactttttcaatccggtcaaaaacatcgcacccgtggggctcaacatatgccaatattggcattaattgacaaaagtacccgcgcgaagcacgaagtgagtttttgccacgaacgcacccaatacannnnnnnnnnnnnnnnnnnnnnnnnnnnnnnnnnnnnn

SEQ ID NO: 4319 - DNA, 658 bp, Oryza sativa
  unsure (1)..(658): unsure at all n locations
nnnnnnnnnnnnnnnnnnnnnnnnnnnnnnnnnnnnnnccaaaattcatgttttggtgctttttgaactttttcattccggtcaaaaacatcgcacccgtggggctcaatatatgccaatattggcattaatggacaaaagtacccgcgcgaatcacgaagtgagtttttgccacgaacgcacccactacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttgatgctttttgaactttttcaatccggtcaaaaacatcgcacccgtggggctcaatatatgccaatattggcattaatggacaaaagtacccgcgcgaatcacgaagtgagtttttgccacgaacgcacccaatacacttcaatatgttcaaaattcatgttttggtgctttttgactttttattccggtcaaaaacatcgcacccgtggggctaatatatgccaatattgtattaattgacaaaagtacccgcgccgaatcacgaagtgagttt

SEQ ID NO: 4320 - DNA, 455 bp, Oryza sativa
  unsure (1)..(455): unsure at all n locations
tcacttggtgatacgcatgccgaacttttgtcaattaatgccattattggcatatattggtacatgtgggtgagatgtttttgaccggaatgaataagttcaaaaaccacaaaaccatttgttttagacatattggagtgtattgggtacgtccgtgtcaaaaaatcacttcgtgactcatgcggctgatgaatcttgagttccacatgaaactcaaggctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaggggatctctagagcacgaacaagataaaagcaatttgannnnnnnnnnnnnnnnnnnnnnnnnnnnnn

SEQ ID NO: 4321 - DNA, 324 bp, Oryza sativa
  unsure (1)..(324): unsure at all n locations
nnnnnnnnnnnnnnnnnnnnnnnnnnnnnnnnnnnnnnnnnnnatgatgcacacgtcaccacgtcgagtgattgtgacgagacccttcgcataaccctcccctaaccatccacaccacgctaaggtttcacccccacccctaaaaaggcagtgggcggtcccctcttcgccgcggtgaatccggcagctggacaaccggacaccccggccgacccaactccatcacgcccacccttgccaccggtgcctatgaaagggtcgagctatacttcagatcaagcagttacccactcccgcttgtggcaagcgctgtaagtcttctag

SEQ ID NO: 4322 - DNA, 698 bp, Oryza sativa
  unsure (1)..(698): unsure at all n locations
nnnnnnnnnnnnnnnnnnnnnnnnnnnnnnnnnctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaataagtccaaaatttatgttttggcgatttttgaactttttcattccggtcaaaaacatcgcacccgtggggctcaatatatgccaatattggcattaattgacaaaagtacccgcgcgaagcacgaagtgagtttttgccacgaacgcacccaatacactccaatatgtccaaaattcatgttttggtgcttttagaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttg

SEQ ID NO: 4323 - DNA, 1130 bp, Oryza sativa
tccagaaatcatgttttggtgctttttgaaatttttcattccggtcaaaaacatcgcacccgtgggggcacaatatttgccaatattgacattaattgacaaaagttcccgcgcgaatcacgaaatgagtttttgccacgaacgcacccaatagactccaatatgtccaaaaatcatgttttggtgctttttcaacattttcattgcggtcaaaaacatcgcacccgtgtgggcccatatatgctaaatattggcacttattgacaaaagttcgtcgcgcgaatcacgaagtgagtttttgccacgaacacacccaatacactccaatatgtccaaaattcatgtttggatgctttttgaacttattcaatccggtcaaaaatatcgcacccgtggggtctcaatatatgccaatattggtattaattgacaaaagtacccgcgcgaatcacgaagtgagtttttgccacgaacgcacccaatacactccaatatggccaaaattcatgttttggtgctttttgaactttttcattccggtcaaaaacatcgcacccgtgggggctcaatatatgccaatattggcattaattgacaaaagttcccgcgcgaatcacgaagtgagttttttccacgaacgcacccaatacactccaatatgtccagaaatcatgttttggtgctttttgaactttttcattccggtcaaaaacatcgcacccgtggaggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaatatatgccaatattggtattaattgacaaaagtacctgcgcgaatcacgaagtgagtttttgccacgaacgcacccaatacactccgacatgtccaaaattcatgtttggatgctttttgacttattcaatccggtcaaaaatatcgcacccagtgggggtccaacatatgccaatattggtattaaatgtgacaataggtacccgcgggacatcacgaagtgagtttttg

SEQ ID NO: 4324 - DNA, 1729 bp, Oryza sativa
  unsure (1)..(1729): unsure at all n locations
nnnnnnnnnnnnnnnnnnnnnnnnnnnnnnnnnncgcgaatcacgaagtgagtttttgccaggaactttcccaatacactccaatatgtccaaaattcatgtttggatgctttttgaacttattcaatccggtcaaaaatatcgcacccgtggggtctcaacatatgccaatattggtattaattgacataagtacccgcgcgaatcacgaagtgggtttttgccacgaacgcacccaatacactccaatatgtccaaaattcatgttttggcgctttttgaactttttcattccagtcaaaaacatcgtacccgtgtggctcaatatatgccaatattggaattaatggacaaaagtacccgcgcgaatcacgaagtgagtttttgccacgaacgcacccaatacactccgatatgtccaaaattcatgtttggatgctttttgaacttatacaatccggtcaaaaatatcgcacccgtggggtcccaacatatgccaatattggtattaattgacaaaagtacccgcgcgaatcacgaagtgaatttttgccacgaacacacccaatacacaccaatatgtccagaaatcatattttggtgctttttgaactttttcattccggtcaaaaacatcgcacccgtgttggcctatatatgctaactattggcacttattgacaaaagttcgtcgcgcgaatcacgaagtgagtttttgccacgaacgcacccaatacactccaatatgtccagaaatcttgttttggtgctttttgaactttttcattccggtcaaaaatatcgcacccgtggaggctcaatatatgccaatattggaattaatggacaaaagtacccgcgcgaatcacgaagtgagtttttgccacgaacgcacccaatacactccaatatgtctaaaattcatgtttggatgctttttgaacttattcaatccggtcaaaaatatcgcacccgtggggtctcaatatatgccaatattggtattaattgacaaaagtacctgcgcgaatcacgaagtgagttttttccacgaacacacccaatacactccaatatgtccaaaattcatgtttggatgctttttgaacttattcaatgcggtcaaaaacactgcacccgtggggtctcaacatatgccaatattggtattaattgacaaaagtacccgcgcgaatcacgaagtgagtttttgccacgaacgcacccaatacactccaatttgtccagaaattttgttttggtgctttttgaactttttcattccggtcaaaaacatcgcacccgtggggtcccaacatatgccaatattggtattaattgacaaaagtacccgcgcgaatcacgaagtgagtttttgccacgaacgcacccaatacactctaatatgtcaaaattatggtttggcgctttttgaacttttttattccggtcaaaaacatcgacccgtgggctcaatatatgccaatattggcattaatggacaaaagacccgcgcgaatcacgaagtgagttttgccacaacgcacccaatacactccaatatgtccaaaaatcatgttttgggctctagaactttttattcagcaaaaacatcgcacccgggggctaatatatgccaatatggctttatggacaaaagtccccggcgaatcacaaatgagtttttgcaaaacgcccccaataacttcgatatgtccaaaattatgtt

SEQ ID NO: 4325 - DNA, 2826 bp, Oryza sativa
  unsure (1)..(2826): unsure at all n locations
nnnnnnnnnnnnnnnnnnnnnnnnnnnnnnnnnnnnnnnnnntcgcacccgtggaggctcaatatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttggcgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggctcaacatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgaatcacgaagtgagtttttgccacgaacgcacccaatacactccaataagtccaaaattcatgttttggcgctttttgaactttttcattccggtcaaaaacatcgcacccgtggggctaaatatatgccaatattggcattaattgacaaaagtacccgcgtgaagcacgaagtgagtttttgccacgaacgcacccaatacactccaatatgtccaaaattcatgttttggtgctttttgaactttttcattccggtcaaaaacatcgcacccgtggggctcaatatatgccaatattggcattaattgacaaaagtacccgcgcgaatcacgaagtgagtttttgccacgaacgcacccagtacactccaatatgtccaaaattcatgttttggtgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatatacgccaatattggcattaatggacaaaagtacccgcgcgaatcacgaagtgagtttttaccacgaacgcacccaatagactccaacatgtccaaaattcatgtttggatgctttttgaacatattcaatccggtcaaaaatatcgcacccgtggggtctcaatatatgccaatattggtattaattgacaaaagtaaccgcgcaaatcacgaagtgagtttttgccacgaacgaacccaatacactccaatatgtccagaaatcttgttttggtgctttttgaactttttcattccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccatggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtctaaaattcatgttttggcgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgaccaaaattcatgtttggatgatttttgaacttattccatccggtcaaaaatatcgcacccgtggggtctcaacatatgccaatattggtattaattgacaaaagtacccgcgcgaatcacgaagtgagtttttgccaaaaacgcacccaatacactccaatatgtnnnnnnnnnnnnnnnnnnnnnnnnnnnnnnnnnnnnnnn

SEQ ID NO: 4326 - DNA, 1343 bp, Oryza sativa
cattccggtcaaaaacatcgcacccgtggaggctcaatatatgccaatattggcattaattgacaaaagtacccgtgcgattcacgaagtgagttattgccacgaacgcacccaatacactccaatatgtccaaaattcaagttttggcgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgagctttttcattccggtcaaaaacatcgcacccgtggaggctcaatatacgccaatattggcattaattgacaaaagttcgtcgcgcgaatacactccaatatgtccagaaatcttgttttggtgctttttgaacttattcaatccggtcaaaaatatcgcacccgtgggctctcaacatatgccaatattggcattaattgacaaaagtacccgcgcgaatcacgaagtgagtttttaccacgaacgcacccaatacactccaatatgtccaaaattcatgtttggatgctttttgaacttattcaatccggtcaaaaacatcgcacccgtgggctctcaacatatgccaatattggtattaattgacaaaagtacccgcgcgaatcacgatgtgagtttttgccacgaacgcacccaatacactccaatatgtccaaaattcatgtttcggcgctttttgaactttttcattccggtcaaaaacatcgcacccgtggggtctcaacatatgccaatattggcattaattgacaaaagtacccgcgcgaatcacgaagtgagtttttgccacgaacgcacccaatacactccaatatgtccaaaattcatgtttgggtgctttttgaactttttcattccggtcaaaaacatcgcacccgtgggggctcaatatatgccaatattggtattaattgacaaaagtacccgcgcgaatcacgaagtgagtttttgccacgaacgcacccaatacactccaatatgtccaaaattcatgtttggatgctttttgaactttttcattccggtcaaaaatatcgcacccgtggagtctcaacatatgccaatagggatcctctagagtcaaaagtacccgcgcgattcacgaagtgagtttttgccacgaacggcacccaatccactccaatatgtcgaaaattcatgtttggatgctttttgaatttattcaatccggtcaaaaacatcgcaggggatcttctagagtcgacctgcaggcatgc

SEQ ID NO: 4327 - DNA, 589 bp, Oryza sativa
  unsure (1)..(589): unsure at all n locations
gggtacttttgtcaattaataccaatattggcatatgttgagccccacgggtgcgatatttttgaccggattgaataagttcaaaagcaccaaacatgaattttgaacatattggagtgtagtgggtgcgttcgtgacaaaaactcacttcgtgattcgcgcgggtacttttgtcaattaataccaatattggcatatattgagaccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaatgccaatattggcatatattgagccccacgggtgcgatgtttttgaccggaatgaaaaagttcaaaaagcgccaaaacatgaattttggacatattggagtgtattgggtgcgttcgtggcaaaaactcacttcgtgattcgcgcgggtacttttgtcaattaaaaccgatattggcatatgttgagaccccacgggtgcgnnnnnnnnnnnnnnnnnnnnnnnnnnnnnnnnnnnnnnnnnn

SEQ ID NO: 4328 - DNA, 733 bp, Oryza sativa
ctcaacatatgcaatattggtataattgacaaaagtacccgcgcgaatcacgaagtaggttttgccacgaacgcacccaatacactccaatatgtccaaaatcttgttttggtgctttttgaactttttcattccggtcaaaaacatcgcacccgtggggtctcaacatatgccaatattggtattaattgacaaaagtacccgcgcgaatcacaaagtgagtttttgccacgaacgcacccaatacactccgatatgtccaaaattcatgtttggatgctttttgaacttattcaatccggtcaaaaatattgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggccaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacatattcaatccggtcaaaaatatcgcacccgtggggtctcaatatatgccaatattggtattaattgacaaaagtacccgcgcgaatcacgaagtgagtttttgccacgaacgca

SEQ ID NO: 4329 - DNA, 1384 bp, Oryza sativa
attgacaaaaatttcccgcgcgaatacgaagtgagtttttgccacgaacgcacccaatacactccaatatgtccaaaaatcttattttggtgctatttgaactttttcattccggttaaaaacattgcaccctcgtatgccaatattggcattaattgacaaaagttcgtcgcgcgaatcacgaagtgagttttttgccaacactaattgacaaaagttcgccgcacgaatcacgaagtgagtttttgccacgaacgcacccaatacactccaatatgtctaaaaatcacgtttggatgctttttgaagtttttcaatccggtcaaaaacatcgcacccgtggggactcaaaatatgccaatattgacattaattgacaaaagttcgccgcgcgaatcgcgaagtgagtttttgccacgaacgcacccaatacactccaacatgtccaaaaatcatgttttggtgctttttgaactttttcattccggtcaaaaaacatcgcacccgtgggggctcaggatatgctaaaattggcattaattgacaaaagttcgtcgtgcgaatcacgaagtgagtttttgccacgaacacacccaatacactccaatatgtccaaaattcatgtttggatgctttttgaacttattcaacttattcaatccggtcaaaaacatcgcacccgtggggctcaatatatgccaatattggcattaattgacaaaagtacccgcgcgaatcacgaagtgagtttttgccacgaacgcacccaattaactccaatatgtccaaaattcatgtttggatgctttttgaacttattcaatccggtcaaaaatatcgcacccgtggggtctcaacatatgccaatattggaattaatggacaaaagtacccgcgcgaatcacgaagtgagtttttgccacgaacgcacccaatacactccaatatgtccagaaatcttgttttggtgctttttgaactttttgaatccagtcaaaaacatcgcacccgtggaggctcaatatatgccaatattggcattaattgacaaaagttcaccgcgcgaatcacgaagtgagtttttgccacgaacgcacccaatagactccaatatgtccacaaatcatgttttggtgctttttcaacattttcattccggtcaaaaacatcgcacccgtgtgggcctatatatgctaaatattggcacttattgacaaaagttcggcgcgtgaatcacgaattgagttttttccacgaacgcacccaatacactccaatgtgtccaaaatttatgtttggatgctttttgatctcattcagtccggtcaaaaacatcgctcccgtggggtctcaacatatgccaatattggtattaattgacaaa

SEQ ID NO: 4330 - DNA, 3080 bp, Oryza sativa
ttcgggattcgcggggcgaacttttgtcaattaatgtcaatattggcatattttgagtccccacgggtgcgatgtttttgacgggattgaaaaacttcaaaaagcatccaaacgtgatttttagacatattggagtgtattgggtgcgttcgtggcaaaaactcacttcgtgattcgtgcggcgaacttttgtcaattagtgttggcaaaaaactcacttcgtgattcgcgcgacgaacttttgtcaattaatgccaatattggcatacgagggtgcaatgtttttaaccggaatgaaaaagttcaaatagcaccaaaataagatttttggacatattggagtgtattgggtgcgttcgtggcaaaaactcacttcgttattcgcgcggcaaatttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcacggcgaacatttgtcaattaatgccaatattggcatatattgagcctccacgggtgcgatgtttttgaccggaatgaaaaagttcaaaaagcaccaaaacatgatttttcaacatattggactgtattgggtgcgttcgttgcaaaaactcacttggtgatacgcatggcgaacttttgtcaattaatgccattattggcatatattggtacacgtgggtgcgatgtttttgaccggaatgaataagttcaaaaaccacaaaaccatttgttttagacatattggagtgtattgggtacgtccgtgtcaaaaaatcacttcgtgactcatgcggctgatgaatcctgagttccacatgaaactcaaggctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcacgaacaagataaaagcaatttgaattgcaaataggaataaatgcacacaataagttggggtttcggatacaagcagatggacggtctagccgacacgcgcgctgcaaggaagtagcaatggctaaactttcatctaaacaaaagccaactaaccctgaaggggttactagctatttaagggatgtaggaggtcagaagggcgtcctccctctgtttggagcgcaggccccccttgggccccacttgggccggggtcccagacgaaattacaggcccataggcccattacagacaatgcagccccttgtttcttcaattgccaatgactcagatagaatttgacaatgaggttggatccgttggaatgaggattccgagagctttctatcaagtactcgtgggcctaaaatgaaggccatatggagatttggcgaccgtttgaattcagcactatctcaagtggtcgaattggattctagaacgcggcggacttcatctccatctctgcatgcaccatggccgtcgtctttatcttccatatgcagccccaaataagtggattggtgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgtttttcctccctcccgggctcccctctcactcaggccgacaggtgggacccgtgggccccacctgtcatcttcaacctccagcccgggccggcaactgccatggccgccgaaaaccgcccacgtcgccaccattcccgggctcctcgagccctctctcgcgtgggaccgggagccatccctcttcttcacctcctcccccgtttttcccaatttttggcgccgaatcgagccccactttcgccacgatgtcacccacgtcgccggccgttgccgcttcaaatccgccacgtccggccacgatttctcctccccgagcctataaaaatggtccccgtgccatcctcccccttttccccaaaaattccgaacccgctgcactcccaaccgctctgcccttgttgctcttgcgctctgtcgctttccggcgagctccggatggacgccgacggacatgaagccgccgccgcgccgcaccgcttgcaccggcggctccggtgctctttgccacaccccggccaccgctccgttgccacaaaactccgccgaaacaccacatccaccgagcacccgagccacagctgcctctcgtcacctccagacgcgcgccaccaccgctcccgtcgctgccgcgctgcgctaccaccgccatcggcatcgccggtcctcgccgcaccccggcccctactccgtttgccctccctgcccctggaacgccgccgccgcgttcaccatctctctccgccgccaccgtcgagtccagccgcgtcgcgccgcctctccggtcgacgccgacttgagccgccacctccttcggcttcgtcatctcgagggccccgccggccctcggccgcgtctccgccatggtcgggtgtcgccggaacgccgttcccgccgcctctcgtgccagtcgccgccatcctttccgccgccagccgcctccctgtggtcgtctcgccgtcgccgtcctcggtgagaatccccaccggcccttctcctttttttttccctcctccaccactccccgtgcccgctgccgcgacgcgccgctgtcgcc

SEQ ID NO: 4331 - DNA, 2338 bp, Oryza sativa
  unsure (1)..(2338): unsure at all n locations
tgcgcaataaatcgagtttaattatagaaattcatttaaatggctcaaaccttctaaaattcatatctaattcattcggactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacacggggtcagggtttacctatctgctcgcttgtgccatgtttacttgatatctgttctttgtcaaccttgggtaataaattgactagctcgtgttacttatgtgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcacccatagcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgcctttttaggggtgggggtgaaaccttagcgtggtgtggatggttaggggagggttatgcgaagggtctcgtcacaatcactcgacgtggtgacgtgtgcatcatgggcacatgatgacgcggtgacatgtcggtgggttgtgtcttgtgggtacagttgtgcacctctggccagagtaaaactattcgaatagccgtgcccgcggttatgggcgctcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgccttttttcgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaattggtcctgaacatataaacgcatacattatgaggtagtgtcatattcttgattagattaaattggcacttgttatgaaacgagaccacctgtgggtatttgacatgatcaatggttgtatccgtcgtaggcgtggtcacatcatcggcagactttgtcaattaataccaatacttgcacacatgggtgcgatgttttcaaccggaacgaaaaagttcaaaaagcagcaaaacatgagttttggacatcatggatcggattgggtgcgtccgtgttgaaaaattactccgttactcgcgcggccaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtgacaaactttgtcaattcatgccaatattggcaannnnnnnnnnnnnnnnnnnnnnnnnnnnnnnnnnnnnnnnnnnnnnnnnnnnnnnn

SEQ ID NO: 4332 - DNA, 11288 bp, Oryza sativa
  unsure (1)..(11288): unsure at all n locations
nnnnnnnnnnnnnnnnnnnnnnnnnnnnnnnnnnnttgaaaaattactccgttactcgcgcggtcaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtggcaaactttgtcaattcatgccaatattggcacacgtgcgtgcaatgtttttaatcggaacgaaaaagtttagaaagcaccaaaacatgtgttttggacataatagagtggattgggtgcgtctatactgaaaaatcactccgtaactcgcgcagcgaaagtttgtcaattaatgccaatattggcctacattggcacacgtgggtgcgatgtttttagccggaaaaaaaaagttcaaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaactcttgtcaattaatgccgatattggtacacgtgggtgagatgtttttaaccagaaaaaaaaagttcaaaaaaaagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcgttcttccgatctccaccgcctcgcctgatcaacagtagggttcctcatccatccgatgccagcgattgtattttctccgacggtaaatgggtgagggacgccgcggccgtgactgcttaccgggaggactgcccgtttcttgaccctggtttccagtgcatcagcaacggccggagcaactcgtctttccgctactggcgatggcagcctcatggctgccagctcccgaagtaggtagccatcgccaatgacatctttgataaattagtaatttcttttctgtggtttttcatgatgtggacatttttcagttacttgcattgccactcattcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccgcgccccaatgcttgtcatgatcgaccgcttcccggcaagcagcggtgccgtcaggggagcggtccggctggacatgctgcctcggcacgccaaccgttgggctggcgccgacgtgctcgtgttcaatacagggcattggtggaatgagcacaagactatcaaatcgtaatttgagccgtagttaattaattaattattttgtttctatgcatactatgttgtttcatttattataactgatccctaagtctcaaactactgccacatacatgttttcaggggaaactatttcatggttggtgatcggctgaacatgagcatggacatgaaggaagcattccgatggtccctggagacagtgaaagattgggagataagtagtacacgggttccaaatagttattttttcttcaggagttattctccttctcattataggtaagaattgttagtgaacgatacacacagttcacctctttggtgaattttaacaagacaaaacataatccttcatacaatttgaccattcgttttattcattttttttgcaaaataaaaaagaatataagccatgcttaaaaaaatatttgacgataaaccaagtcacgggtaaaaacgaaaaaataaaagacaatacatatttttttaataaaatgaatacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttttgagtaattttatagtacattctacttgaagtatatatttgctgcagtatatggaagggtaggttcgatatttgttaaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctctatcccgattccttcatgacaaaaaaaaaagttatgtccagatttcacccgatatgtctggaccaggaaacaactaaataacacgtgattttcagatggagctaatataaattaaataactattattttaggaaaaaaagttacctccggatttcatccggtatgtccggacatggacaacaatgaaaaaacacgtggttttcgggcgtgctagcataaattaaataactattattttaggggaaaaagttactaccggatttcatctgatctgtccagaccaggaagacaactaaataacacgttgttttgtggtcatgctaacataaattaaataactattattttagaacaaaaatatttacatccggatttcatccggcctatccggaccgggatgacaactaaataacgcatggttttccggtcatgctaacataagttaaataaataatattttaggcaaaaaaaagttatgtccggatttcatccggtatgtccggactgggacgaccaaaaaaaaaacatgtgctttttcggtcatgctagcataaattaaataactattattttaggaaaaaagttatgtccagatttaatgtgatctgtccggaccaagataacaaacataaattagataaatattagtttaggaaaaaaaattccgtccggatttcatctggtctatccatactgggatgataactaaataacacgtggttttccggtcatgctaacataaattaaatatctattatttaggaaaaaaagttacattcatttggtctgtcgggaccaagacgacaactaaataacacgtggtttccggtcgtactaacataaattaaataactattattttataaaaataagttaggtccggatttcttccggtatcccagaccgggatgacaactaaataacatgtggttttatggtcatgctaacataaattaagtaacacctattttagaaaaaaaaaggttacatccatattttatccggtatgtccggatcaggataacatgtggtttttcagtcgtgctaacataaatttaataacaattattttagaaaaaaaagttacttccggatttcatccaatctgtctggagtaggataaccgaaaaaacacatggttttctgatcatgctaatataaattaaataactattattttagaaaaaaaaagttatatccggatttcatccggtcggtccaaaccggtatgcaacgaaataacacgtggtttttttagtcatgctaataatataaagaggcaattgtgcttcagtccttgatttacaattcaattgtgattttactcttactttttagggtttgtgattttgcccctgtttttctgaaatgagtctgcccctggttttgacataagtttggtggcctgaaatttccaaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcacgcggcagagtcgggcgcgggcagggaggtacggcagcggctagggctgtcaacgagccgagcttgagcgagcttgcctgtctaggctcgagctcgagccgagcctataaaatgttcgaactttcaaacaggctcggttcgagctcgatcaagctcgagctcaactactgagctcggtttttaattagaacattgtatatttcaaaggataatttttaaaaaatatttaatttatggtttatcatattagtataagaagaaaaaaaataaaataaacatataatgccaatacaaggcatacaaataacatatttgatctaccaatttattaaatagcaacgaaaaattatatattactaggcccgttagaagctcgagctcggcgagctttgggacaagctcgggctcggctcgtttggagctcgagccgagctcgaatcaagcctaggacgagtcgagctcaagtagctcacgagtctcgagctttctttttttacagccctagcggcggcggcgtcgtggctggcgcgcgcagggaggtgcggcgctcccgcggctgcatgcgcagggacggcctttggaggcgccgcgacgaggatgacggcgaggaagaggacattgccgtcgacgagagggactcgctcgggctgccgttgccggtggtgagcaactgctcatcgtcggagtgtgagtacatggccgagtcagaggctgagctggcgaagaccgaggaggagaagtgcgcgtcggcgtcgtcagcgtcggagtacgaaaagacgtcgcagtcgagcacgaggagcgtcgcattccatggtgctgccgacgccggaggagacgggcataagctgagtgttagtgctgcttctattattgtgcgtttagttagttgggatttgggatgccataaatacaatggtgatcgatcacgatgcccatgcacgctgtgggccaaaatcatccatgcaactgttcgtttatcaagactaaatctctataacgagcaaaaagtgcaaatatctgtcactttttaccttcttttttctaatcattagacattagtgttcgttttgctctagaaattatcattgaatgccaaaacatgtcaggggtatatttgtccattcaccacaaatttaacaccgctaccattaattaacaaagtaggggcaggcggctacttcatttcaaaaaagcaggggcaaaatcacaaaccctaaaaagtagggataaaatcacaattgaatagtaaagcaaggatagaaacacatttggccctaatataaattagctattattttagaaaaaaagttacgtccaaattttacgtggtctattcgtactaggatgacaactaaataacacgtgatttttcgatcgtgctaacataaatttaataactattatttttgaaaaaaaaaagttaattctggatttcatccggtctatatggaccgggacgataactaaataacacttggttttaaggtcgtaacaaattccctttttaatcgatatatgtacgtgcccgatccatttttttgttctctccatttgctgcttgctgcctgccggttgctctttgcttgctgctgccctgcctcctactgcctgtcattccctgtctgcgctccttgcccctgactgcttccgtcgcccggatgccctgcaatgctgctgccgcttcctgcactgctgctgccgcgcctgtagcagttgcgcccgggtgccctgaagccacgacccttgactgctccgcatccccttgccgctgcgcgcctctggccgagccaccagtggccggcgcccttctgcggctccgccccttcccacgcacagagacgtcaatcgtggagttggggaatttccaaagacctaggttttgggtgcgcgggaagggcagatggaggaaaggaggtcggaaaatcgaatcaaatcacattcgcggtggctatcagcggcggcggtagcgcatgggacgaaggaaagcgaacggaattctctcgggccggatctgaccgaataagagaacgcgaaaatacaaaaaatactccatgcaaaaagatagaaagacaaatttacccttttcaatttatactgtaaactaatctaaaggaaggtcggatgaatcgacaccgttacatcatttactaatctaaaaggaagatcggatgaatctacaccgttagatcgtttaaactacaagtatatactttgcatgtaccgtaaaaatcctctacatttttaaggtcaaaaagggtgccatacatgtcaactaccccaccatcaattctctacttttttggaagaaaatatgacagtataaatgtgaataccaaatacatacataaattaaaggggtgatatatacattaatgaaggtaataatgctttaatgctaattttctttacttaaaatcacattgcaacgcacgagctagttaattaatatatgcatatatttctctctctccatattatactgtacaatgtttttccattctctatattaattaaaaatgcatacaatttcaagtttatatatagttccgtacagagaactttacagtttaaactagtattaaaatgaaggtcaaaaaatgacagcaatggcacgtggaacacgggtggctcgtgtgctgaccatcgagatccagtgaccagcagtgaccaattcgacgaggagtactcttggatcaacgccatgatctcgaacgccatcgacggcatcagaagccacggtcgaaggaaagcccatttcttgaacataacgtacatgaccgaactgaggagggatggccacccgtcgcggaaccgggagcctgggacgccgcaggacgcgcccgaggactgcagccactggtgtctgccgggcgtgcccgacacatggaatgaggtcctgtatgcacacctcatgtcaatgggatatgatatcaggatacactagtacaaaaccctcgcagggaccggctgtatatgtgctatgtgcctttttccacctccacatgataaaaaaaatataaaactagcatatttaacaactatagttgtcggctcttaaaaaaactggtagtaatattgggtataattttatgctttctaaatgtttcttgaaactaaatgatttgaaatgatgatgagattggtatatgtgatatgattgccttacttccccttatgttgtaagggaatgatgtctatctatttatgttgatatcatgccatgattaatatgctttatatattgcttaaatgatttgcttaaattacgttgcaaatagtttgtgaactaaaatttgctttatgctgaaaattgagactacaaatagccttccattgacttagagctttcatgtatgtaagtttgatggtgctcttgccagtacattaatttgattaatgtactgagtcttgccatgtgttgttttatgttttgcaggattagacttagtttaatttgagtgatgcggttttcgactgcttcttataggatttgaacttaatgggggtaaacccctagtcggtgtgcttaaggattgggtagtcaagcttccgttgttctcttatatatttatttggccggtcggcctatgtaactattaagttgatgtaagtctcttagtccctttcgtcttaaatgtgtttgctatatatgtccatgcttaagatgaaagtgtgaatctagtgcacatcttgggaattagattcacatgagttaagaatatttgagatgttgtagatctttagccattttgtcaagtctcctgattgtgtaacacatctggtcgccgctttcgagtggtttgacgggcatatctcacgccgaagttgactggcaggctaaaggcccagcaatgtcttcaatattcttctctcgatgtgtcggatatttcattatgtttgtttgatgacttgagttattcacttcatctcttaaatataatgggaggtccggagagcctacgaaaactgccgccgcagctaagccgctgccgagccaagtcgagccgagccgccgctttaacccgttgctcgatagctgagttgcctagccatagatgcaaacctaggttcctactggcctaccgtttgtcgtaccggggctttaccgtgaatcgtgtctagcccaccagtttagcctcagccgttgttgagtcgttcgctcgtttattcgaacgaggtgtccccgtgtttcgttcgtccgtccgtgttgagtcgtcctttagtttagagccgttcaaagccacaggttccgtttgcctatttcggttgaccatttgggtgatcccgtgtcacgtagaattgactcgttgagtcggtatctcatgaggcttgcttgccagtaaagtgttaagaatccattaaaattggtttcttttgctgtttcagtagctctttagcttgtatttattgtgtgccttgtttgtcgcttagactctggcagttccgacgctccaatttattttgaagtggttgaagaggttctatcagctcaagggcaaggcaagtcatacagatatcattgatcatattgagcctatctgcaaaacccctgcttttctcttaaaattgcattattttataatgtcatgtgggaaggaatttacccgtactcagccttatgcttaccctgattcattgatagcctgggataataatttgattgtaggttgggctccgtgtgctgtggttgttgcttgaacaaaacactcggctgaccgtgagccgatgttgacgcacccagcttcccaaaagccgttgtaactataggctgttgctctggggttattccagatgcaggttgatgcttaccaccattattagtgctgatggtcctatattgtggaaaaacaccctcaggaaggaaaatcgatcccttagcttgatactcacttgatcatattagacaagcactcctgattggttgatcaaagcatgataaacagcatagtcaatccgatcttgcatattattgagccctttaggatctccttatggtttctcatttttaggcttggcatctttaggagaactcgtttctgggtcgtcatcagatagcatcgctatcttatacctctgaattactgtccctgatctagttaacacaaatgagtgcaaaaacttattttgcatttggttcatcatctgctcgaggtccaccttttgttctgctgtcaacttgtctagcgttatcgggacgatgttgtccgggtcaacattagttgacttgatatccaccatgatgaagatatgtcgaagtcggtcccactgagcatgccaaaagcatgttgatgcgaaaaacacacactggtctgagagatttgctttactctagtgcaggtcctaaattttgcttttgggttcaaggcgtgccagttggtttgatcctgcaaccaacaagaaacaaaggagccaaagttagatccataaacgatagccgatcggctggattgctgatgacgtatcgttcatatcaggctgatgcgatatggatcagattggcagtgaagtatatggcaaagaaaagattaaacctacgctattgcccgtatatatcagtaatatatgagataatccaagaaatgccattgacaagcgtctaagtcccaaaagtccatcgacaagtatgagttccaagaaatgccatcgtacaaacgattttgtcccaaaaatgccatcacagttagggttccg

SEQ ID NO: 4333 - DNA, 8965 bp, Oryza sativa
atttcttggaactcacacttatcattggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagcaagcccgagggagagggagagcatcagctacagcgcggcgaggcgcgggcctggtgcggcacctcggctgggacggcactgcgctgtcacgcacagggctaccacggtatgcacatgcacgctgcctccaaacctagctcaagcatcagtagcagcgggccaacgacagcagtagcacggtgggttagtgggtgtcgctttcagcacctccatgttctcacttgacatggccacacccatctgctccctgccacgccagcaccacgcgaccgacctcgcttgggcgcccatcctcatcgccgctccgcccgcgggacttcaccctcgtccaccacgtcggcgtcggggacatcgcttgaaggagaatgcgtcggctcgtcgtcctcgtgcgagtacgccatgaaggtggtggactgccgtgcgctctccaagaagggcaagctgggccacgccgtcgcggagaagcgcgttcttgtaagttcaagtgccttaatttggtttggtgattaatgacaaatctaataatatgagactaacgtttttatgagcttttctttgactagtctcgtttcgatatgaaaataaaaatgatgagagttgtcaactaggttatttcccgatgatgagatgtggtagatatgcattctttggtgatggaccttaatcatgataaggataaaatgcatggagataaaacgttatgtaccacttcttatctcctactttttgataggttcatatatatgatttccatgttattgttatataagtgtgagactaacgtttactcgagtcgtatcttatttagtctcatttacattaagaacatggagatcatgaatgtatgtgttttatgttggtctacatcattactacatatgctttctctatgtgtacaggataaacccccattggtcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgtcaattgtggtgttaatgaataatgaatactcaacaaacatattcatatctttcatatgcaactggttggtcatcaagtgcaagatgacaaccgatttgttgggactaatgttctcctttgagctgtgcaaaggaataggtcccaccgtgatgaggctaatagatgacaccatggtttgatgatcaccaagccaaggacatcgccatgttgacaagaatgaagtcaagattgtgatgagatgaaagtcttgacaaaggatggtcaagacctaggcataaacaagattcaactgaatagtcacatgtgttgatcttggttcaagcattgaccccaagttggatggcacaaggcaaaggtataatcgagcgaagatgttttcttagtctttttcccggtcttcgtgtttggtgtagaccggatttgctagataggcgccatactatcaagaggggtctatgaagcgagcacgtggatgatcttgtgccatattagttcatatgaatgtaggagcatttggtgggcttgtctagccatgtgtgatgagttttctcatgtcctaaacaaagagagaagtgagcaagtccaataggagcgagtgacatcttgtgggtatgtctggtggatatcctttggagtgtgagccctttatccttgacttaagttgtgtttcttgatgtatttttcatgggttggatagctccttgaataatctttccatagagtccaagaacatcaaattccgagatccaagtcaagagatatcgtcattttactgtcggtgggtcgtgctgaaaatcggtcggcggtcagaccgaccttgtgtagccggtcagacctcccgaaggccccgaaagcccgccaacggctagtttttttgtgcgttggactgagggccggtctgaccgggtttagaagggcggttagaccggcaagcacgtcctaaaaggtgttttagcctctaacggctagttttggtggttgggggtatatatacccactccccagcagcaagggtgaagttttggcactccattgcattatcttgaacccttgcaagagctctcacacccttgtgcacttagtttatctagtgaggtgttagagagtaagttaagccaatccaagtgcattgcttcattgttatagctagtgtggcacttggtcatcctcggcaagcatcctagacttgttactcttggaggttgccgcctcctagacggcttgtggaggtgttgcccggtgacctctcaaaggagattgtggaggaggcccggtgccatttgtgagtggtttggagttcaccaccttcggagtgaaggaagaactaccctagtgatcgaggcttgggtagtcctctccgtgggccggctcccaccatgcccaccccttgacgaagggggcgtgcggtggcttcgttgttgagcggtggagttgggctcgcctcaacggggattaggaatctggcgagtttccgaacctcgatgaaaaattccttgtctcttgtctcatttatttgttgcatttacatttgtgcaatttacatccatagagacatatttgagcccatatcacctaggtttgcaaaacttaacttagttgcttagttaaccttgcaccttaccttgcttagcaacttaggttagttttgtttaagtgccattaagttttaaaaccgcctattcacccccctctagtcggcctccttgatcctacaagtggtatcagagcttggtttctctttttatggacttaaccgttccgagagaaaaggatggcttctagagatatagtccacccgggtggtgaccctcttatatttgatagcacaaattatgcacaatggagaattcacatgatttctcattttagggccatgagcccaaaaatatggtggattgtagatgtgggcttttctcatgctttggatgaacgtgctcccacaagtgggcaagagaaatgcctacatctcgatgctcaagctactaatgctatattttgtgctttgagtgatgacatttttagtgaagtatgcaatctcaagagtgcacatgctatgtgggtaaagcttaaagaaaaatatgaaatgcccacacttgttgagaatggttgcacataaggacggatgtcgggtgaagacttcacctcctcaagagatgatgaggagctcccaacaccattcacatcatctcattacttaatggcaaatggtaagaatgaggtaaataaagattctcttgatattactattgaaagtagtaatggtgatgatgatgatgatgatgatggtgatgagccttcatatgatgaagttttggacatgcttagggaggctagtaaatacattgccaaagagaagaagaaaaattaaattttagagaaaactcttctctctttgaaagactcaaatgtggagctaataaattcttataaggaactttgtgattcttataagaacataaaagaagcttatgagtctcttctcattggcaatgcatttagtaagccaaaggtggacataggtatcatatgcaatttaattgatgatgatatgccatgtgtagctagctcatgcattacatctaagactaatatgtccacctcttgtgatgacttgcaagacataccttatagctcaaacatagatgaaaactcttgttcttcctcctctatgtatgttgttgctaaccttgtagaggaaaacaagcaattacaagccaaagtcaaagatttaaaagaagacttggatagaaactacataaggaagaacacacttgacgaaatcctaagcaagcaaaagagctcaaatgacaagtgtggacttggcttccaccacaaggagaatgctaagaagacaaggcacatgcctagatatacaaggaagcatgcatacttaagaaaggatggaaagaaaaatgtgagtaagaaccatcctcacattacatgttgtggttgtcatgagaagggacactttgcctcgttgtgccccaaaatgaaggatgaaaagtacaactccaaattgagacaaactggcaagaagacaagtcatagaggtcaaagcctaacttgctacaattgccgcaaaaagggatatattggtaaaaattgtctcataggtaatacttctaagcctaatattatttttgatgattatgtgcttaggaaaaataggcaaggcaatgtgtttgccagttatgttggtttacctagacttgcacctagaaggaggaccatttgggtgccccgtattttggtaactaacattgatggacccaattttgttggggaccaaaatgtgccaaaatgagaatataggtacatgagaggcattgaagttttggcctatgctagaaaatgtgattctcaccaagttcaagaattggagccaataatgaggatgaagaattcacatcaagaaccaatgccatctcggtaacatgcttttggtttgtaatttttttatatagccttatgtatgttgcattgcattctcatagctctttccaaaattaaatttccctctcgtatgaaaatcgtcatatatgcatgttaagcataataaatgtggcatatgaagctataggtttggtcataatcacacatcatgtttgcctcatattgcttttgtgcttattgtcaatcatttttttatcttagttcgatcttgagtttattttcctatctttgttgagatgaagagaatatcacattaaggaaaagtattgcatttcttgcatatgcactacaactcttagaatgtgaacaaagtgatcaaagtgcaagaaaggttttcaaaaggtccattttgaccaaaagtcaattttttgagaaaaaaactataattcttgaaaactattacatggaaaatgtttcaaaaggtctctaatatgttttccaaactttagtttgcaagaaaaaatatttgtaaagtaaatatgcatttttgactaaaattctagtttctaggatcttgttttggagcaaaactatttttctctctacaaggatatctaaagggaatttgaaatggagaccaaaacaagttagatagagttggtcatttcaaatgtttttggtttttgaaccttatccgaaagaccaacctattaaaagaaatttgatgtcaaaactcaccaaaaaatttagctagaccatatatggtcactttctagcacttggttgagtttatttcttaaacctgaataattgcatctttttggctcaaaatcatatttgaacttcatgcatattaatttctctcaaataccatctcatttgcttcttttcgcatttttagaggaaggtatttgaaaagagagcttttgtgtccgtttgctaaaacttggcctttactatcaaatcttgaattcagggagtagaaatgagagttgcattaatggggaacaatctgaatcaaatccatattccccttgctcccaaatatgaatttttgaaaaaagttgtatccatcgcctttgaaaagagcctaatttggtgaaaaagtcaaaaatcttatttaaatggcccaaatttgtgaaaatcctttcaaaagtatccaaatatgtatttcaaatgttttgcaaggctttcgaagtaaaaattttcatttgtgaaacaaaatagcaaaattggtttcaataggatcttgtttttgttgaaaatgttttatttccctaaatcaaaatatattgagtttttggaaaaattttctatacaaaacttttagagttggtcatttcaaacatttctctaattcaaagttctcccaaaataccaaccattcaaactatacaaccatttaaatttcagccaaaatcttgacttggccatttttggcctaaacttgcatatggtgtgttaagcctttagagtcaaagttctttgtgaatcttggcttggaagtgtatttataaccctcctaaggctttacgaatgtcaaactccatggatttcaaatttgaatgtgatttgagctctcaactcaaatttactcaccctaaaggcctacaatgcttattttgtcttatcttttaatataaaaatgatttttaagaaattatttttggaaaatttcctcacaagtataaagatcatatatgcaaggtttcaactcatttcgatttgatttgcaaagattttgactttttctcgttttgctcagcctgctgaaattttcagaacaaccatgtttttgggcagatttgtgattttcgtatctccaaatgggttgcaaatttgaagaagatcacaacatgagttttgatcctctatagttgaaatttatttcaaaatttattcagaattgttggaggtcatttatctaccttttcaatgttgttttaaagctaatatgaatgtccaaaatctgaaacttccagtttgctgaaactttgagacgtttttatctctaaatgggttgcaaactaggaggaacttataatacaacttttgatcctaaatagttgaagtttgcttccaaatttactcaaaattttcagtggtcatttggatgccttttcaacctcattttcaatctcaaaaatctgaaaaagtctgaatttttcagttggctgaaagcttttgagcttcatttcttcatgttaattgtgatctaggcaatggtcccaaaatgaaacttgtgcattcttttatgaactatctccggggtttatggcatattttttcgagcttggttccacaggttcctattgttaaaagatgccaacattgctatgtgctttttcatctaaacatggatttcaatgtgcatatcatttcttgtttattatttgagcatggtggtgaaatataagatatttcaagtaatgagctctttgttattttaaaaacctcatgaattcttgaactcttttagtttttgaaatacccatgatatatgaaaccacctaaactcaaaagtcatttttggatttctcaaaaccaagcctccatggatagactccaaattccaatctttgccaccaaatacaagttgatccttgctaccaaagctaactaccattccttcatcccaaattcgaattcctatacacaagtggtctctaaacaaatggtagtttatcttgatcatcttgaacacggcactagctcatcattttcattccttgccgatattgtgcacatgtaaaattcttccaaatagccttgaccaagctcttctcaatttttgacattcttgagaaaacctttgatgagaatatctcaagtgaaagttcaagtgctcaaactaaccccttctacatatgaaatctattccaaattccatatccaaagacaaatatctataagtaagggggagttttcctaaatgggcaatttctaaaatttgttgctttgtgcttccataaaaattttatttggccttgtgggtctttattcatttttgggcttttgtaattgcctattttctaaccctttttcatttttgggtgattaatgccaaaaggggtagaatatttgaggatcccacatttgatcttaaagggagagaatatttgtgatatccttatgatcatagctataaaaggggaaaatattctaggatcccacatcatagcattacatatgcatcatatgcgtaagcatgtcattggcatatatatcactcctatttactcaatgacatgcatggatataaatcaattgccaagcttcaatacaatgataatctatatacttcatatccaaatgtggttattattaatgaatttgtcatcaatcaccaaaaaaggggatattgtaagttcaagtgccttaatttggtttggtgattaatgaaaaatctaataatatgagactaacgtttttatgaacttttctttgactagtctcgtttggatatgaaaataaaaatgatgagagttgtcaactaggttatttcccgatgatgagatgtggtagatatgcattctttggtgatgaaatgcatggagataaaacgttatgtaccacttcttatctcctactttttgataggttcatatatatgatttccatgttattgttatataagtgtgagactaacgtttattcgagttgtatcttatttaatctcatttacattaagaacatggaaatcatgaatgtatgtgttttatgctggtctacatcattactacatatgccttctctatgtgtataggataaacccccattgatcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatg

SEQ ID NO: 4334 - DNA, 1097 bp, Oryza sativa
gcattgaaaaagttcaaaaagcatcaaaacatgaattttggacatattggagtgtattgggtgcgttcgtggcaaaaactcacttcgtgattcgcgcatgtacttttgtcaattaataccaatattggcatatgttgagaccccacaggtgcgatatttttgacctgattgaataagttcaaaaagcaccaaaacaagatttctggacatattggagtgtattgggtgcgttcgtggcaaaaactcacttcgtgaatcgcgcgggtacttttgtcaattaataccgatattggcatatgttgagaccccacggctgcgatgtttttgaccggattgaataagttcaaaaagcatccaaacaagaattttggacatattggagtgtattgggtgcgttcgtggcaaaaactcacttcgtgattcgcgcgggtacttttgtccattaatgccaatattggcatatattgagccccacgggtgcgatgtttttgaccagaatgaaaaagttctaaaagcaccaaaacatgaattttggacatattggagtgtattgggtgcgttcgtggtaaaaactcacttcgtgcttcacgcgggtacttttgtcaattaatgccaatattggcatatatttagccccacgggtgcgatgtttttgaccggaatgaaaaagttcaaaaagcgccaaaacatgaattttggacttattggagtgtattgggtgcgttcgtggcaaaaactcacttcgtgattcgcgcgggtacttttgtcaattaataccgatattggcatatgttgagaccccacgggtgcgatatttttgaccggaatgaataagttcaaaaagcatccaaacatgaattttggacatattggagtgtattgggtgcgttcgtggcaaaaactcacttcgtgattcgcgcgggtacttttgtcaattaataccaatattggcatatgttgagccccacgggtgcgatgtttttgacccgaatgaaaaagttcaaaagcatccaaacaagaattttggacatattggagtgtattgggtgcgttcgtggcaaaaactcacttagtgattcgcgcgggtacttttgtca

SEQ ID NO: 4335 - DNA, 1106 bp, Oryza sativa
  unsure (1)..(1106): unsure at all n locations
nnnnnnnnnnnnnnnnnnnnnnnnnnnnnnnnnnnnnnnnnnnnnnnnnnnnnnncacgggtgcgatgtttttgaccggaatgaaaaagttcaaaaagcatccaaacatgaattttggacatattggagtgtagtgggtacgttcgtggcaaaaactcacttcgtgattcgcgcgggtacttttgtccattaatgccaatattggcatatattgagcccccacgggtgcgatgtttttgaccggaatgaaaaagttcaaaaagcaccaaaacatgaattttggacatattggagtgtactgggtgcgttcgtggcaaaaactcacttcgtgcttcgcgcgggtacttttgtcaattaatgccaatattggcatatattgagccccacgggtgcgatgtttttgaccggaatgaaaaagttcaaaaagcgccaaaacatgaattttggacttattggagtgtatcgggtgcgttcgtggcaaaaactcacttcgtgattcgcgcgggtactcttgtcaattaataccaatattggcatatgttgagaccccacgggtgcgatatttttgaccggaatgaaaaagttcaaatagcaccaaaacaagatttctggacatattggagtgtattgggtgcgttcgtggcaaaaactcacttcgtgattcgcgcgggtacttttgtcaattaataccaatattggcatatgttgagaccccacgggtgcgatatttttgaccggattgaataagttcaaaaagcatccaaacatgaattttggacatattggagtgtatggggtgcgttcgtggcaaaaactcacttcgtgattcgcgcgggtacttttgtcaattaatgccaatattggcatatgttgagagcccacgggtacaatgtttttgaccggaatgaaaaagttcaaaaagcgccaaaacatgaattttggacatattggagtgtattgggtgcgttcgtggcaaaaactcacttcgtgaatcgcgcgggtacttttgtcaattaataccgatattggcatatgttgagaccccacgggtgcgatgtttttgaccagattgaataagttcaaaaagcatcaaaacatgaattttg

SEQ ID NO: 4336 - DNA, 702 bp, Oryza sativa
cccgcgcgattcacgaagtgagtttttgccacgaacgctacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactctaatatgtccaaaatccatgtttggatgcttttttaacttattcaatccggtcaaaaacatcgcacccatggggtctcaaaatatgccaatatcggtattaatggacaaaagtacccgcgcgaatcacgaagtgagtttttgccacgaacgcatccaatgcactccaatatgtccaaaattcatgtttggatgctttttgaacttattcaatccggtcaaaaatttcgcacacgtggggtctcaacatatgccaatattggtattaattgacaaaagtacccgcgcgaatcacgaagtgaggttttgccacgtacgcacccaatacactccaatatgtccaaaattcatgttttggtgctttttgaactttttcattcctgtcaaaaatatcgcacccctggggtctcaacatatgccaatattgtattaattgacaaaagtacccgcgcgaatcaccaagtgagtttttgcacgaacgccccca

SEQ ID NO: 4337 - DNA, 639 bp, Oryza sativa
  unsure (1)..(639): unsure at all n locations
ggcgaattcgagctcggtaccctttgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgctagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattacatgtgacaagacgatcacgcgtgggcgtgattcactttatgtcaacgggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatannnnnnnnnnnnnnnnnnnnnnnnnnnnnnnnnnnnnnnnnnnnnnnnnnnnnnnnnn

SEQ ID NO: 4338 - DNA, 601 bp, Oryza sativa
  unsure (1)..(601): unsure at all n locations
nnnnnnnnnnnnnnnnnnnnnnnnnnnnnnnnnnnattggcatatattgagcgccacgggtgcgatgtttttgaccggaatgaaaaagttcaaaaagcgccaaaacatgaattttggacttattggagtgtatcgggtgcgttcgtggtaaaaactcactttgtgattcgcgcgggtactcttgtcaattaataccaatattggcatatgtcgagaccccacgggtgcgatatttttgaccggaatgaaaaagttcaaatagcaccaaaacaagatttctggacatattggagtgtattgggtgcgttcgtggcaaaaactcacttcgtgattcgcgcgggtacatttgtcaattaataccaatattggcatatgttgagaccccacgggtgcgatatttttgaccggattgaataagttcaaaaagcatccaaacatgaattttggacataatggaaagtgtattgggtgcgttcgggcaaaaactcacttcgtgattcgcgcgggtacttttgtcagttaataccaatattggcatatgttgagaccccacgggtgcgatatttttgaccggattgaataagttcaaaaagcatacaaa

SEQ ID NO: 4339 - DNA, 7263 bp, Oryza sativa
  unsure (1)..(7263): unsure at all n locations
aatatacatgttttgataattgcatgggatcagggaattacctatctgcttgtttgtgccatatttatttgatattcgtcctttgtcaactctgggtgataaatcgactagcttgtgttacttatgtgacctagctagaactatatgcttagccatgcttaattaccactagctcagttgatgggataattgcagtattagacctttctagtttcagaacgagctgcgtgctcgggacatccgaccatgtttcattggtcgtaattacccaactgaaatgcgacataatggtgggctgtgggtgcatggttttgctagtcgtgcccatggcaattaaggaccggttcacgggaaatcctagaagaacttatcatgcttaccacaagccagcgtgggcaacgactgggcttgtagtgtagctttcctctagccgacgtacccaggttagggtgggcgtgatggagttgggtcggccagggtgttcggttgatcggctttcggattcaccgtggcacgagagggtgaagcatctaggcctccggtgttaagtttgataattaatgacaagcgctaattgtggactaactgatgtctttgagctatatattttaagttaggtccacatcatgtgtgcgcatggatgactatcgatggattaaaattgatggcgcgaagcgaagaaaagaaaacggtaaaactagtgttttagttttaaaattgatcgaggtgaagggcgatcaaatttgctagtttacttgttagttttgccgtactatcaaggggggtaatgacctagtaaaaagatgattaaattgccacattaggtcattgcattttctcttgtgctcacatcttcacacacacacaatcacctttgttttcacttggttcggcctgactaggggcggtcagaccggccacacactggcggtctgaccggcgtgccctggccggtctgaccggtgccacaacggcggtctgaccggcgcataaggtcggtctgaccggcggcacatgcacggtcagaccggccccctggaggccaggatggtgctgctcagggtggccgatacagagccgacggagccgtagtcggttagaccgagccgatggtggtctgaccaagccgaggccggtctgaccgccctctcaacgtcggtctgaccggccaggccgatggggccctctgacagcacttcaacggctagttttctagccgttgcagagtagcacggtctgaccggccacatacctccggtcagaccggcagagcacaaagttgggggatttcgcccccaacggctagttttggtgggtgggagtataaatactcccccaccagcagcaaggggactcttttggcacccaattcaattgcatacaccccttgcacctctctcacacccacttgagctttgtgttcatccatctagtgtgttagaggtttgatctagccaagagtcaagtgcatttgcttccattgtagagctagtgtggcacttgattgatcatctccacaccgggtcattgcttgttactcttggaggttgccgcctactagacagcttgtggaggagttgcccggtgacctctctgagaagattgtggaggaggcatctggacgggtcaccacgtagttatcccaccccgcagaagcgggaccttgcaactggtgtgtagcaaaagcaactttctctttgtccgtgcattgcagtaggttcagcttcttctcaatagcacggagccagtcgttggcccccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatctgagtgactgttgggttctcgggcggcggagatgaactgctgccaggtgcaccactggtatgagcttcatctgtctgctcttcactgccactggcgtcgtttgagtcacggggatcattccttgtcttcaccatctggacgaggataggtagaaataagagaaaggaagaaaacagatggctcagaaactaatctctctgataaaattaagtgcaattatcttaatcttgattaaaacactaaaaaagaggcacgcaattcctaattaaggctgtcataccactcacacatgatatcgaccgccgactaacccacaagcaacaaacctaaacacaaaaactagcacgcaaacagactaagaagacgataaagctaagggcggcgactctgaggctcgagcggcgcttgcgatcgaagaacaggtctgacttctaaggtagacaagggatgggaatcaatgcatgctcaaatccaaatttagacaacgcaacaaatggcccaaacaactagccaagcatgatgatttttatgcatggaacatttttcatgaacccaaacaaaaaaacactaatgcaactgactaaacaatgacttaatgcatgaaataaatgcacgataataatgatgcgcataaagactgcatcccatcgaatctagacacaacttaatgcataccaccgaacaattcccgactgactgccaaataaattccaaataaagttttgctaaaaccctggactgtccctagtcaagagatccgattaaataggcgaccaagattttctcccaaaatcaaaagatcaaaccccaaagtttcccgaaacaaatccaagtgaaaaaggcatgtgcatatgaaaaggggtttagatggctcttaggttttccagttggcttgtcctacggtcaaggtcggctctgataccaacttgtcacgcccagaaattcacgaaccagaatttctaagctgaatgtgtattaaacccctgtccaggaccagccagggtacacaaatgacaattgttgacatacagatccacgtcttacaaaaatataaaagattacaaatgcagcgaaaaaaaaggtaaaagcgagctaagcctgaagacttgactcctgcagcgggcgattccattccacaggcaacccttaacggcagcgacgaaaccaacctcttcaagacatctccaactgagaagaacttcaactctggtgtgagggaaaagagcaagactaagtactacccactgtactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtctaacgctacgccacgttgcaacaggcccaaccaaccacctgaactacaccagttcattaagcttaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacatactccggaaagaggccgtgacaggacccttcgcataaccctctctaaccgatcgcaccacaccttagggttcgcccccgtccccagcaggcaactggcagcccccctttcgtgccgcggtgaatccggaagccgatcaacaggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgccaataatcagtctatgccttaatgtgatccccttttgtgcactagttaaactaagcaaggctaagcatctcccaaaccaacatctagtcattttaatacccaagttatcaatggcgtaagggaaacaacatatagctgagtaataggacccatcccacataatattgtaaaacaatgcaatatttaatagaaatgcgggacatttgtaaattgggtacaatatgatcaattgcaatgtatgacttgccttgctctcgcactgatggaaccacagcaacgtcttcaagaaaccacgaatcgacgaaacgggcgaaatctacgcgacaaacaaagcacacaagcaaaacatgctataagactactgaaacaggaaacaaaaccatttttaatggattctatacatttttatgaatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcggcgccggcaagcgggccccaccggttagcggctcgggagagggaggaaggggcgccggcaagcgggacccgcatggcagtgactcggggagggcggtccatggcggatcgggtccacggaccggggaggagcggcgcaccacgcggcggccacgcgacggtcgaaccgatggccccgatctacccaagggtagatcggacggcggcgggagctcgcggccggtgcgcgcgggcacggcgcaaaccggcccggcggccatggcgcgcgacggcgcggcgcgtatgcggcagcggcgcaaacgtccggccgccgccgaccgaccgcgatcggagatcgtcggcgtctcggcnaatcgacagctacgcggctaagcggcggcgcgacggctaaacggtgcggaagagagacagaaacagtaggagagtcctcaccgacaacgatcgacgacgccgagcgacggaggacgatggcgacggcgggacgagctctggaacctcctaacgaacaaaagnagaggggttatagggacaaaggagagtgcgaaagggcgagggccccggcaaaaggcgccggccatggcgtcactcaccggcgcacgacggggatggggctccggtggcgaacctcgacgcaggaggggtggacgaggtggacctcggccgcgtgaacccaacgccggcgacggcccggtgcggcggcgagtgtaccgccggctagagtcggccggagtagcgggagaggcgtcggcggatgggcgcacggcgcgggaccaatggagggcacgggagagagcggtggaaaaagaaaaaaaaggtggaggggagtgcgggcatgctttataggggctcgggagagacggacgtggccgaggcgagcccgatttcgccggcgacgtgggaggttggaggcgggggagagagagagagagcggcgggattcaaaatttgaatcccggccatctcggttgagggcgcggcgagagaaagagggggagtgggtgcgggaggcgcggcgcatgcacgggcgtggccgacgtggaccggagaaggcggggtgcggcggtttcgccggcggtgacaacgtgggcgtgcggccggaggttggggaagggcccgacaggtgggccccacctgtcggcgaccctggggagaggagggaggcggccggcctggctgggcctcggcctgcggccggcccagcagggaggagggggaggaaggagagaatgggccggcggcccattcgaaaaaaggaggaaaaagggaggaaaaagaaaaagaaaaaaggaaaaaggattttccctggaattaaaatattgcttgctcaattttaaatggttaaaattatttctagagctctgaaaattccactaaaaatcctgttaatgaatttcgacatgtagaactcaagaaaaattccacatgtcaaatccgattattatttgcattactttcttaaggattcatctctaggttaaattaaacaatttcttcggacgatttattttatgaatttagagcaagggaggggaacttcagggcgtgacgctgtgtcttgtgggtacagttgtagttgtatacctctgatcagagtaaaactattcgaatagccgtgcccgcccgttatgggcggtcgaccagattcaccgcgattagtctcacacttaataaatcgacccaatgcactgtagttcaggtgggatggttgggcctgttcaacgtggtgtagcattgttcagtggagatataatgttatcttaaccaactgtttcactgttttgctcaataaaatgttttacaactgcctttatgcaaatagccacaaacctccatttgtcttcccttgcacgtatgcatcattagggtggcttgttgagtacggtggttgtacttagccttgctattatttccccttttcagaagtgtagtgcttctgagctgaagacgaagttagaagaccaaggctcaaaccccagttgagttttgcctgtggagtggagctgaagccctgctatgatcgccttttccgctgctgtcgttctcattcggtgtgaggactaagtgccttttctgtaagtattttacgctttatttacgtttggaacttaatattacttgtcgttttgtataccttggctggtcctggacagagatttaatacacaaaatagtctgcaaatttaggctaaatttctgggcgtgacagcacatcgctggcaccgatggcggctaccggatctccctgccaccgacgtcaccgcccgccatcgacgcctcctatctcgcccccaccgacgcctcctctctcgccgcccgccaccgatgcctcctctcccgccctccaccgacgccttctctctcgtcgctcgccaccgacgcctcttctcccgcccaccaccaacgccatcctctgcactcccaggttgaagacgacaatgacgagctcgggcgcggtggcagcgatggagtctcggagcctctgagtggaagggcagagtcagtgatgctgcgtgggagggcagcggggccgtccccgtgtgccgtcgttcggcggccggcccccgccccttcgtgccaccgatgccttaccgtgcgcacctgtcgacctgcgtctgtgagagagagatttaggaagagggaaagacaaatggggggcaaaatgcaaaatatgttgccacgccagactgccacgtaagccagacaactcgctcagaggccctttagatctcaatgagtcacttaaacaagatggtggacctaagtgac

SEQ ID NO: 4340 - DNA, 27534 bp, Oryza sativa
ttactacaagcattccagcaaattgcacaaaccaagtctaccgaaataaaaagaagagaaaacagggaatgggggaaaaatccgtggatcttgtcgaccatcgttatccaccaccaccaccaccacgccgctcgctgccttcgtccccagccaccgccgctgcctccctctatccccacccgaactgctcactgcttccatccacgccccatagctccggaagggcgcaaggaagacagtgaggtagatgaggtcggcgacgctgctgtccgattcctcctgctttctcagatctagcggcgccgagctcggggacgcctgatccggcagcccgcccgctgtagccgctaaagaagaggtagaccaaatattgtttttcttttttcttttttttttgggaatttttggattggatttgtttccgtaagcttcggttcttgttgttcgtttggttggatttttttttatgttttgaattttttttcctttctccgattatgaggatgcaaagaacgcgatcggatttagggacgacgggtgcgatgggcgcaacggacgaaaacacggaacgaacgtgtactgactacggatggatgaagtaaaacgaactcttcaactacgcacgggacgcggacgaacgagaagttattaattttttaattagttgttattattattaagttattattataagatttagcatagcagcaacaacatcataaatcagttatacccgtaaagctacgatttttctcttttttttgaatttttttcggctcctcggagaggtttacacgtggttggtaactttgcaaaaatttatattactccggttgagttgttgtgtacctaacactgtgagtgagttggaagaaatttgcaatttaatttgggccgtaacgggatttgagatgaggaaagcccattagacccaaagtaccagcaccataaaaaccctagccgccctcctccccttcctcacagccgcctccactcctctcctcttctctcctagccctagccctagccctagggcgcgcgttcgctcaccgccgctgccgcctcggcaggtaagcattgatcgatcccctcgccgaccgtctctcttttcctctcttcttcttgaggcaggtttgccttgtatgttcatcgcgatcagtcatccacatgcaaagaacacctctctttttttcttttttgttaatttatcatccgatctagcaggatggaaatggttttcttcaaatcttttcagtactgagtgctctagttttgttgcgtctagcttcttgatttgccttctcatagatcggatgttccttttcagtattttgactgcacatgatttggttgtgaggatagcagtaaaaatgaattgatgtgttcttgataatagccataagtaatcatctttggtatcatcctaaactcgatttggttggtttggtatctgggttctgtgaattttccttgggcttattaacttctcctgacatagttgctggaagatttttggctaagattgcatgcgcttcagttttttttttgttggcttctaacgaggaggctcctttgctttttgtaaacaggaatttgcatccgtagcgtgatcttcaaaggctgccaagatggtgaagttcacggttgaagagctgcgcaggattatggacaagaagaataacattcgtaacatgtctgtcattgctcatgtcgaccatggtatgtgctacaagatttgatctattaagactaacgatgttttacagtagtacttcttagttctagcagttagtgttgtatttcgcttttcctattgtatcttgtttgcatttgtcctctaatgatgtatattttcatccgtgcatccataattccacctgttaccttctatatgtattgatttctgttaccttctatatgtatgactgatgcttacttttatatagtaccaattgtttacttgttcattttaacatgcctataattgtattagtcaattatttacttgttcatttgaacatgtgtaattgtattagatttgacatgaaatctcaaaatttacactgctttacttgtgtgcttgacatcgatgcctccatgcatgtcctattaatacaaatttgtttgaggttatctatgcttactaagccttaggattttttttggccaaatctctagtttctgtttttgtattgcaaatagtcaattatctttcaagttgtgatgctatttgtgtttttgttgtatataggctaatatgttcaatgctcatgctctaagcgtcattcatttcttatgctgagtatttgtttaattctaatgttttttgctttaatggcatgcctaatatgtgaaattttgttgattctaacaaggttttactgcttggtctgattcataattgtaacatgactatctttggactatttctaaatttctaaatattatgctgctgaagtgtgaattcatatgctatatactcctttaattggctatgcaagcatttcaactcttctgtaaatttgctgctgaccattccattttctgttagaaatacactatgctaatatgttatgtgttccttgcaggcaagtccacgcttacagattcccttgtggcagctgctgggattattgcccaggaagttgctggtgatgttcgcatgactgatacccgtgcagatgaagctgagcgtggtattacaatcaagtccactggcatctctcttttctacgagatgagtgatgaatcactcaagttatacaagggcgagagagacggaaatgagtacctgatcaaccttattgattcacctgggcacgttgatttttcttcggaggtcactgctgctcttcgtattactgatggtgctttggtggttgttgactgtattgagggtgtctgtgtgcaaactgaaactgtgctccgccaagctcttggtgagaggattaggcctgtccttactgtgaacaagatggacaggtgcttccttgagcttcaagtcgaaggtgaggaggcgtatcagaccttttcccgtgtcattgagaatgccaatgtcattatggcaacatatgaagacacgctccttggtgatgtccaagtttaccctgagaagggaactgttgctttctctgctggtttgcatggctgggctttcacactctcaagctttgctaagatgtatgcttccaagtttggagttgatgaatctaagatgatggagaggctttggggtgagaacttctttgacccggccacaaagaagtggaccaacaagagcactggctcagctacctgcaaaagaggtttcgttcagttctgttatgagccaatcaagcaaatcatcaacacttgcatgaatgaccagaaggacaagttgtggcctatgctgcagaagcttggtgtggtcatgaaggctgatgagaaggatcttatgggcaaggctctcatgaagcgtgttatgcaaacttggctgccagccagtaatgcacttcttgagatgatgatataccaccttccatctccttcgaaggcccagaagtaccgtgtggagaatctgtacgagggtcctcttgatgatgtctatgcaactgctatcaggaactgtgatccggaaggtcctctcatgctgtatgtttccaagatgattccagcatcagacaaaggtagattctttgcctttggccgtgtcttctctgggagggttgcaactggcatgaaggtgcgtattatgggtcccaactatgtccctggccagaagaaggatctgtatgtgaagagtgtccagcgtactgttatctggatgggaaagaaacaagagtctgttgaggatgttccttgtggtaacactgtcgctatggtcggtctggatcagttcatcacaaagaatgccaccctaacaaatgagaaggaagctgatgcctgcccaatcagagcaatgaagttctcagtgtccccagttgtgcgtgttgctgttcagtgcaaggttgcatctgatcttcccaagcttgttgaaggtttaaagcgtctggcaaagtctgatcctatggtcctctgtaccattgaggagtccggtgagcatatcattgctggagctggagagcttcaccttgaaatctgcttgaaggatctacaggaagacttcatgggtggtgctgagattattgtttcccctcctgttgtctccttccgtgagactgttcttgagaagtcctgccgtacagttatgagcaaatccccaaacaagcacaaccgtctttacatggaagctcgccccttggaggagggactggccgaggccatcgacgatggacgtattggcccacgtgacgatcccaaggtgcggtccaagatcctgtctgaggagtttgggtgggacaaggacctcgccaagaagatttggtgctttggacctgagaccactggccccaacatggtggtcgacatgtgtaagggagttcagtatcttaatgaaatcaaggactctgttgtggctgggttccagtgggcatcaaaagaaggtgcattggctgaggagaacatgcgcggcatctgcttcgaggtatgtgatgtggttctccacgctgatgctattcacaggggcggtggccaggtcattccgacagcgaggagggtcatctatgcttctcagctcaccgcgaagccaaggctgctggagccagtctacctggtggagatccaggcccctgagaatgcccttggcggtatctatggcgttctgaaccagaagagaggccatgtgttcgaggagatgcagaggcccggtaccccgctgtacaacatcaaggcttacctccccgtcatcgagtcgtttgggttctcgagccagctccgtgccgcaacatcgggccaggccttccctcagtgtgtctttgatcactgggacatgatgacttctgatcctctggaggtgagctcgcaggcgaaccagctggtgctggacatccgcaagaggaagggtctcaaggagcagatgacccctctctcggatttcgaggacaagctctaagaaaaaacccttttggtctcgcatatgtttttgccattaatttacctgttctaatagctgttctactattgttaaagagttataagacaagtcagaaatatgatgtgtttgttacacatcaagtatcggtgttggtagtgttgtgctgtggaactatatattttgctgtctggtgatatgcaacagatatggaactttgataatgtatctgttgatagtttttacggttttctgaatcagtttcagtttgatatatcatatccatatagtacctttcactttcgtttctgccgaaatcaaatctaaaccctccacatagatattattgtacgtgcctggagtcgtggactaactagctgctttgctgtaacctaacaactctttctttgcattaatcattctgtgcaactttattctttcttactttcttcaatattgtttcactcggataaaaacttttggaacatgtaaaaagaagctaccaatggttacataataagaaaagtcatcatgcaagtaagaaaaatatttaaattcacaagaccatgtctgtcttcaaattcacatcaattttagttatgaattaacacttactggtgcataattaatacacattgagagaaagtttaatggtttagtctgtttctagctaaaacaatacaaaaaaaatattaatacatattttttcagctaaagcaatacaaaaatattaatacatactttttcagtaaaactacataccccttcataaaagaatagaggatatattattaaataaaacgctctcggtgttattgatattcagactcttttttctcgttattgtgtaagatacttttacatttataagaaacgtgattattacaagaaagcagaattatctcctctttttcacattgtttaattttttaatataaaaagagtgatagtttttctgaaacaaacagaacgagttttttaatataaaaagagtgatagtttaaaatattttgtcgaatgatagtttttacagtctcctgcggcccttatactatttactccctccgtcccaaaatataacaatttaggattggatgggacacatctagtctaatgaatctggataaaaggctgtcgagattcgttggactagaatatgtcacgtacagttctagattgctatattttgtgacaaggtagtatcatataaacaactaatatttttcattattcttgtcattttcgtaaatatctactcgtttattgtacggactgcctggtttcgtcttcctctgatcttggtcatgctatcaatttttgtggcttttttttttttgcgtgtatggtggacggctaactagttttgggagatgaatgcatgatagcaaaatttggcctgtaagatgcactgcaacatactctgtcaaaaaaagcttaccgcattcctttatcctaggttatgttctatccttacctaggttaggttttttttgggacagagagaataagctacaagttttataagatgcatcggaaatttctagaatctgttgaagagatgagctatgagatgaacataactccaaggatttggggttaaggtttcaacagttggaatgttggtctagcttaatagaaagcaaagaaatggcagattgacataattgtaaagtttgttttggagcaaaattggttgaacataattccacgaaaattcatttcaccatggaaccaagaaaattctccagattttaaatcttacttcagaggtaataattattattatccgaaaacatagcctacaagagcctgcccgtatgtaagtttggttttcttcagatctttagatcgttaaaatcatattttctacacccatgtgtccattcatatattgatagggtttccaaatattgaaaacaaatgaacaatcgctagaaaacggagcaataggagattaaaatgttcatcacggaaacatgccataccatgtgctcaaatgtcgaaacaaaagcgggtcgcggaacatatcatattcgttacagggttcattttgatttgaagttttaggctaccagaaaataacatttggaagccaaccagctgacgatcgatatcagcatcttaagcagtgcgcaggatgatgtgaacaccactgtcagtgtccacagtgtcactcatctcaccaaccttgagagcaaatgtcgcatcttcgaagggtttctgcatctgcctcctcccaaaagtgcctgcaaggagggttacgccacggttagaaaagacctatagtactggcaaagatagaacccataccagaaaatcattatgcattatctgtaaagataacagtgcccaagaagcacataaaacataagtggccgtaatgcaacacaaagattgcaaagttattcccttaaagctatacttaaagatgcgcacacacagagaagaatatgggtgcttaggtaaattctcttaaagaattctcgattaaatatttctacttgaaacagacatgtgacactccctactcggcatgccgatgctaaggaataatgaagacaatgccataggctgatggaagacgtgtaatgtggctacaaacaagtcttaacagaataaacttgcacaataaaagatggatatcacaacataatggaatgactgcagaagtgcttgttacactgatataacgcgtgcaaccaaacaattgggaaacacaaaaggaagagaaaaaaaaatggtgcagtaattaactacaaaaaacattttatcagaggagctgaccatcaatgatcgaatgaagggaatcaacagtaacacccatttgggaattaatactctagttttcagcataagctattcatctgacttgtatgctcttacagctgaaccagctcatttcatttggcttaatttagcctgggttaattattcttgaaaggctatagttctacctgcaaagttagccccagtagtgcacaaattcgttgacaaaatagcaaatcttgtatcgcgcagacactacgtccactagtaggttgcagacactaacaacacagatccagtgggaggctggtgatctttcatgataaacagaccagcaaactatgccatcagaccaagcaaattattggatgtcctactcatgtcatgacatctgtgaatgttatacacgagttaaaattagaatttcattaaatgcctcatttcacactgtgacaaaaatgagtagatgatagatgtgaacaagctaactgatccttgtacaaacagttaggcaacaatccatagatgatagatgtgacctacctcctcctaggagctccaggaactcccgagcatatagctctatcgatcgataattcttgtttgagtagttactgttactattacaaacttacacataactcctgtatggattaagggttgcaattatagcgcaaaagttgattgaagtggcaagatgaaagaatcgcgtctcactcacagaagaaaggttgaaagatctccttgatttggctacaccaactaagtccgcaagaaacgaatggatgggccaagaagtggatctgagagagagagagatcagatcgggggacgcacccaggtcgccgccacggcgcgcggaggagcagtcggagtggcgggcggcgaggtcggcgaagttggcgcggccggagaggatctggtcgcggaggtcggcgaggcgcgcggcggcgtcggcgcgcgtggtagcggagatgacgcggccgtcgggatccttccaggaggccttgcggcgggagccctcgtgcttgatcaggatgtgcaacgccctcaccgtctccgtctccgtcgccgacgacgccatctcgatctcctcctctactcctccgcctcaccaatacgctttctgcgaatacgcttttcgagtccgtttgtgcaaaccacatggagtagtgatgaatgaatgaaataagggttttagagttgctatagggtgtgtgtttgcaagagaagttaccaacactcccctctcgttttccgcgtgcacgtttttcaaaccgttaaacggtatttttttgaaaaaagtttatatacaaaagttattttaaaaaaaatcatattaatccatttttaaaagaaaattagctaatacttaattaatcacgcgctaatggaccgcttcgtttttcgtgcatgggagatgggttcccaacaccacctccgaacataccatagtcctagtatgaacttgacttgaattccggatgttttattttccaaaatgataactttgaaagttcctcacttgatataaattcctaacacagccaaaattattcatattgattaaaccatatatattttggttgcttgtaattccattcaactttgtcaaatcgttgtgacttgtgtatatacttttcatgctctataatcaagatcatacacccacatattatgcacgtgctaaacttctacactggaagctagcatatatccatttcatccattccatctttatttccactatccaaataaattctccatgcttatatatgctttcttctcctaaaagaaaatcctttctaaaaaaagaaaaaaagagaaaataaatatggagggaaaggcatggttataaaaataattaagttatgctctctcaatattgagcatgatattaaaaaaaagtagccatgccctctacgtaattatgaaaggaggattttggagaagaaagtaagcacaaaggagaagtattttctttatttttcacatttcatttccaccatataccacacacacacattgcacgatcttgatcttgagtatgtttagtcatctattttagtccaagtttttgacttagtaataaatgtgaatacaagtatatcatgtttgattcctactaagctgtaacatcccggtctagggcttaataggattaatataatactcatatcaacaagttgcaacttcttttctggaagccaatctccaaagaactctagggttaagtgtgcttggcctggagcaatttgggatgggtgactgaccgggaaattcttcccgggtgcacacgagtgaggacaaagtgtgtagaaaagacatatgttggtctgtgagggcagtctatgacctatgaaagctgccagatgtaagtgggcccggcctgggagaggcgggtcgttacataagctccacatattaacttaagagtaggaataaaaaggcaatttggtgaagaattcatatgcttggagtgattgagtgaatcatttgaggaacttggatttcttttgaaaaatcatttgaaatcctccggaatgaaagttgaataaacatatgaaagctgccagatataagtgggcccggcctgggagaggcgggtcattacataagctccacatattaacttaagagtaggaataaaaaggcaatttggtgaagaattcatatgcttggagtgattgagtgaatcatttgaggaacttggatttcttttgaaaaatcatttgaaatcctccggaatgaaagttgaataaagattgggtgattagtgctctatttgctgttctgtctctcaagcgcttaaggcaaggaaatgaagtgtctcatgggaatcaggggtaagggtaagccactgtgccaaatttatttaatttgagagagagtacacatactttacacatttgagatatacagcatagtagcaactcctgatcaacaaccaagttttatttttgaggtgtctggatagttaatttctagtggttgcttcgtatccatcatggtgaaagtgaagcattggttatcccaatagtatgctaatgtctctaagctggctaaacaattatactaatatatgtagttgaactattataattactttaacttttattgatcttaactgagtttcattattacaaaactgaagactctcacaccactaaactcaccaacttcctaacactcaaaagcaaacaaacgcatgcacttacatcccaccactgatgtaaatcacatgcaagacccacacacacaaccaaacttaaaacaagcaaactaacacaacgatctaagacaacgactagacatggcactctagttcttccgagcatcgaaggtcgattgaaggctcgtcttcatcatcttgagttgctacccactcaatcttggaatggttgcgcttggattcttcttcttcatcatcacttataatgatgaccggaggatctgttaaggctggggcaacttctttttccaccacacggacctttggcgccaattgatagcgagggacaaatagagctctcttccttgcggtaagacgaatcctggccttctgcggcggtgcttctcccttcaatgcagctagttccttctccaaacgatccactttgtcctctagcttgcaaatcttaccacgattccggtcttcacgatcttgagccgctaacacagtctctgcacggctttcatccatagcccacagcatctcaaccaaatgccttgtagtagcatcattctcaattccttcagtctcaaggtagctgccacggtcacttccctggggttggcgaggatggtagcgatactcagtgtcggccaactgatcactgtagcgatcacggagctctcctatggcgatccttgccacctcctgacatgaatggatgtagtttcttcctccagcttcgaacatcactgaggggatatcttcactattactgttcaaggtgactttgactcgacacttctcttcatgacgatcatgaggaatctgggcataaaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagtttagaaaatcaaagtaaaaaggtaagtaaataaaataaaccaagcttgcaagataagttgaaacagttggaaataaggttacaaattttgtgcttttgaataacaggtttcaaaagaaatgaaagaaagttataaaatcaacatgttaaatttatttcagtgcagtaagattaaataaaacaatattgtaaaacttttgctggtaaatgagccattagtatagtaatagatgtacagtactaataacactggaataaattttgaatgagaaccattaaaagagattatgaagtgcatgtgccagtagtttggtttaattaaaagagaaagggaggagaacagttctacttttccaatatttttagagagcttctatggataaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataaaataaacggcgcagacgactccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaatccaacactatacaacataccctgttgtataggcccaaccattctgaacaaccatacccggctgtacagatctatctccaaaccaggaatataccattccaaaccaggagctaatcaaattattaccaattagcatctgttaacatgatgagaggtgtgagactaatcacgaaagacattgttagacccgcccataaccgcgggcacggctattcgaataggtttactctgatcagaggtgtaccactgtacccacaagacacaaccccacatcatgtcaccatgtgcctcaatacccccacagggtacctcggaaaggagttgtgacaataccccttgcataacacaatctaccggagcgcaccttcctggatcatattcccccccttataaataaggcatggactccccaccgacccccgtgggctcatctcccccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccaacaaaaccatgtgctcacaacccaccattatcaggttttagttggcacattaattaattaaccaatcacgattgaccatcgtgaactatcattaagccatcattaaattatagtgattcataagttatcccaatagtgtgctaatgtttctaagcagggctaagcaattatatctgatatctagttgaaccaatatacataaagctcaaccagtcaaattataataacccaaggtatcaaggaataaggtaatcaagaacaaaagggctataacaaacaataggttaattccacccaatgacattcgaaaataaatgcaatagttgaatagaaaccatagctttaaacaggatcaacatgctctaagggttgtttgggatctgtgtgacttgccttgctggccttggaactcttcaaactcttctctagcgaaaacggactctccggaaacgacggaatctaagcagaaaagagcaaaataaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaaaacttaaattgattttaattgaattatgacgcaataatgaattatttttgaaaaggaaaagaggatttattgcgtcagcgggctagggtttcggtggaccgggcgcacggcggcggttcacgcgaacggacggccgagatcgacttgatccaaaacggacggccgagatcgatcggtccacgaccggctcacgggagagggcgacgatgacgtcagcggtgacgtcaccaccggcggcggcggctcggcggctcgaacggcgcatgctcaccggcgaacggcggcgcttcggcacgaacggaggacaccaacgggtagcggacggcacggcgaactcaccggcgaccaaagcgacggcggaagaccaacggacggcgacggcgacgaggttgaaacggcggcggtcttcggcttgacgacggcgatgatgcttcggcggtctccgacggtggcgaagcggtggacgaggacggcgacggcttggcgaccacgacggcggtcttctcgagcgacgacgacgtctggaacggcggcggcgcacggctggagcgacggcggcgacggcggcgctagagcacacggcgctagagcgctacgggcgacgagaggcgaaggcgagggtggcggcgggtagaggagacaccggggaagcttataaaggggttaggaggcggcggcgaaggcccacggcggccggcgacgagaaggaaagttcgggaaaatcgaatccgaaacaaactcgaatccacgaatttgcaaacgattttagccggtgtttccaaaggagaaaaggtagaggagatcccaaagatcatttcccctctatcaattcggccggaaacggaaagaaacggccggattggaaagcggcggcggcggcgcgaaactacggtttcggccggaggaagacgacgggcctgacaggtgggccccacctatcagcgggcagacgcgcgcgcgcggcggcggactgggccggactgggccgaggagagagagaagagaggttttgggccgactttcggccctaagctaaaagaaactttttaaaacctttttcaatttaaattatttatgaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaataaattctaaaaattccatttaaacaacaatttatatattttgaattttcagggtgtgacaggcggcgcgaaactagggtttcgggcggcggcggccggaggttgacgacgaccctgacaggtgggccccacctgtcagcgggcggacgcgcgcgcgcgcagcggcggactgggccgaactgggctgaggagagagagaagagaggttttgggccgactttcagcccaaagccaaaagaagactttttaaaacctttttcaattaaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccaattaaacaacaatttatatattttgaattttcagggtgtgacagaagtagagtatagagtccatatagaaatacaattaagaaataatacaaattcagaattaaaaataaggaatattataagtagagtatagagtccatatagaaatacaattaagaaataatagaaattcggaattaaaaataaggaatattagaagtagaatatagagtccatatagaaatacaattaagaaataatagaaattcagaattaaaaataaggaataatagaagtagagtatagagtccatatagaaatacaattaaggaataatataaatttgaaattaaaaataagcaatattagaagtagagtatagagtctatgtaggaatttaaaactaagtaaaattcgaaataaacataataaaattaaaagtagagttttgagttcatataaaaatacaatttacaaataactaaaattataaattagaaaaatgggatgaagagtctaaattcaatataggaatacaatttaaaagtgactgaaattcgaaattaaaaattaaagaatattgaaagacgagtttagagtccacatagaaaatagaaataataaaaattcagaattaaaaataaataatattagaagaagagcatagagtttatataaaaatacaatttacagatagcaaaaatttgaaattaaaaaaagaaatattaaaagacgagtctatagtccatataggaatataatttacaagtaaataaaatttgatattaaaaataattaataaataacacgtatataaaatacaatatgaatattacacattagtagtttcgtaaagttagtacaaaatttaaaattatgttgtcattttaaaatatttgaataatacattgagaaaacgtatatgctattatatgagagaaaatataatgatgctagccgcgcaatctgcgcgggccaccatgctagttacacatattcaaatagataaatcgtagtggtaattttctaaatcaaagaagttgtagtggtatatatggatccaattaacaaaaagaaacggagggagtataaattagaatttagacttccagtggatgaaatcatacgcccatgactccaccaccatagtctccttatagtactggtgttttttttaaaaaaaattcccaatttctaaagatgaaccttgacaagagcttgtcggattcatcacaagaaattattctattttggaatgagagaaagtactactcactctgtccacaaatacaggttctataaaaactcacatctataagggatggaggccagggagtaacatccaaaaattgtcaaaaacaaattgtttaatcgacttgtctgcgttttcagtattgtaaaaaaaaatcagaaactaataaaacatggtaaatatctagaaatattatttcctgttaaatatttgtaccatatgatatatatatatatatatatatatatataataaaaaaatgctgctgcagtcagccactgtctatccacccaaccagccactgactgaagcttcaccatccccatccctcccatggccatggccgccgtcgccgcaacttcgccgacgacgacgccgtcgccaccgaccacgcacccaccttccacctaggcgacagtccgctccctgaccgccgcgggcaaccacgccgccgccctccgcgcgctctcctccatcaccatggcgtcgccgcagcagcagctcgaccactcggcgctcccgcccgccatcaagtccgccgcggccctccgcgacgcccgctccgcccgcgccatccacgccgccgcgctccgccgcggcttgctccaccgcccctccccggccgtcgccaacgcgctgctcaccgcctacgcgcgctgcggccgcctcgccgccgcgctcgaggtgttcggctccatctccgactccgcgcatgacgccgtctccttcaactccctcatctccgcgctctgcctcttccgccgctgggaccacgcgctcgccgcgctccgcgccatgctcgccggcggccacccgctcacttccttcacgctcgtcagcgtcctccgcgccgtctcccacctccccgccgccgccgccgccgttcgcctcggccgcgaggcgcacgccttcgcgctcaagaacggcctcctccatggccaccagcgcttcgccttcaacgcgctcctctccatgtacgcccgcctcggcctcgtcgccgacgcgcagaggctcttcgccggcgccacgcccggccgcggcgacgtcgtcacgtggaacaccatggtcagcgtgctcgtgcagagcgggatgttcgacgaggccgtccagacgctctacgacatggtggcgctcggcgtgcggcccgacggcgtcacgttcgcgagcgcgctcccggcgtgctcgcggctagagctgctcgacgtcggccgggagatgcacgcctacgtcatcaaggacgacgagctcgccgccaactcgttcgtggcgagcgcgctggtggacatgtacgccacgcacgagcaggtggggaaggcgaggcaggtgttcgacatggtgcccgactccgggaagcagctcgggatgtggaacgccatgatctgcggctacgcgcaggccggcatggacgaggaggcgcttcgtctgttcgcgcggatggaggcagaggccggcttcgtgccctgcgagaccaccatggccagcgtgctgccggcgtgcgcgcgctccgaggcgttcgccggcaaggaggccgtgcacgggtacgtggtgaagcgcggcatggcgggcaaccggttcgtgcagaacgcgctcatggacatgtacgcgcgcctcggcaagacggacgtcgcccgccggatcttcgccatggtcgacctccctgacgtcgtctcctggaacaccctcatcaccggctgcgtcgtccagggccacgtcgccgacgcgttccagctcgcccgcgagatgcagcagctagaagaaggcggcgtggtgccgaacgccatcaccctgatgaccctcctgccggggtgcgccatcctggcggcgccggcgagggggaaggagatccacgggtacgcggtgaggcacgcgctggacacggacgtggccgtcgggagcgcgctggtggacatgtacgccaagtgcgggtgcctggcgctgtcgagggcggtgttcgaccggctgccgcggcggaacaccatcacctggaacgtcctcatcatggcgtacggcatgcacgggctcggcggcgaggccacggtgctgttcgaccggatgacggcgagcggcgaggcgaggcccaacgaggtgaccttcatggcggccctggcggcgtgcagccactccggcatggtggaccgtgggctgcagctgttccacgccatggagcgcgaccacggcgtcgagccgacgccggacatcctcgcctgcgtcgtggacatcctggggcgcgccggcaggctggacgaggcgtacgccatggtgacctcgatgaaaaccgtgatggagaccagcaggtgtcggcgtggagcacgatgctcggcgcgtgccggctccaccgcaacgtccacctcggcgagatcgccggcgagcggctgctggagctggagccggaggaggcgagccactatgtgctcctctgcaacatctactccgcggccgggcagtggactcgggcggcggaggtgaggagcaggatgcggcggcgaggcgtggcgaaggagcccgggtgcagctggatcgaggtcgacggcgcgatccaccggttcatggccggcgagtcggcgcacccggcgagcgaggaggtgcacgcgcacatggaggcgctctggggggagatggtggcgcgcgggtacacgccggacacgtcgtgcgtgctccacgacatggacgacggcgacaaggcggccgtgctccggtgccacagcgagaagctcgccatcgcgttcgggctgctcagggcggcgccgggcgccaccattagggtggccaagaacctgagggtgtgcaacgactgccatgaggcggccaagttcttgtcaaagatggtcgggagggagatcgtgctcagggatgtcagaaggtttcaccatttccgcaacggccaatgctcctgtggggattactggtagtgaagtactagtctctcaaattaatgatgaattatatatagcatctaatacacatggttaagaacaaaaatgatatactcattcacataaggtgttcttgtaactcgattaatttacagcaaatgttcagttcatttgttgccactggagagacggggaagagagaagagtggggaggatggatgaagatggaaacgtggggattggaggcaaatgtattttagatgcatctaaaactatagaattatatcctatgttagatttaatgaaatattgctgatcaaacttaataaaatttcactaggaaaaaaaatctgttgtaatatacaaacgaatgttgtaatatgttacggtaacaaaatacaagttcaaaataagtacttcctctgtttttaaatattttacaccgttgacttttttaaatatgtttgaccgttcgttttattcaaaaaattttaagtaattattaattcttttcctattatttgattcattgttaaatatacttttatgtatatatatagttttacatatttcattaaagtttttgaatagaacgaacggtcaaacatgtattaaaaagttaacggtatcaaatatttagaaatagagggagtagcaaactaaattctagctagtgaacatatattgacaagtaaattttgttttttttatttattgcctgtagaagttgaagtcttacgtcacattcacatattaatctaatcttattattcttttcaaattttgtttaataaccatttaccccctccgtccaaaaagagtcaaacgagaggagagaatgtcgcatgctcttaacccaatttgtaactggtggtagtataataatttcctgcatcctccatggcctagttggatccggtttccagtgtcggcttcctcccgttccgtccagccaccgccaccgaccgggggatttacaattataacactacaaacattaacttttgctataataatattggacccacatttcatagacacagatgggctcatttctcattcactcagagtgtcaaaacagcgatcatgcgtccacaagtacgctgccggagccagtgagccaccaccacatcgatcacgcgcagctgcgcgcggccgcacataggcgaggcgcgaccgacttacctgctgtccggacaaggtcgcggaggacggcagagcgcgcgcacgccaggtgttcgacgcaattacatcgagaagaaaactctctggtagatagaattctcatctcggcttcggctgtgtgataagcaaatggtgaatttttggtttgctgtgagtgacgtctgttctttctgggtcttgaccagatgtcagcctgcaatgcaggtcatcaaagcaggagcatatgagcaccactgaggtcaggtagcagataccgaggtaactttggtccatcgttaccatctcagcagccacgggttccttgtgtatttgtcctaggctgacgcactccagcccttttgttttccaacaatttgcactcccaagtcccaactggcaactgctgttgacatttaagttttttagatcaaaaggctaccgcccagctttacttgaaaaagcataagatgtctggatacaggtttaaggctggggattccagcttacaagacaagcatttagccaagtctggcaacataagctgctggcccagcagaagcagagacaaaccagagagagcgccaaaactaccaccagattactgcacatttatccggcaaatcagctgcttcttcctgcttcttggatactggcatgcagtgaggccctcaaagcttccagctctcccctcaatttcattgggaccagatttttccactgtaagaaaaaagataaagctttatacggcacatgcataatgtcagaaatgttgacatttaagttttactcttgaatgccgattacagtacgaatcatatgatactctcgagctcaacttcctggaaggtgcaagttgcgatatttgatggttgatgcttaccacaaaatatagtctaaagtgtggcgtacatgagttcaccccatcgccattggtagcgtgagcgatcagttcaacaccgctcaacaactattcgacaaaacaccttcaaggcatctccctggcccttgtgattcctggctggctggctggttgcgaagaattaattcaggttccttctctcgtatctcttagattaatttgatgggtggtttcgatttcatacttccataagaagggtgttcggctatatcacaaattagattgtgtctatattacatttttatttcagtgctagatggatattttgtttgaaagctcacacaatcatttgttttcgatttaacacaacttttcagcaataccagtgcaaagtttgtacatatgatgatcgatgtttcacgtccaatcccacttttcaggtccactgataataactgtaattgagccagctatatttgactgcaagatttgaggactggatggcagaggctgtggtgtttggaatcctatgcaagattggatccatcttgagttcacatctaacacaggcgttcgttgcacacttgggaaaggaggtatcagttttcattgaaattgaaagcagtattaagcaaatcagaagtgagtttaggttgatgcaagctttcctgcaagacggccaagaaaaagaaagtcatagcaggctggcagaaacctttctacacgaagttcagcaggtatcatttgaagttgaagacattctggatgaatttgtctatttgtttggccaaaaacaaaccgcatctctaaaatcattgaggaacttctttccaaaatctaaaagtatgatgcactggcagagactagcagcagagctcaaagaagcgcagaaccgcctccagaatttgcgaaatttgaaggttcagtacaatattgacttatccgaagaaagtcctagttctatcaggtatgaagatagccaagttcacacaatccaacacataaagcataataacaaaattgttggttttgcaaacgagcgagactgcctacaagagctgctgatgacaaacgagaaatcatgctcaataatttccatatggggcatgggaggttcaggtaaaactactcttgtcaaaactgtttttgaaagaaaagctatcaagaatcgttttgattgcctgatctgggtaactgtgtcacaaacatatgacattactgaaataatgagaaagattatacaatgtgcattgaaggaaacttgcccagctgacctagaaagcatgtgtagtgaaggtgtagccctgaagctccaggggactttgcagggaaggacatacatgatgatcttggatgatgtgtgggatacaaatgtttggttcaacttggaaccttttctagatttgaacagcagaggaagcaaggttgtaattactactcgcataaacgatgttgcttctttggcagatgacaagaaccgccttcaactacgaggactaaacgaggcagagtcttgggacctcttttgcatgtgggcattcagacatactgaagatcaaacatgtcctctcagattggagagagtagcaagacagattgttggcaggtgtgaaggtctgccattagctataacggctgtaggcaatttgctatcattcaaaagactggattcgtttgagtgggataaattctataatcaactaaattgggaattgcacaatcgattggataaccaaggacttaacatggtgacccgactcctaggtttaagctacaggcatctaccagcccacttgaagaactgtttccttttgtccagtatctttccagaggactatatgatacacgggaagtggctaagtagactgttaatagcagaaggtttagttgaaccaaggaaaaatatgacactggaggagattgcaacagagtacattgaaaagctagtagatcgctgcctgctccaagttgtcaggagggataagcttggaagaatatggcaactccagatgcatgacattgtgagggaactggcaatttcaatatctgaaaaggaaggattctgcatgatttatactagtaaagaagcacatacatcagtggttgggtgcgagcctcgtcgtttatcagttcatgagaattatgacagagtccagcaaattataaatgctcaacgtattcgttctttctacccatatcaattggatagtgattattccgtgatgtcaaatgtgcaatgggtgtcaacaagtgctagatacttgaaggttctagaattaagcaatattccaatcacaacactgccgagagacattgggagcttgttcaatttacattatttaggattgagacgaaccaaggtcaagcaacttcctgaatcaattgacaggctccaaaatctccgaactttggacatctaccttactgaaataggaaaactgcccagcggcgtaaccaggctaaggttgctacgccatctgattgcaggcaaagctgaagctacttattttggccttgccgatgtctactcaggtgtgcaaatgcctaatggaacatggcaatcgctggacataaatgtattcacaggcatttctgcaagcaacaagttggtggaacaattggctaagttaacacagctgagatcgctgaagctgtcagacgttaaaagtactcactatgccaagctatttgtatccatcagcaagatgcgtcttctacagagcctgctaattgagactgccaatagggatgagtgtgtgagcttggaagccctgaaccctgcacctcatcaccttgaactactctttatgaaaggcaaactccatgagagcgtcataggctgccacctgtttgaggtaaataggctaagcctccgagagctgaatcttcagaatagcaggctcagcattgatccgcttccatcactctccaatttttgtaacctgacccttcttggtctgttcaacacttacagtggagaaagcttgctctttcaggcagggtggtttcctaagctccaaacactcactttggctgagctgcaaaatgtcaattcaatagtgatacaggagtatagcatggcaaatctctacaacctagctctcatctgcttgaaaaatctggagtatttgccccaaggcatggaattcctaaaatctgttgaagagttcaatctagtgggcatgcaccacaagttcatggaagatgtacaagctggttcctcatatgagaaagtcaaacacataccggtagttgactactttgaccaaagcaaagggaggtgggatcgactttcacgagtttatggcaaaggtaacccatgatctgctcatcacctcatcttctataagctgcataatgcattcttttgaccttcagtgatcaattccctatccttgcagaccaagacaacaagcatcagcagtaagcaaataaaagatggaaatatacccggtctccaagttatatatatatactagaaaatcaacgtgccttttggcacgctcatgttatagctctgcagatgatttctgtgggctattaagaaatagaaattttgcaaatactacagaatatgttcaatttccttaaaatttgaaaatccttaattatattttgttggtattatttagcgtttatttgttgtgtataattataattgaattgtccattaaatgataaaaatgtggtgatatttttatacttgttctaagttttgtttggaaacttatgcttgatgggtgtaattcatatgtccaagccggaataaaatttgtaattgataggtactacaagctaaccaacttgcatctgggctccgttgatatatgcttgatatttgctcccttgttcaaattattttgagcctcaaggatccttctagattaatccctaattcagaggccaacacctcttctgtaggtagaacaggagacctacaacgcagcaacattcaagcctttttctcaacaatgtatttttctttcacataatatgtgatttgtttggaaagtaaggggttgccacgtggcccaatcaaaactagacactgccaacatgagaatattattatattatagaattttttgtatctccatccattgtaactgtattcactcttttgccatccaaaaacaccttttatattttgccaatcttcgttagtatttcttaaagtaacacctgtcactttacctgtaacggacatgaccgttttgtcataccacggtaaccaaactggcgtggcgaaacaacgttgccacgccactcagaccagcgtggtagtgttgtttaaccacgccagcgaaaagattcggatcttgaaaataaccccccccccccccccacacacacacacagagagagacaaacacaatgtccttgtatatgtccaaaaaaaacaaaaacttaaaatataacttaaggatcatctctgaaatgttcttacatttttttgaaaaaaaattatagatatggatctaatgttctcataaaaaaattgcccaaggaaattatgctattacatagtaattgagacaatgttggaaatttttgaaatccttttcaaacaaccttggaatttgccccttcatttttgtgaaacttctacttgaactatcaatgccttcttttcttctcatgttttctggattttttattattttttgggtaaagaaaaattttctaaaattggaagttcgcgtgaggtcggatatggttttggggagcaaactagtgcttattgaatgacaatggcaaaagattgagcactaaaaaaaggaaggaaaaaagatggtaaaagatagaagggcaaaatatatgcggcagaagagagaatacagattcagttagtggcaatgagaccttcagatgatccttgcaatgtttgaatacagattcagtgtgtcaaagtctcaaagatggttgggtgagggatcgtgctcctgttgggattactggtagtatattacttgtcttctctgcgaaattaataatagcatataatacaccatacatgagaacaaaattgtaggccatttgctggtacggttaagtggaagctgtgccaatttctagatgaaatcatgaagttcaattattagaatctttgcagaaattatcataccattttgtccactgacgaaattattgtgatacggcaagctcttagcctcgcattttagaaacaaatttgtgcttgtggcgaacaaattgtgcacgcctggcaaaatgcttggcaaaccgtgtttgttatccaaacaaattggccacaaataacaaaagattaaatttgacagactaacaacaggaggctagaaatataaagtgcggtagtcatagaaaacgttgtggcacaggtacatcgcacagagttttgccttgatgcacaacacatcatatctaaattatactagtacggagttccaggtcaacaaaaggtaaaagattttcagttcgactacgaaccacccatgagtacccatatctaaattatatatatagtacggagaagacaagttcttgctatcactgctaaagatctagagaggcagatgcaaacccttcagcaaccagccaaccacccttgagaaaactctgtcaatcataagctcttctgttggcaagtggggatcttgatcgccggacaggaga

SEQ ID NO: 4341 - DNA, 19989 bp, Oryza sativa
tctgactagcttaggtaacataaatgttctggtgtcctcaagaaaatatttgcttagagaactgctgctcctagcataacataacatccccaagcataaatagtgcaatccaaggaactacttaaatgaatgtatgaaggacataccttcgatagcgatcattaacaggactcctgtcatacgaaccgtacacaggactcctttgacgaccgtagtcaggacttgggcgtgacctgtacactggactaactgatcgacgatatggactatcatctcgcctaccatagccacctcttgcaccatcatacctgtcacctcgttctgtatcatccctgaaggcatactcaacagaaatcaccctgtccaacaacttgctgcagacagaaggaaaaatacagaaggcatattggttacatgctacaataatttcaaaaatatcaaaatcattagtgtgtacagaattgcatagatttcagaagcagcataactgggtagctgtgtgcctctactgttgtgttttaagcaagactagaagaatgattgaatagtaacattcctaactgaatcgaacaattaaagcaatatctgctaattttccatgcacgtcagaaacaaaataatcaatgaagcgcctatgtggaaatttcatttatcctatataagcttgagaaagttccttatttgccatgcaaagttatccaatttccttatttgtcagcgacaattgattgtccccttgcgacaaccatatgaaattgtgacccttacatgccttcaataccattaacgtttctctgtttttggcatatcctaggaattaccaaaagatactccttccgttcacaaatacttgtcagttttgactttgactaatcatgctttctatagttatacctttcaaattatataactattgtatcaaattggtgttgttagatttgtgatcagaagtactttactaatattgtacatttagagctattcacttttgtattacctaattaaaaaattaatggtcaaaatcatattcataaaagtcaaaactgacgaatattcgcaaacaggagtcctttaattaacttcactatctcccgtattacccaatctacatccaactatctcccgtattacccaatctacatccaagccagtagctgctcctatgctatttcctcattccctcccatcagctcaagcagaaaccttcctccccaccctccacggcggtcttcgcccagaatcctccccggcactatgagcaaccatagcatgagtccggcagcactacctcccaaatataaaagctgctactcaggatccccatggctgcatggaatttgagggcaagcaccatcaccatgtccatggcaaccaccgagcagcccccaccatggaacgtttctactactgcaagttgtaatctgtaccaacaaactgcaaacagcagtacatgttgggccaccgatctaccacatatggtatttcgaagaggaactagatatatagcaccactatggttcaagggttcatgttttgttggccggaccaccagacagatttggcaacagcggcatggttgcagttgagggaaactctaggaagatccacgtgcaacagatttggctcattcatttttctataagcagtgggatccacatgccatgtttttttttgttatatccaaattctgaacgggttgcgaagaaaggtagactttgcatatgcacccattaacaaccctctaacagaaaattaccatgagtggcaaataagggagcaattgagaaaaggtagcaaataaaggaagagacaactctcagtggcaaacaaaaaattcacgtaactttacatggcaaataaggaaatctggtaacttcgcataaggaatctcaacaaggttaagaagaggtgaatcagattcatacgtagaatgagtagcttcaagtgcttttgtggcctcttcctgtgtttcaaactgcacaaaagcaaagttcctcctgatccgaacattcgaaagctttccaaatggttcgaaatgcctttcgatatcagtgactctggtgttgatggggtcaaagttaatgacaaatagtgtcttcgtgggtttagtattcacaggtggtttgctatagccatcacgcctggaaccacgatcaccctgtaataaaggccataataacgaatgcaatactttgacattaaagaccgactaaattaaacaacaaaactctcaacatgtaagtaaaacatgtttcaattttttcagggttataggtggtgacaagaacagcaagagaaattacccgtgaccactccaccgaaagcctgcgcctcccagggccaaaaggatagccatcaagggctcgtatggcctcatcaccatcacgctcatcctcaaagtagacaaaagcaaatcctaaagaaaaggtaaacacaattaagaacagagaaaaaataaataatgtctttgcgccaataggtgcaagcatttccagttttcctttatgataaacaactcaacacacaatccccgttcaatcagacctaataagaacagaagagtactgcacctgcaaaatatctgatggtatgaagagcactagtgtggttattggtagattccattgatggatcagagctaagcatgatgttgtaataacttatatccaaagtaagacgatacgactcaggagatactgagagtgcttcaccaataacagaacaatctcacaggcattgcttattgagacagcacgcacagaacattgtgatgttgatgccgggaggatggcatggtgatactgctagtcatggcatggtatggaatgatggaactgacggcacggcatggatcacatgatggtgccagtccccgctaaacatgctcgggcagtggtaacaacagtaaacagcgcgcgtcatgtaatggatggtcaagtgaaggggatggccggatgagtgcatggagggtgtttcaggagttgagttttgcctctgtagttcctgcgccagagtaaacatttaaaacatcttgcttcctgctgtacatatattgcaactgcggctacatgggcatggaccatcatacatatgcacaatttatgtgttccacgccgttggatgttacagatgtaacgacgacaagctaatcttaaacatcctaattgcttccacaaaacatatttaacataaagcacatcgacatgcttgggtggttattcttggtaaattactaaagattattattgtgaaaacatatcataaacatgagagtggtaaccaagaacagttcaaagttggaaaagaacctcttgttttctctagggtgaaaagaaaagaaaatttattagacaccatggactcgcaatctcgcaggagattaacaaatcggtgccgtatatgagcaccaaaccggatctaataattcacgggggaaaaaaaaagaagacaggtggagaggagggcaaaggcagacctgacttcatgtcgatgcggtcgatcctgccgtagcggtagaagaggcggtcgagctcggagtggcgggtgtcgtagtcgaggttccccacgaacacgggcctcatcttcgccttcgccttcgcagcaaatcaaagatcccaagacagcaagaaccagaaaaccctagcaaggaaagcagcagacagcgcaaccggatcagcccgaggactctctccaggtcgaggggttctagctcgagaaaccctagcgcctagagcctagcaccgaggaggaggaggagggtcacctgcgtcgtggtctcgtggagcggaggacgaagggggaggcggctagggcttttggggcttttggaggaggagggcttcttggtcggcgtcggtcggtgtcttgtgttggttggtttctgtttgggttcgttgggctgggccatactcgacatgggctggtaggcccatgcaatcatggactgtttggggagtcccaaccttcccgacacagtctagcttctttttgttaagattatgagaagatgttagacagtctccttacaaattataaaataataaaacccactagaaaccacagtctccttacaaattataaaatccacaagtgatattaaacagtaatatataaagctccaagacaaaccatggcttgaaaaagatggaaataagtaggagaataatatcttttttttcttggtgtttgttattttagggcctgttcagattgtagccaaaataaaccttacgaaattttggcaattccaaaattttggtaagatggcaatattgctaaaattttagcaggatttcttatgtatttactaaatttggcaacaaactaaacgtagacatttttttgtcaactttaccaaaaaatggtatggttgaaaatggcatcaaagtgaacaggcccttaatgtgtcacaaacattatggttgtctaatggcgcctttcttacaccttgaattatgtaatgataattctcatttgctcaaccaaaaagaagaaaagaatcttgtagtcaccatctacatatcattatccatgagagaaggaaaaagtgcacaacccttgaaggcttggagcattggatattgctgagccatcgatcttgtggataagagattctgaagctagggtgctatccatctagcaatcgagcttcttcagcaaaactacaaaagaacactatgtcgagcaacgtggattcaaagacatccaacaaagcctcctatcctcttgcatcttaagccattgaaacaacagcagctcaatcccaacatatttactcttcttaccttctccattgcatatataatagacacagctagctttgttgtaccattgaatcaatcatcaattttgcagcaatagctagacaatcagcgagacaaagtcacaaaaccatggcttctgcagatgctatcctgtcttcgcaggtggccggtgaatgcctgaagatcaacaaggtcagtcagtcacttcttctcactcaaatcaacaaagattcttcacgaatatatatacatatattcttgatcttgcacatgctgctgctggtgctggtcttgctcgattaggaccattttacatctggtgatttcttgggaaattttttcctggtgaattttgcagctggcagcagcaagcccagtgaaagtagtgcaggtgcagaagccgagcaaagagacgaagaacatcagcggtgcacctgtagctgccgctgccgtcagggtggttgtgagcaagcaagtgatgaagccacggtttgccgtggagctggatgggctcaactgcttcgagacacttgtccctcgctgatgatatcatgaagcgcacacacgagctgctagctgtgttccatctgatttgttgattttctggtcattatttttgcggggttatattatatttgttcaaattttctatgagttggatcctttcgcacgcgcgattatgtattttctttctttgaagtgatatgtgtaatttgctcttacgagtgattccgactgtgaagtattatttgttatataaagatatacgtgctattgatatctcagaggttataataaggttgggaaacgatttttctatgttgtaccttcgtactatatcatgagctttaaattttatgttttagtagaattcttcttatatcttaaaataaaactattttagctattcaaggacagaaggtgatttttccaagaaaacagttgattggtgctatgtgcagtgctacaactataatcataacaaaagcattgaattataaacattggtttaagaggttaagatgataagatcgaggggtggttttttcatgttgtaggggcgccatactatattatgagctcaaaatttcatcttgtatgaagatattgtttttatatgtagaatttttttagctactcaaggaaagaagaagttgctttcacgacttcttccaagaaaaagttgtttgtgtactaggcggtgtagtgctagcataacaaaataatggaattatcaacctaccaatgtgagtggttttcttcctcatagatgcattaattctttggaaaacacatacaacattaatcaagtagtagtattataaaacaagcttaatttgcactatctattcactatctacccacattgtaagtactaatgtaaacagtgatagtataaattgggctattgttttactcaagtagatatacatatcaacataaataccgcttaacacgttaaatcaatttgagaaaatcatattttcttcgagcatactctagctattcacatgatagaactacatctaaatttatcaaatacacattaattttataactgacataacaatacaataaaactgtcattttatttaagaccttaattgactgcatcaaatgagcaatcatgtatgccttgagaatttttttttaaagacaaagcaggacctataccaacattcattgaagagataaaaaatttttgctaattagagggaagtctaccttagacttcaaactccttatgtttgcaatatagctaccaattaagaaaaacccacatgactgaaaacactacatatgttacatatgttagtcttggcttttacacatttgggttttaatgtacttgaaataaatcaaaagtgccttatttttttttcttttttttttttggcccaaacctcttctcagtcaatttcacagtcaaatttgttggcctacccacggaaggacgatggatagactaagtccatacgaggctcctagcatatatgcaaaactaatgaaacaagattagatgccttgaaattatcttagagcattattaattgttaacttttgcatgatgttactcactactctaatagacatgaacaaatatttaatagttttatattaaaaaataaaaataaaataaaaagatatatatgttagcttttccataatgtttctcactactctaattgatgtggacaaacatttaattgctctttgtatcaaaagaaaacaagaataaaataaaaagatatgtccttatattatattatattatattatatgctaacacgaaattttttgtttgctgcttgaaaattaacgtttgaactttcaactcaatagcttaaaaatattttacctaaaagactacaatatataacttaaggtttttaaaacttccacatgagagctcctagatattttttttttgcatgaacagcagagccagcccctgagctggtcaggtggctactaggactctattgttgtaatgcttcactgtggattatcaagaaacccataaaaagttgtcgtcaacttataatattcttttatcacccaggctgaacaataccagtggcttcgtcattgattattttctccgtaaaattgtaatgtccgctttattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttccggctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccatacaggtacgcgatgcggcagccgaacgaccacggcttgccggcctggcatggattgcgtgaggggcttgattcattgattcattgcattgatttgttctaggtagttcaatagtagctatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactgcatcaagcccagaaatttcaacagaagaacaactatcactttcccacttcaaagtgatggaattctttgataagcctgtcagctaaacattaagagagtcatcacttagcacaaaattgtacaagcagtgccttttatcttaaccatcataactacacactgagggaaaaaaaaaaagaaatattggtgagtgttcacttacaatgtcagcagtagccaatttaatggcttccaactttggaaagcaagctcgtttactctgcagaagaaacatatgttcaggggaagcaagtagcatagtaacataactagtagcaatgtggtaacaggacaccagaccaccaacagactttactttgtaagatagttgtgagagatgtacacacaggcaacctgttggtatccattggtattaccagtgcacacaaattataaaaacaaaattattttcccacacacattgttttgtactgttctaaacagtataagatacctgtagtagctgatgcccttcattaagactgtagccaagaatccagaacatatacgccaactgaaaatttatataatggtatcaggatcagaatattgctgctctcaagataatggacaccatcaaatcatagaggatcctgatactataatcatcaatccagcgtgaaacttggacaggcatcagcaatatcatgagagtgaaagtcagttgtgatactattggattatttaagtactataacattgtgcaaatagaacaatttaccgactatacctgtgatgattatgttatagtctaggactcactagacactagttaatgttcattatttgggaatgtatatatgtgttttccatttttcttccctttttgtgggtgggccaacaactaactgaacaggaaagaagaagacaatattataatgtaaacctaaacctattataagaattcttgggaaacaaaaaagaaaagaccatggaaacctactgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctggtgtaattaaacattatgccactttaagactttgaaaatatggacagaacagacaatggaaaaggcattcaagtcaatgcaggaaaagttacatttgacaaataaatgctgattcaaggaaagatgaatcatctattccaaaaatagaagagcataggaattataattggaaagagaagggggaaaagagatagacgttcagatcatgccatcttgtagacattattaatgaaaataaagggatttctattgcatttgacatagactacaccaaatcaccaaaattcttagtttctcaaagtaaaacgaagttatagaactttaggtacctaatttcggcacgacagtgctctatatctttacattgtagacaatattcttgaatggcacagatgtcaactccaaaatatctgaactggttaaggatggaatacaactattcactgaaagaacacattgggcagcaatggaaacaacaagcaactatgctgtcagtataaaatagaactatttttatgagatgtacaatatgcattgtgctgaatatcatagctgcagaagaagtacagtagcagggaagtgaggagcaaatgtaattgttcaatagaattatggttattgtccaatagcacagtaacataattaggaagaaggcatgctgacataaaagcactccctattccaatagttattttgataaaaagccatcaccagaattttataattctcttcgatatagttggtgtgattcacagtaagtgacagcatacatttcaagaatcaagaggctcaaattctctaaaccaggagaactatggaaaaatgatgtattatctatttaattatgagaaatatattagtccaaatcaacatatatgtagaaaataaaaaacaatatgaaagaattacggaaatacgtactaatgtagttatcatatataatacaatgagaaaagaagaccatagtcaaatgctttattattgagcaaaaatgatggtattatttttatcatcttttagaggaatctatctaaatatagttaatcagcccgtgttagtagaagcatgtatcgtcatgcatcaacatatcatgagattattagttatagctaagtacaccggcgtaatcatacttagcatatcacgagactatcgggtaatggacaattatctttaattgtgctagagaaaaaatatcatacttagcatatcacgagactatcaggtaatggacaattatctttaattgtgctagaaaaaaaaaagtactcccttcgtcccataaaaaaccaacttaggactggatgtgacacatcctagtaaaacgaatctagacatgcatatgttcagatttgttgtactagaatgtgccacactagttctacattcgtttttttggaacaaaaggagtaaattacaatccatactatgtattctaaaaaattcttacaaattttcatataatgttatcctttaaccattttcatttacacaatagctaactttacattttaatttggaccaccatattttatccatctccaagtccggtgactcagtaatcacgtcgcacattaactctctctctctctctctctctctccattttcttctttcatctgacagttggataaccgatagatctagcaagaaagagcccggatatagcgccttcgctcttcgtcgggtcagctcctgccttccaaagtccctgcaagcccgacatctccgacctcaattgcaaccataacaatagtgtgcatcatgataggggaggagaaaaagacttgtcggttactagaggttaaggctgtgcatgtaaggcaaaggggaggaacgatggtggctcatggagaaagagcggtgatggcggtgcgtagagtgacagttagcagttgcaggtggtatgaggaatttgtcgtcgacacaatcttttaatttttttcctaagtattgatgatacgtgggtcaccagttatataaagaaatagcttttaaaatattagcttgccctaaaataaatgtcaaaacttttgaccgtccgtctttgaaaagtttatgaaaaaattaaaataaattagtcacacgtaaaatattattcatgttttatcatctaataacaataaaaatactaatcataaaaaattttaaataaaaaaaaagttaaacgccggacgtaaaccgtaataaaaaactacacttaattagggacggatggagcggtaaataaaaatatggagataaggttggagtatcgctacttgagataaagaaaaagaaacctctcgttgtctcctccgctccttgcctccttgcgccgccgccaagacgagtggcggctgaacaagggagggccgggcggcgatctccatcgcagcggaggggaggggatcctggtgcgtcttctttctgattcatctctctctctctctctctctctctctctcccaccccaccgggactggaatttgcgggattgcgttcgtaaaccctactagcttctcttctagatcttctcctcctccttaatttgatagccttaaacctctcttaaataaataattcaagtaataacagtttgtttgttcacccaaaagtttgggggttcaactgaacccccatgtcccaagttggatccgcccctgtgtcgaggtcttggtggtggtgggtaccatttcagaatcaaacctcatttcccatgcataaagtagtatgtatagtgtgtttacttaattttaggagagaaatagaatgctccattcacacatactagcactcattttgtcatcagtaatggagatgtcatcactactactccccatgccatgcaaaataaatatccatattaccgtttcattgcccacattatgatctttaattcggaaataataaggcattgcagcgagaaatccatggcatggggaggtctcttcttgagcttcagccgtccctcacaggaccaacagaagtcatgcctttcagctgctggtggtttcaactatgatgcgcctctccatggtgcctcaagaccaaaatcagtagctaaattgactgcgggagatactgaagcaagtgacaaagcgcttgtcgagcgcggcttcttcgtgaaccgttcacgtgttctggttggctctggcactaccaccttcaaccatgccaaatccgcgcttctctcctggaagtaaagcccaagaactacaaattttgttatgttgttcatctggtctccataaccaagcaaactggtgtatatctaggcatttggcactaggctgggcaaatgtggaacccgacacaccggtgaaggctggaacaaggttctgcatttgttacaaggagctgatcccttgggtcatgttgcccctccagattgcctatgtgaccgatggcaatggaggcaactcctcaggccatggaaaaggctgcgtttttgcttatggtagcggcactctacaaggccatctgctggtacgcctgcctcctaatctcatcaagtaacaatgaaacattgtagtactcactactcagtaatgtaaaatgttcagaatgcagtgcagagttgcaggtgtttttttactgaatgagttggatgatcatattttgatggtttgcaggcaggggaggagaggttctcggtgcagctggacgaagacgatcaggtgtggtacgaggtgatgtccttctcgaagccagcacacatcctgtccagcctctgctacccgtacgtgcagctgaggcagaagcatttcgcgcatcagtcagggcaggcactgctcaggcatgttgccagccgctccagggacacacggtgatcgacttcgtctgcagatttgatcttttcttcaggagtagtcttcgcatgttgtgagtgagcctgcttgtatgttcctgtatctatgtccgaatctgctcctgagagcattattagtttgtagtttgaatttttgagctcagggtaattatttagcatttgtgctttgttgttaagttttagatcaaattgaggtgttatggtgatgtaaattcagatttccatggtttgttactaaatcaaaaggaagaatgaaagataagcacaagaggaaccccacagttccacggaacaggtagaagagacgtcttgcaccaggcaaacgccccttgtttatagtgatgagagtatggattatctgtttgtcccctttaccatggtagtagagtactcaatggattagcaactttttccatgtctgtcactgtcactagaagaagctttgctagtgcaagtgttatctgagttgagcagacttgcagcagcaactgctgcttgattttcatttcattttattgccttcattattggtcagcttagcgttaagcattcaagcatagcctctgctcatcagaggaaagagaaagatgatgtcaaaatttatgcatgtttgctggcctgcacattagtgcactgtatattgttctgtctgtccacccataaagtttgaatacaaacttcagtcttttttcatcacattaacctattatacacacataacttttcagccacatcatctttaattttaaccaaaatccaaacttttgtactgaactaaacacagccaaaaagaagaagaaagcgtcctcccctccacgcaagcaagcaaaaaataaaaaaaataaaaaatttttcatgtgatgaagttgataaatctcacatctaataaatactcctccagtttcattttaattgatgttttggacaatacacggtctaccagatatatctttgaccttatttttctattataatatatacaatatataaatacatgtttacttttattaaatatttttaaagttattgatggttaaatttataaaagtttaatctcaaccttattcaaaacgtcaatcagagcgagcagttagtttccacggtatattttcccggtttgggttaggccatccatcctccatccctgggcgcttgctgggcctcggcggatcccccgaagcagccgccgcaacaacgagagaaaggcaacaaatcaatcaattcccccatcttcctcgttctctccgcctcctccccactctccatttatactcctcttctcctctccatcgccgcattgctcgccaccccgacgacgacgacgacgacggcgacggcggaggagtagagacagagagatggccgccgcgtcctccttcaccgccgccgccaagttcttggcgccggtgtccgcgagatccgccggggactacaagccgccgctcccgctcccggcctccgcctccctcaggcccgggaggaagcccgcgccccgcctccgcaccgcgctcgccgtctcctccgacgtgctccccgggaacaaggccgcccccgccgccgccgcccactccgtacgaaccaaatcccacatctcttcttgcttcttctctccctctctgaaatgatcccaaaatatatatatatatatatatatatatatatatatatatatgtgtgtgtgtgtgtgtgtgtgtgtgtgtccgatcttgcggggcgccgccgcagtttagctacttgagatgtggtaaaatttccgatcctgggtgttccggtttgtagattcgtcgtcattcctgaggtggtttaattctagaacatagttaagattacacgcgctgcttggaattttttttatgctaggctactttactgaatctcatgttgagcagctagttctcagtactaaaaatggcactttcttttagttagatcgaaagtgttccggaaagctgccctcttggcgacttccttactgtgactgtccaaccttttaagcggttttgtattctcgattgagatttctttagtgcaaataagaggtcaccaacaagcaactagaattcattgtttgccacgaatttggtgatgcaatttactactaaacctgatggaatctggaaatgcaaagtttaaagggaaggatccgtccttgcaatttcagaactggagaatgttgcctcacttcttgaaatgcagcttgcaattttgtagccactgtggtgcttcgatagggaaaactcatcttgtctgctgttacaagtgttaatagtagccttcttgattcatatcgtttcattttccacaggctgtcacgcgggaagaggctttggagctgtacgaggacatggttcttggccgtattttcgaggatatgtgcgcgcaaatgtactaccgtggcaagatgtttggttttgtccatttatacaatgggcaagaagctgtctccactggcttcatcaagctgctcaaccaagctgactgtgttgtcagcacataccgtgaccacgtccatgccctatccaagggtgtccctgcacgttctgtcatggctgagcttttcggtaaggccactggctgctgccgtggacaaggtggttctatgcacatgttctctgaaccccacaacctccttggaggttttgccttcatcggagagggcatccctgttgctactggtgctgcctttgctgctaaataccgccatgaggtgctcaagcagtctagccctgatggacttgatgtaaccctggcattctttggtgatggtacctgtaacaatggccaattctttgagtgcctgaacatggctcagctttggaagcttcctattgtgtttgttgtggagaacaatctatgggcaattgggatgtcgcatcttagggctacttcagacccagagatttataagaagggtccagcgtttggaatgcccggcgtgcatgttgatgggatggatgtcctgaaggtcagggaggtggctaaggaggccattgagagggcaaggagaggtgaaggaccgactcttgtggagtgtgagacttaccggttcagagggcattctcttgctgatccagatgagctcaggagacctggtaagggtcaccttccttgttcattttttagttcaatggtgtctactaggctaactaaacagagaaatggaaactataaggaaaatattcaggcacttaggtttctaatatttttaataccgttttgtttcatgtctgagtaagtacaatacacttcacaaactttgtactaattcaccacataatttccctcaggcaaggtcctctgatcctgtttagtgacgtcgtaattttataactatctagaatttttgatctgcttatatcactgaaggagtacttatatccttatttcaatgaaggagtgttaataagatttctgcatgtacatgcaaaaattttgcttccaaatttagtatatcctgtttcatcagatcagtatacgcatgatcttctttgctgatgaataactaatagggttatttgatacttaatgaaaatttattaaaattagttattgctatagaatagtctggtggaatgtttgtatttttatgccaattgaactattgaacaaaaagaaattctcgaagtctgtagcttttgttcttatcgtcatcccagtcatcttatctgacatgtcaacatcctgacagttattgctagattgtttggtagttacttcataggacatttggcaccccttttttcaactatcattttgacaatgaaaaacatcagtttttgggagaaacaaagagttgttgattaataggatctcatgagtcatcattgtttaaatgtgcttgcaatacatacaatcattaagtagggttgatatgtgagttgtgtcctacatttgttagttttttttgtctactttgatcttgagtaaatatgcccttgtttatatctaccaattctgtttgatttttgtaacctcaccgatattcttcatgatctatcttttttgtttggctgtgtatattcgtcatatttagttttatactttgattcatagccactgtaactcatgatgtttttttattggtctatatctgaaactatattctcattattcattttatggtttgtatcatcacacagttattgaatccttaagtcagctgtacagtttctttcctcctaatttgctctgactaaatcgtcttatgacattgtgcacagatgagaaatctcattacgccgcaagggaccccattacagccttgaagaagtacatcatcgaacagaaccttgcaactgaatccgagctgaagagcatcgagaaaaagatcgatgatgttgttgaagaggccgtggagttcgctgacgcaagcccgctccctccccggagccagcttctggaaaacgtgttctcagatcccaagggctttggaattggccctgacgggaagtaccggtgtgaggatcccttgttcacgcaaggcacggcccaagtctgagaggctcaacgagcacgcttatcagttattatgtcatgctttttcttgtctctctctagctctaccctatcctagtttttgtcgaacccatcgtcgtgttaagcgtaatgtaagcacaacctacttcttcatttgtttcattcttagacctcccatatcaatatgctcaactgctgccccagtttttgctcagtgtgttcgatttgctcttcagtagttctattggtttcagaacagctgggcctgtaatcactcactcctatgtctggacatgcaaagatacttctggtttagagtttcagctgagttacagtgattagtttcctgcctgttatactatatttataaacatcatgatggaatgtgagacaatatctgctgtccttgttttacttttggctaaaccatggacattgtcccagtcaaaaaggtactccctccatatttttttgttggttagctaaaaaatgaactaaccaacgtcatacatttgtgcaaggaggtagtatgaaatttagtatttgcaaatgttatagtctcataaggaagggcaggtaatggttagcggaacttaccaataaaaaatatcaaataaaggtttgaaaatttgatcagtaaagtttcttttttatatataaaaaaatgaatttatatccctctctgtaccataaccagtaccattagactacatgtccttttgcaattgaagattacaaagaaagtcttatgtgccaaaggatcctctttgaatcccaagtcatggtttacattagttctggctagagttatgtaacgccccgattttcgttcgggaataaaaatcaattaataatgcatttctagaaattatattaaaagttaaatcaatttaatcaagtgaaattatagaggaaattaaaatttcctttaaaaaaatcattggccgggaatattttgcaatattctttgtgccccaaaaatactctccggatttttccgcaaattttcggagctcaagaaataattttaaagtcacaaagttcatttaaccaattagaataaaaagaaaagaaaataatcttccccttcctcccttttgggcttagcccaagccttcccctccactcccgtgggccgcgcgcctcctccctctctcggccggcccgcgccttgcgaaagtctactttacgtcccccggttttcctcccctcctccttcctaggccggcctcctccctcggcccgctcggctctctctctccctcaagtctgctttacctccctcgcccgttttcccctctctctctccccgacaggtgggacccgaggccccacctgtcatcttcatcccttacctcccgtcgccccaaccgccgccatggccgccaaatcctcccacgtcaccgcctctcccgcgcgtgcgtggacgcggtcgtcgcccacgtcggcgccgttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcatccatttccccttgtttcccgggcccggcactctctccctcgctctccccacatcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctatccaccgtgctcccgttctccatcggtccctggcgagctccggccacctctagccgccgccctagccactg

SEQ ID NO: 4342 - DNA, 2729 bp, Oryza sativa
gtcgagctcccccgcctttccccgccccaagttgtcgcgtccttggggagctcctcctctccctccttgcctccctcctctgtctgccgtgcgtgctgccgcgccggtgcccgccgccggcgaccaccgggccgtgcgccgccgctgttaggtcgaccggccggcttgtcgccgccccgctcgcctaggccgcccggatccccttgccgcgccgcgccaccgctttcccgcgtgcgtcggccgtcgccgcagaaggccgcgccgccgtgagccgtcgctcggccgggccggcctgagctgtgccgtgctcagccgcgccaccccgtggccgcccgtcggttcccgtggaccggtggtggaccgcctcggtggtcccggtccacggtggaccggcgcccttgtgccgctgaccggtggggcccgcttgccggcgccgcccctcccctttgatgacgtcagcaaccgtctttgcctttgtaaaaataaataataattgcgcaataattcgtgaataattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcatgccagcgtgtagtttccgtcgtttcggaagtccgcggtcgcgaggaaaagagttcggaagatcaaagtgaagaagcaaggcaagtcacacatttcccttgagcatattgatcccaatttacagatgttttactgtttgcaaataaatatgcatgttttgctaattacatgggatccgggtattacctatctgctcgcttgtgccatgtttacttgatatctgttctttgtcaaccatgggtaataaatcgcctagcttgtgttactttggtgacctagctagaactatatgcttagccatgcttaattaccactagctcagtcgatgggataattgcagtattagacattctagtatcttgttgagcttcgtgctcgagacatctggccatgcttcatggtcgtaattatccaactaaaatgcgactgcatggtgggctgtgggtgcatggttttgctggtcgcacccatgtcagttaaggaccggttcgcggaatgccctggaagaacttattgtacttaccacaagccagcgtgggcaacgactgggcttgtagtgtagctttcctctagccgacgcatccaggcaagggtgggcgtgatggagtttggatgggccctgcgacggcctatgcggcttccggattcacctaggcacgagaagggactgcccactgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgttgggctgtgtcttgtgggtacagttgtacacctctgatcagagtaaaactattcgaatagccgtgaccgcggttatgagcggtcgaccagattcaccgtgattagtcccatcttaataagtcgacccaatacactgtagttcaggtggattggttggacctgttcaacgtggtgtagcgttgatcagtggagatttaatgttactttaattactcaacagttttactgttttgctcaataaaatgttttacaaccgcctttatgcaaatagccacaaacccctccttgtatccccttgcacatctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctagtcctggacagggatttaatacgcaaaatagtctgaaaatttgggttaaatttctgggcatgacaagttaagatttaccaaacgttctaacgattttcttccgttcttggctagggacttgcattctgcctgtaaaaccgaccctgagaccatgtgtgttcggctagatgccgcgctcgaatagagctgtggcttaccatctccaattgtaggacaactcgactcgtatggatgaaaatgacttgtgtacggagaaaactgcctctaccacatctatacctaataaaaaaattcgtaatgcttccgtgaggtttttttgtccgtcgccggtttcctgaacgcacacgcggttttttcgtccatcttttgtccatgcacaatcctattcggttagcaatagccatggaaaaaattgcaaaaaaaaaagggcggccgacgacgccaccaccgccgccggagggagccgccgctgccggatccgcacgcggatgaagccgacgccatcgcagccgttgggagggcgccgtcgccgtcaaggccgacggtgagagagagagggggagggacggccgtcgccgtcgtatccgccgcaccccgccgtcgctgcgccaagccgacaagacgggaaggaggggggagagggag

SEQ ID NO: 4343 - DNA, 2589 bp, Oryza sativa
gcctctccccctccccccagtggcccgcctcccccgccaccagtcgctgcccgcggtagggcaggtatgccgccgcctcgcctcggccgcgagatcgccggtcgctaccgccgccgccgccgccactcgccgactcgcggtgcgagagggaggagaatgagttggggagggggcgggggggaggggtggggagggttagggttttgataaggccgtgggccgaccggaagggacggaaataagtctattttaggtccctcaggccggaaataagtctgtattaggtccctcaggccgaaaaaaaaagagaagttcatttttagtgcttcattttttcagaagcatttataattatagttattaaatgtgtttatttctaagcaaacctaaaaggaaggattttctttctttttccaattaaataattattaaatgatatttgtattattaaaattagcaattaagttctgaaaattccaataaaattccaaagagcgtaactaatcatggagaatttaataaaattaaatttaacaatgtcattttatttctcgtacttgctttacttgtaaatttatttaattatacacatacctacttaaaaataccaaatatttcagcgaatttgtattttaattaatttgcatatttttactgatctgtgcgcttcccagtgcaacgcacgggcacttttgctaaactaaacaacaattttggtcaatatacacactccgtaatcacccggtgcaacgcacgggcacttttgctagttatttttatattcttttattttgaaacagaaacgaatgtgcaagaaacaaaaaaataaaaattattgaatacagatatgggatgaataagaagcggaatgaatactttcacggatatttgttggaccataaaaaccccttacgaggcttccgaaatcaaccgagagataaagttcgtttaaattttaacaactctatatacatatagaggtattgtatggacatatataaactaatagtatcatttggttttattacaataaagatacacagttacactaggcaccataaaaagctccaacattaataagaaatatcaggccattataaacatatcatatttgttgacgtcgaatcacgccatcacaccttgagcatgttatgtgcaacctgctgttaacaactaaatttggtaacatatgtgtcaggaaagaggatttgatcaaagcggagtcggaggcggagatcgggttcaaaagcagagcagaaatcggctggagtccagatcggctacggttaggatcggctgggtctgagtcgggctaaataagccgatacagccgattccgacaatacgacttgtacgcgatatcgggtttaagttaatgtacttcaagatgattgccacgcacggataaagtcctgggaaggcaattgtatctattaattaggatgttttatgtgaattccttatagataaatgtgggcaaaagtccgccgcaaagacttatggtatcttagagtttgttagagataatagtcgtgtccggtatgggcatatcttgtaattctcgggtataaatagaccccgagccctatgtaattttttaacacacacgttcaatacaatctcggcgcatcgccaccctttttgctttagttttgtttcgacgagttcttgctttcgggttgagctgcatcggtttcgatcttcaacaagaggtaaaattcgttatgacggactgcattcttaggattagtgcttccatcttcatgacactctaatcttgttcatgtaattcgtcgagctgtcatatatcttacataatctctagcaatatcgccacctaatctactatcggccaatatctgtatgcagaaggcagccgattaggttagatcttgacgttgatctagattatataagatatctaccattttacgaaacttctagcggcttgattgtctagatatcgttcttcttttcatacttaatgctgcatcagttgagtttgatctattaagtcgtgcttagaatatcgatctctagcctgccttctagttgccgattagaatagcatcggagtttcagccgatcgtatctgatttagctatatttattctatatgcctcattgatacgttaaatatgccctttatatcaagatattgctgtatctaaatatgttaggcctttgtttgatatattattcttgctttaatatcctgacatagagtagtatcggagtattagccgatacatgatagatctacctgatcggctacgctataaacatatatagtcctgttattgatatatatttcgatctaagtgatttatactgtctcggcatgatgaccgatctatcccaatcacttgatttaagtatacatcaatataaggagtatatatcgttaatatctacagccgatcgagtagatttagttcttctttacttattcatgactgccgatcgatacacagatgacatcggcccaaagataaatgatatgccatcggcatctagccgatcggctatgatttatagatttaaccacgggtcctttgcttctatttcttgttgattacaggatcaaat

SEQ ID NO: 4344 - DNA, 9582 bp, Oryza sativa
cttgaccctctatatttatagcaagggtggtcttgcgtctacagaactctttgcatgttctattaggttttttttggaaattttacaatcaaggacaccccggatcaatgaaagaaacatggggaaactctacttgaattcggactttgtgctgaatgtctaaccgttcagacacctgagtctgatcggccatacaatggcggttagatcagtcttcgtgggaaagcttcgattttttttaaatttggtttgaacttgctatacgtgtaaattattgccaaatttgagtgtcaacaatattattgtgatagtagataatattaaggatttatgttaagtaaaatatagaaattataaataccaaagactctttagtttttactaccatgaatctctagctttagttttgataaaattaaatcatttttaaatttgatattaacaaatacaaagttgcacccatcttgaaatcctaatttattaatttatattattgtttaaacacggtatagacacatgtgcctatacacatatgcacactcaccactatgaatatccatacggataccgtacccatatgagtaccttcgaagactagcctagcatatcttgagattgatgaagtcaccatagatgcttcgttgtcgacggatacatcgtctaacactaatactgaaataatttataagctaattctaaaatagaatgaaaacaaatatacaagtgcatgacacatagatttacggttaaataccatttctaaaataaaaacttagacaaatgagttaggactagaggtacctagtctaggtctttgtttgctatacgctatgcaaggagacactaacatattgctgtggtcagtcaaaaactatatgatacatttttcaacctgatacagctatgcacagggactcctcgcgtgcatatggaaagagagaggagccatcaacaatattgcatctataacattctaattttgttatgcctctttgcaacccaaatttgacttagttcccaatttcccatccatgccgtgatacatcgcagcgagctattctggtcagttttcagcaaaggttggtctgcaattttgggggaattccagctgtgcgtccaatggacgatgcaacttcccagtgaccattaaactaggtcatgctgaaagcaatcctcttttgataccttctcagaagctacacaacaaagacaggcgtaccagcttatttctctgtgcttcccaagttagatgtttacagggtttacaatcccgatcggtttttagcaaaaaaccgatcggttcttatgaaaccgctagggtccggtttgctaaaatcaagcctgtttatttatttgtttttggagttgatcgaaagtcatcagttttttttgcggaaatcaagccggtttatcttgttttttatggagttgatcgaaagtcgtcggttttgtttgcggtcggttttcagtaaaccaacatgaccgggtctcagctcgaaatctgtaatgtgaacctggctgttactgtcaatcttctctctgaagttagctgttagtgtcaatcttcagctgtgctgaattaatcaatgatccctgaattaaagtttgcttgcggtattaaaagtgcaggccttacttagaccactactgttgcctaacatccatttttttaggtagtaatgacatgtccttttttacttggagaaagcacattggctagtggagaattgatgccttctgaaaaagcagttcaatattgtgagaagcaagaatgactaggtgttaatagaaaagataaagagaggacaagaaaagcaaatggaatgaaagaaggaaaaaaataaaggaagagggcatgacacacgctaagtataagcagtcacatgaatcctgcgtatacaatacccatttgctagtaataaaagtataaatgggtgattttgtctcggggaagtatagtaaatctccaaaaaggggtcaattttcatgttgatagaatcaacatgttcagctgagataatttgacaaatccaatggagatggacaatccaattgaaagcagatttctctgaaaaatattcaacaagaatttcaccatgcatgtcaccaccacccataggagaaaacaataaatgtttgcgacgacgagagcgagaattcttgtaacaaacaatagcactatattttatagcacctcaaatttgagcgttaatacattgtacaccatacaaccggttttttggtctcaaaatcccagcttagctagttctaatcctcagaaactgcagtaacagcagtatgcccctagtctgctaaacgaacactcctttttgtctcgaactagatcttttcatgaactgatctaacatggacaaaccaacccagaatatgcaacaatggcactatctgaactgcaaaaaaggcttgatctgcatcatctgctgtattggactattggtacgatgacagctttgcgggcgaccttttgtaccttctgttgaaaaatgataagcgaagaattgttcattaggacttaacttcatctccttcctggtcctgcaaacctcctcgccgtaccaaatatgagagcctttgttaacagtccatggtcaaacgtgcatgccagggcaactgcgccacctacaaggatgactttgggtatattgcctgtccagtgctttggtttctcagcttcagcgttgttggttgaactggcctctgtcttgtcctctgcagtgatgagctcatcaggatcaaccttcgtgttgacatgtgccatggcagcgcattttgaaaggggctcgccagcagtccttgcgatttggtatgccctcaagccaggctcaatccttttgacgcagccccacatcccctgccgaacaccgagctttgcaatttcccttggaatccccatttcctcatgatggaacaggagcacctcacatgcggtcattgagccatcaccgtttcttgattcaactgataaaaagaacaagtgttagattcattggcctcacaaaatgtgtcatcccgcaaaatggagcgatggaactgcaaaattacctggacggatgcaccaactagagtagtacacgtccacacgacgaggtttgttgcaccttggaacagaggggcgaggcacaccctgaaaaattatgacaaaagttcaataacctaattcgcgcatatacggttaaatatttaaacatacaactgctatatgtagctatagatgaccaggatgcagcaagtatacttagcactaccagaggtaaaaagggcaaatgtaacttctcttagactcattctggaatccacaatagaacaaaaagcatgccattatcatgagcaactctacaggcatggccttgtcggcaaacataggaatttgaaaaggacctcataacagctaataatgcctttactcacaggacaagcatctcagccattgtgtggaatggcctgagaatatagtattacctagactgcaaggttgaaaacacatgataagtttggttatccggacctaaatagttggtggttcagagaattcatgcctactgcgtgctgtaaacaaacaaaaacggagtttttttttcccttgtgcaataggatgataatgcagtatgcaacaaaatttccagctaaacagttgcttgaaaggaactatgagaattgtaaaagcaattacaggaacttatgtaggagcattaaataacttgctaatagaaaaaaaaagcagattgtttcgttctatacctttgttacacagtaatacgtctttccagatgcccatatcctgcgaccgataatgtactccctgtcactgcagaagaacgggaactgcacagccaaggcatatagtataagcaaaagatatagtttgctggtgctctgtacaaagaataccagagatatcatacgaaaagctcaccttcctgacccaccggagaaccatcgttccagtctttgtgcactcctccaacgtatcgtgctgaagaagcatgtcgtcccaagtgttcttaatccggaactcgtcatcccagaagaaatccctgacaacttctggcgatgcatcctcaaagatagtgctactgcggtattgaggcgggccaccctagaacgaaacaaaccacataaactctttaattctaaagaattagggcttaatgaccagatattttcaactatgaactttattatcagtttatcatctaccgtatttcttagcagtaattcaaaactaacacagcaacaacaaacttgagagacaattcggccggtgctccccaacaaacacacaatcccctaaacccgaatttctcgattgtagaatcaagaaatattcctccatgtatgtactagtaagtatccatcgaattgagttcacgccgctgcggcgagatatcgattgaattgaatgttcacaccggattaagtagtactacctcaggatctctcctccatgcttggtagcgcatcgtgggcagcgtcttgtccatcatgtgaatccacgccggcccgccgtccttctcctcgacaaggcggcggaggtgcatcaaatctccggtgtcgacggccaatccctcatcctcctccggcgcggcggcggccatcgcagttctgcatccacacccaccacagtatcagtaaacaaaccagatgtccactcgaattcacccaatcgaggctcgtttgatttctgaaacaccataaaccctcacctaggaacggcggcaactagctcgttcttgcggcaggagtcctcggcggcggcacgcggcggcggcggcgcctccccgacgacgacgagggcccagcgcgggcgccacgcccagccgatgagtaggccgacgagggcggcgagccaaagcggcgcggcgagggaggcgagctcgagggcgacgccgccgagggtcggctggcggaagacccccatgagcagatcgagcaacgccgacatctcgcttctatttttcttttttgaactaatcacacacacgcctcaggaattaatcaaggaggaagaaaagatccgatttatcctcgtcgtcgtccgcccaaattctgaatcctgaatacaactagtacaagagcagcagcagcaatctgacaatcctcctactggtgatgcaatctgagaagaattttccaagacgcggaagagtagaggtttttgggcctagatgatgatgaaatcagtgtgtgtctattggcaccaaaatctctctctggcgctcatggcgtctgtttttgctcgctggagctcactggaccactataagcaaacgcaacgcaacaacaagcacaaacaccaagcgatcgagaggaggggaaaaaatcagggaagaatccaaaacggcggaggcgagtaatgtgcggtggagaagcgtctgcgtgggggataaggaggctcccagccaccgatcgattccgatggatttgatctgatggagaagaagaagacaatggagaattggagatggaggaggatatgccgggggatcaccgaggtgataaataccgtgtgttgggttgggtctggctcgtgtttgttgtggttgtgaccgtgtggggttaagacgtaagacgtgtgtgtgcgcgctgaccgggcgaccgtccacaaggaaggaaggatactggacgacggtgtgtgtttcttggtaatgggtcaccaccatcgatcatccatcacactactagtactacgatggagtatgtacgacgcccaccgtccgtccatggaattgacccgcacgcacacccgcgtgccggcgtggaacacgtatagggccttatttatacttgggttgaacgagtcctagctactagtatcagtctgtgcatgcacagcacggctgttaaaacttgggaacttccttcttgccattggtgccataggacattggtgccataggattatgttttatttgtgtactttttatcttgggttagcagtcattagtttatttctggttgatggttggtttcatcttttaaggctgtgtttaggattccggcacacaaaacaatatttgtattaacacgtaattaattaaatattagattttttcccccctaaaatggatcattatgattttttaagcaactttcgtatatagatttttttttaaaaaacacgccgtttaatagtttgaaaagcatgcgcgcggaaacaagggtgaggagttgagaactcccagcaaagaactggcctaagtttctttcaacttcacttattttagtgtgagattgtaataattggctataactctttgagcaaaggccggaatgctctattccattatctaaaaagaggattacgtttgatttcatacttacataatactccctcaaagcttgattcatattataactttttatttgactctttttttaaattaaacttatttaactctgaacgagaatgactccataaaaatcgtgatagacgaatcctaggctacctaatactccctccgaactgataatacttgtctttttagacaaggatgagatcaaacttcagaatctttaattgtgaatcattttaaaaatatttatctttcaaagatggtgactacatgcatatattggtctttaaaagcactttaataaaatcacatatttgttaacactcttattaatggtcaaagttgttttttagagaccatgcccttgtccaaaatgatagtaagtattatcaacccaaagggatcgtatatcggagtgtatttagagcaagtttaatagtatagccaactaatagctctaatttatctatagctaatctaatagctcatttatacaatagatacatactacactattaatacttggtcccactagtcatacacacattgtgtcttggagtccgtgctacagctgactataaatctgtagcctgctgctcttttctctcctcatttatcttcttaaaatatgtttgcaactggcttttagcctgctattgtacctgctcttacaaagagagatgctatacatacgatttttcatgtacgacactcgtacgacgtaaacgtttcccaatgcaagcctgtggcgtttttcagtcatttcccggcgatgcaccacaccatgttcaccatccgttaataatcgtatatgaattgcacgtacaagtcatatgcatactattttcgatttacaaaacaccctaaaaaattactaccatgtaggaatgttaacggcgtaagtttatagtatgaactagagattacggcgtaagtactgaaatttgcactaagttttgaaagctacaatgtattttgtaaatttagtgtaaatgcatattatttattgtttaaagaatgatttttttctttgaaaaatgtggtgccataaatggcaatatagctagagtaacagatcaagtctatctcattatttcatattataattaattgtctcttacaatattggcgaggcaaaccatttcaaaggtattttttatttgcagattataaaacatagtattttaggataagacttttgtattttataatttcaataaaacttttatattcttacaatccaaaagtcaataccaagaaatcaaaaacaaagtaaaaactatattaattcaaaattcatctctaaaatacataaccgaagctgccactaaagttttctcctttttatacaccacgcgtgtttggttcttgatttcactatcccaccaccattatttaatggaatctttacaactccaactttgtttaaaaaaagcctaccgtccaccccagctgacgaagacgagatgaagaagaagagaagaagcacgttttgtttcttttatttgtgaaatttgcgcgtgtgttgaaattgtgtgtttcctaaaaggggaagagtacaagtccaaatcactcacacgcatataatttatttaatattttaaaaagtactcctactctgtgatcatcggtaccaacatggcgtggaattttaatgaccgcagatacgtatatagagtagggttgtgtttagatccaaagtttagatccaaatttcagttctttttcatcacatcaacctatcatacacacacaacttttcagtcatatcatcttcaattttaaccaaaatctggatccaactaaacacaacctagctagctttagctttttcgtccgtccattcgtccagcagatgtgcttaattaattaagtttagctgcctgcagcgtgtgaaagtgaaatttagcaaagcaattaactgtggccacagtatgggtggcagactggcagtgaacgagtactacaggtctctacacgagcgttcttgtatgcatccgtacgttttgttaacattaatagagtaccacaattaataatcaattttgatgtattatattttatatagtggaaattttatatcttctacatatatgtgagaccttaattaatttgttggctttgggttttatttttaagaaacatagtataaacgcagacgctcataacgtacacacactcatctaaacacatacgcacaccctatctctatgagtatatccggaaaactggaccggcatatatttagcacgctatggtattttttagctctgaatggcttcttgaaaaactttttcatcttcagcactgcttagataaactttttctaatttatttgttagcttgacaatgtataatatttaactaaaaaaataaatggatggggtaatcggataatccggcccaattcatctgtttcgaacgagatgcactggcaataattcgtttgtaaataaaaagttaacgagacaaaaagatgatattttgtatcctctatggtactccgccctatcagaagcatgttttatatcgtccatatgttacttttttttctttagaacttgcatattttactgttgtgtgcagatttcattctctttattagtagcgtgtcatctcaagctggttctcagctttattacacttttacagtgtactatgtaaggcttcattccttcttggaaaaagtgcacccaaggtccctcaacttgtcatcgaattacaaaatcatcccccaaccataaaaccggatatctggcgtcccctaactaaccaaaactggtcataataggtccctcagtggttttaaccccgtttttgtcctatgtggcggctgactcagcgtgggactcacgtggaccccacgtgtcaggctgccacatcagcacatactctatttccccctcttctctctctgtctctgtgttctctccttccttcctccccctcgctctctgctctcgcacgagcggcaacgcgcgcggccggcgacggtggctcccaagtggcggcgcgtgggctcgccggcctccccgtccccctagtgcggttggtgatggcggcgtgcggctgcgtccatcatgtggagatcgactcgacgacgccgccatcaagtcgctgccgtcgggcgtcggcgatggcggcgcatggctgcggccagcgggggaggcggaggaggtataagcggacgccctcgccctcattgtcgatgtcgacaccaatgaagaggtccgcgccgctcaccagttcgcatgcctcgtcgtcgtcg

SEQ ID NO: 4345 - DNA, 16103 bp, Oryza sativa
atgtggggcccacgtgggtcccacgctgagtcagccgccacataggataaaaccagggttaaaaccgccgagggacctattatgaccggtttggttagttgggggacgccagatatccggttttgtggttgagggacgattttgtaattcgatgacaagttgagggaccttgggtgcactttttccttctttctatggatgggcagtttgtagggcttttctagctttcggcccataaccggccgaaactatagacccaaactgttattcacactgggccaagaaagtttgctttagtgggccacttgtattaaaattcctttggttgggctcaatgtactcggaaaaatagaaagggtgatatatggctcactagttgctaccttttaatgatgatgacaataataatataaggtctaaactaagtgtgtaatcgactattattgtgcgtttcagtatctacaatgggagcagagttgccaccaggaaaaaatatatcatattttacacttagttctatcatatttagactccattcggtactatttgctgaaaattttcctcgtttaccgtagagttttccaaaatgctaatcaatgtgttcaacttatacaaaatgagtctagcctttatatttttctggttgtattcaagatagaaatgcttaattaagttaagcaaggagtataatttaaattagttcaaatgggggcccatatgtgtggatgggccaaaactgaagcccatccaaacaaggtccaagagcatgaataatagtttagactgtatttctatataattcttatttttctatttaagtagtagatttattatatagtagtttgtctatctagttgatttatttatttgaccaatgatttgattctacatgcattaatcctacaaagttatgaaatttttatggtgggaattgcttgtttcctccccctcccccaaaagtagtaacaatttgaacctttatgttcataagagtgttttagatatttttgaaaaagaatgcccaactcgtattatagaacgattgataaattaagtcgttggtatattacagaaaaagataatattgataacaaatcgttgaactcgaacaaactcagtgatataaaatatattatctcacaagtataaccaaaaccgccctgtcacctcttcaacgcttagtcaaaagactcaaaacaagagagaaacaattaatcgaatgagccatcttataatacgaattccatgcaaaaaatccaaagaagaatggtgccacgtggcatcaccggcttcgcggaagtggctagacggaatgctcttgcgcatgcgcgtgcagcagtccagaaacgctcttgcgtgtgtgcaccaatcctcctgtagccgtacgattagaaatcaatgatgctggtgcaacggaccaatgtgtaaaattttatattcaaaaggagttttaaggaaaaaaaatgtcagatccagaaagtttgttgcccctcctaaaatgaatcaagatctgccgttcctcatatgcgtgggaaaaaaaatcctaacaaagtaaataaaaaaaatgaacaacatacatctccatatacatcgacttcccaagtatctgttcccttggaaactaaaaaaatttccattgctccatcctttcttatcaaatattattattctcaagccggcagttttacaggattgtgattggtccacatggcactataaaaactgagataaatcaagcaattactaatagaatgaaatagaagtctagaactttctcaaatctgaactagaatgaaatagaagtctgctctcttattcttcattggttgtttcaatacccaactagctcagtgatctgattatgcactaaatatatctttatgtattttccatcttactcctttacagggtcactaatagaaaaataaatatatgagaaaaagtagcattagaaaaaaggaaatattgtgttttgttttcaaaatacaacatacttcactacaatattataagatactgattacattgaaagctaaaacacagtaagaggttctttgaagctcctgtagcaaattcaaaaaaaaattcaacttatttcactaaaatatatgtatgtgccattgactaatggtcatataagataaacacatgatggtcatatagtaagcgcgtcaacaggcgcgctgattttctagtgatatctgttttataacatatagtactagtattagatttgttgcatcaatacatagaaattatacccttttttttttaaaaaaatatacatatggatagaaaaccaaggagccatttctaaaaaaaaaacagcaaaaaaaagatttaagcaccatatatagatagacctccacactctgctacatttactagtcacaaatcccaacatattttttttaaattacatggcagacacagacgcacatacaccactacagacgcaaaaccacacctacacccccatgaatgcgtcatctaacacatactttaatagatggaaaccaacggcacatccctaacacatactctaagagatggaaatcaacggcacatccctgatctcactaaaatcctgttgaaagcccacctacatatgtgtaatattcatggcactaggatttaaatcctggtagatagagtcatgcacccacaccgtaaaattttggcattaaagaaaacatcaggtgacttttatttcccttaaaattgtaacattacaatagggtagttaattgaaccaacggaaaatatttattggtgaagaaaggggctactcatcgaagaaaaaaccaaatcaaatgaccatacaaaagaaattaaattgcaaatcaacatataaagtcactttttatataattttgatagatgatggtgtgctctattagctttggcattattaggtattggtatatatattggtatgcagataattgaaccaaccgaaaagatttgtcgatacaaaattgttactagaataaataatgaaaaaaatccaaatggcaatacaaacgaaatttaattacaagtcaatatagaaatcgaaatagaatgatagtcttgcaatttacacagacggttgtgtgttctatgagctgatccatgcctttgcatgttctcaaatttctatcatggcctaaacaatttgacaaaaacaatggatttataattatctactagggtttaaatatttaattttctcagttacacaaacgggttaactagaaggcgtgctacatggcacacgccaattttctagtatagtactatattgcagctagcagcgcctagtagttgctcacgagcctctgtcttggtttgcacctgcaaatggaccgacgacgacgaccacggacgcctcttctgaccgcactgttgctcgtctcgctggctgcggcggcggcggcgagcggcgcgccctgctccggtctatcaagccgctcttcgtcggcggcgagttcggctacggcgatgcctggaacgagagcaccgactgctgcggctgggaaggcgtggtctgcggcggcggcggcggcggccaccacgtggtgtcgctgtctctggtccaggccggcatcgccggcgccgtcgacggcgcggcgttcgcggcgttcacggcgctgcaggagctggacctgtcgtggaatcgaatctctgccttctctcttccatctgcaggaggtatgtacgcatgcatccatcttcgtcagaatcgaaccaagcataacttaatttgaagttccaaaatggacaatttgatttagaattgcaaagtttttcagatttgattttatcttctgcgaggatgatgatggaattgattttattttaatctcaaccagcatgattgtgtgcatgcctatatggattctgcgggcttaatcttattttaatcatattaattacagtttttttatcagcgaaacactaaactgtacattatgaaaataatagttactattaaaatatttaaaagatatataggacagtatgttgaatattttgtctcgtgcatatataaaacaacaaatctaattttaatggttaaaatataattattattatcgtcaaacttcatgtgagattttatggatacgaattcaatgatataattggattattaaataagtgattgtgatgatcattagaggccgagagaaagaaaaaggagagaagagctgttgagctagtgggcttgggctgctttggttcgccgagctttgctagcgttaagtgcttgctggcagcaagcagcaggcctttggacattgtgcccacgttagggttgtatgataccattctttaactaaaacttgccatgttgtaggtagcaaaaaaattatgaaatttgatcaaaatttagttaaattagttcatgaaaagttggtaaaacgtagaaattttttgaaagaacccatttcaccctggttggtccgttgtcacaacccatggggaatgcccttcgaattgaaagaacacacatgttgctcttcatatttaattgattcaattcgatctaatcatacaaattacagaaacactggaaagcctttcaccaagagagcagctaagcatgtatatccgtatctattgtcactcaaacagttcaaggttattttagtgtgtacggctaggacttatcttaaaagtagtagaatttaatttgtagctcaatgattttgcattttagtttggataaatttgaaccaagtaacactggtcgaaggatcagatattcaaaggaaataagttatagaagggtaaaagactactatttcagatattcaaggctccaggccattggtgccggcgtaacatggtctgtgttggtctcagcctcgccgtggtcggccgccacaatatactgtatggccattgtttccgctactttgtttgcaccaccaactgaccaacataaatgcccaagacaactagacagcgagagttgccagaccaagtaggtcatttggtcttccgtttgcctaggaacaagggcatctatttaagccacaaatgaataatacatcctatattttctctgaaatatttgggtatgccggtgcatacccggcaccacccctaggtccacccctgatggtcccatctcgcgagcagcattagcagtagcgtggccgaatttaaaattttctatgtaaagtgaggacataaacgtaaacggttatatcagaggtgtggttcaaccaattggtttggatataattatttttggtggatgcactaaattacaagaaaaaaaaattgatacccacatgttattaatcttttacttatcgttgtatgtctacgtgctcccacatagtattggcccaatgtctgtttttttcctcgagttgggtacacaaggaaaagcattttccttgttaaaaaagagctaattgcaggttgggcaatgtatttttctagcaaagattcaatttgatcatcttttgtccaatatttttgcttaaaaccatatatatctttggataggggtgggcatttagtcagaccgaacaatttggtctcggccttcagtctttagtgaaatttcggtcatcagattcttgagacagattaatcctgaacaaaatcgaagatcgactactttggtcagtctggttcagccttggtcacaactgaactaagcgctttgtgttcacagccaaaataaaaatcactggtgaagaaacaattacaccatcgaactgactgcaaaatatgtaattacagacaaaaagatcacagaaaacaattacacatatacatgctgtattgctgtatagggctattgggctgcacagtgaaattcggccattttcagttaaccgagccatataaccagactaaatttggttagtacactttgatgactgaatttctcagtctcgttttttttccctcaatctgttcggctcggtctattttgtctacctctatatctttggcttggaggaaactatcggggtctagtggctagcagcatggttggtgagttagtcatcccaggttcggttcctcccttctacaaaatatttgggggatgtctctccctccaaatattgtttttttatatctttggctaggctatctcacactttttgctactgtctctccaatctcttctccacctccaattcctgacctccaccatggccatcgtcagctcaacccttgacctcaagctcatgatctagctctgtccacctagagctccaacgattactttctctagatgacaatagagagctgaagctcggtagcaggcctctctaatgcactcagatcctagcaactggcagggttggcaacggggtggatcagggctgggttggacaagattagccttagccttgactttctcccccaacctctggcctaaaggagaaaacagtgccaaataaagccccgcccctggtcttgctagggacctaacctcccatcaaggcctcattagttgctggcaggcaacaaagacacataaaggtggtgtggaggtgaggttggtgggcatgtggtgggtggtggtgggaggcatgtagtcaagggagccgagggaggcggcggagcagcagctgcacgtttcgtgcgatgaaaatgagggtggcgtcactcgggactgggagagggagttgttgtgcatggacatacacatcgatccttgagctagtaaggtatgtggggattagtttagatccattttatactccaagtatttgggccagcctgatattgtgggtttttctcttgtaacttgaggagatatcctcctccattgagattagtttcttggccctaggccctcatgatgtcggggcgccatgctgatggattcgcaggtgcagattttgctctcgtcccttagatgcgggtctctacacccattagggaaactgtcacccatagcagccagatttgagaaagacgaactcagcccttggttgtgcttatctgagagtccaccctctgctaagcttgatctatgcttgcatcacccaaaactagaagattgaacttgtgcaccctaccccaatgatagagctccatttcctacaaccgtgccatgctgcccaagctcgaggtccatcttggcctatgtcctcatggcccgtggattttacctctacatctgagtgccgatttgagtagtgggaacttaaggatatagtatatcgattcatgtctaactctacatttttttaaaaaaagaaagagttttgcttgccagtatgttttaacaatatgcacaataaaatagaataactcagattgttatgtaccaatttaggtgagcgtgcatttcagaagcttagcaagctctcgctttcgcacaacagtctaacaaatgaaggcgttgctgctctagttatcaaccgaactacactttcagagctgtaccttggcggaaaccagttacttacaacaagttggatatccaatttgacgtctcttagggtggttgatttatcccagaacttcttacacggatacaacggtatatctccgctctttttgttagtatccagggcaatttatccaatatttgtgttttagttttgcaggtatatgtaacctccatcaactagagtacctacaccttggtgtcaacatgctacatggaaccataaattcatgcttgggaaaactacaacaattgaagtacctgaacatgaaaaacaagggggaaaaaaaactttctcatgggggagattgcaccgaacttacttatcaacttgaccaaactggagactatacacctgggggtgaacaatcttaccggcacattcatgctctcctggctagcaaacagctcaaacctcgttgatgttgtcctctcacacaactacaatctgaaaatcgaaaccgagcttgtgagatggacaccgttgttccagctggtatacttgaatttaagcaactgtgttatcaataggcgaagcaatggagttgtgccgacttttctgtcaacccagcttagcctatccgggatcgatctctcgcattgttcgctccaaggcaggattccaccctggctgttctacaatctatctgattttgtcttgctcaatggcaatagaatggatgtcattgatatggatgggcttggtggtaacatacctcaccggtgcaggtgcttgatttgtcagagaacaaaatatcgatgtcgatcccgaccaactttggaagcatttttcagtttttggactactgtgacatgtcctccaacaggttgtacggtgggattccatcattggcagaggcaacatcattggaggtgcttgacttgtcatctaacaacctcaatgaggaaatattgccaacattaatagggaatttgtcaattctaacatctcttctactctccaataatgacctgacagggcctatgccacctttccattggaatttgggtagtttgaagcacctcagccttgagaacaaccgattctcgggatggctatctccattgctgtcgaacagcagtaatctcaagacactcaatgtgagaaacaaccatctatcaggaatcatcccggatggcctcctgagcttccaacagcttggtgtgatcctccttggagggaatgattttcatggtccaataccattggacctttgcttcaacaactatctccactttgttgatctctccaacaatcaattctctggggagataccaaattgcttctacaatgatttctggacagatttgccaatgtacttcaacgatgacccattctcaggcaatatcacagagcgcatgtctgtcgacttcacgacgaaaggcgagaaccttacctacatgggagagcctctagtgctcatgacgggcattgatctgtccatgaatcaattgtcaggcgccatccctccgccattaggtttcctgaggcagctcaagtctctaaacttatcacataaccaacttgttggcccgataccagagacattcatgtatatgcaggatatggagagccttgacctctcatacaaccacctcaatggcagcctgcctatgcagctggcaaatctctccttcctgtgctcgttcaatgtcgcctacaacaacctctctggtgagatacccttccaacaacagcttgggacattcgatgaatcggcattcgaggggaatgacaatctctgtggtgaaatcatcaacaaaaactgctcatcagtgctgcatcagaatcaaggagtgttcgacgccattgacacgtcacttgttttctggtcctacgtttttgggtgttttgcacttggattttggggcaccgtggcattgctgatatgggatgaagtgtgcaggaggagactgtgtgacttgatggatgctctaatgtttaagctgggttgggaatttgtgccttgaatcctgatatgtctagctaagagtctaggagacatggaaagacagagcaatcccttctttttttttgcacgagatgcacatgctgtcacatcctgattttcgtttcaggatttataaattatttaataaattaataatagaatttatattaaatgttctttaatttacaagtgaagttaaatgtgggaaataaaatttcttaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagcaatgattttaaaagcctaaaagagaagatctaattttaatttgttaaatctcaatataaaattgggctagataaaattttgttaaatacttttcttaattctataattcctagatttttttgggatttatttgagctaaggaagtatttttaataaatggaattgcatttaagaaataatttaaattgaaaaaggtttttaaaagtcttcttttggctttgggccgaaagtcggcccaaaacccttttctctccctcctcggcccagccggcctagtccgcagccgcgcgcgcgcgttcggtcactgacaggtggggcccgcttgtcggatccatcgtcttcgtcaagccgccgccgcccgaaaccctagccgagccgcgccgccgccgctttccaatttcggccgcgtctttcccgatccagtgaaatcttttgaggggaaacgatcttctcgatctcctcttccttttctcttatggaatcatcgcctaattcggtttggaaactcgtggattcgaggtcgaatcggatcggtttctttcctccgaaccctaacctttccttcccatctccggtcgccgtgggcctccgtcgcagctcgctagcccctttaaaaggatccccggtgtctcctctacccgccgccaccctcgccttcgtctctcgccgtcggaagcgccctagcgccgtctaacctcgagccgccgtcgtcgccgtcgctccagccgtgcgccgccgccgttccggtcgtcgtcgtcgctcggggaggtcgccatcgtggtcgccaagtcgccgccgtcctcgtccgcctcttcgtcgccgccgtagaccgccggagcaccgccgtcaccgtcgacccgaaaaccgccgccgtttcttcctcgtcgccggcgccatccgttgctcctccgctgttgctttggtcaccggtgagttcgccgcgtcgcgctctacccgttggtgccctccgtttgcgtcctcgcgccgtcgttcgccggcgagcttgcgctcccgagccgccgccggtgctgacgtcatcgctgacgtcgttgctgacgtcatcgttgccgttccccgtggcccggtcgtggaccaatcgatctcgaccgtccgttttggatagggttgatctcggccgttcgtttccgtgaaccgctgccgtgcacccggttcaccgcaaaccttagccgctgacgcaataatcctcttttccttttcaaaaataattcattattgcgtcataattcaattaaaatccatataagtgttttaatccgatttaatctttgaaaattcataactaattcatttgaactcagtttaatgtggttcaagttgcaaaaattatataaaataaagatctacatattaaaattgtccataaattgaattaaatttatttaattctttttaaatgggctttaattagatttaatcttgtaaaattcatattaaattcatattaagtcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaagggtcgcgagtgcgccggaagtattcaagaagattaattgaagaccgattattgcaaggcaagtcacacagatcctaaacacaatcctttgagcatgttgatcctatatttaaattctctatttatttcaactgtgcatttatttttgaatgtcaccgggtggtgtgaacctattcctttgttatggcctgtttgcattgattactctattccttgataccttgggatattataacttgactagttgacctttatatattggttcagctagatattagatatgattgcttagccatgcttagaaacattagcacattattgggataacttatgactcattattatttaatgatggtttaaagatagttcacgatggtcaatcgtgattggtcaattaattacttgcaaactaaaacttgataatggtgggttgtgagcacatggttttgagagtcgtgctcatggcaattaaggaccggttcgcgagctactgttgtgaaacattaaccgtgccaaccacaagccagcgtgggaaacggctttaccttttgtataacatgattcattgcggagcaccagactgagaagtggcggagataagcccacgggggtcgctggggagtccatgcctctggtttttgaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtcccacacctcccataataattatggatgttatacctggtaataatttgcttagctcctggtttggagttagatctgttcagccgggtatggtgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttgttgaggactaagtgcctcataagtaagtatttatcgttttagttaatttgatgaatctgtatattaaattgtcagtttgtgtacctcggctgattcttggacgaggattttatacacaaataagttcggaaattacttgtgaatttccgggcgtgacacatgccttgcataatgcattgacagacaaggagaaaaccagagttcatagtgagaaaggcccaaaacttattggaattgtaagtgaaatacttgtctaaggacaagaatttcctttctcctatgaaatacaagacccaaagttctaaggtgcagctctattttgggggtcaatagaggctattatcacccttgtaaatttgagattttgaggtgcagagctactttgggttaatagaggctattatcacccctgtaaatttgagattttgaggtatagttctacatgtaactatgtaattattaacttatagttgtgctagaataatctgcactagtttggccaactcttcctgttttgaccttcaagttcaaagcttaattttgcgatgtgcttaggggtggatatcaatcgagctagctggcttggctcgttatcttaacgagctagaagcatggcgcactcggcttggcttgtttgtcagctcgagctggctcattaagctcgtgaagcaacacttaaaatcaatatcatctcaagtttacaaattagtaacatataaattagcaaatgcattattaattccatactttatataatcaaccaaagcatagcaagatcagtcaaaatgttgatacctatgattgagtggagctgcacaagaagatgagtggatggaggggatgagttgtgttgaaacttaaagaatgccacataccatgggtgaggataataagcactgggttggagttttagggttcgagatgggcttgggttgctagcccgctgcttgctggtttgtttggcttgcgagtagcatacgagccagttcgagctagctcattatatctaataagctaaaagcttatctcaactcgttaacaaattgaaataagttgagctgagccaatcacaagctgagaaagatagatatgcttgtagcaactgctcttaattaccaatttttaagtttcaaggtgtagttttatgatattaattgatgctttgccgctataagtagcccccttttcaatttctattcatgctcaggctgcctgagattcttttgatcttggctagaaattgggcagggaccacacttaatttgtttgaaatttctgaaattaggtagtcttcccttgatattttatcagtttcatgtgtattcattctgttcaagagtgtcactctgttcaaagttatatcttgtgtggaaaaattctgtaccatcatcaattctgatgaactgatcgatggcctcaccttgtctagttagtcctggtttcatgagcagattaatctgtgtacacggtgcctaggaaattacaagtccaaaatacttttatacttgtatgtagagttctaatatgtacactacataggaatactatcagaagggcttaagtaacaatttaaagaaacatggacttataatataatactagtacagaaacgtctaaattacatgttcatctcaaaagtggtctattaattaaccccccccccccccccccccaaaaatcgggttcttcttagagggacaaaactagtggggtggtataaaggctactcactgcagaaaggactcaacagagaacattttgctagaatctatggcaatctcagagaggatttgctgcagtgagtgcctatgtgagtgggaactaaagcagttacatctttgcaagctggtagtacaatcatgaacagtgacagcagagaaccactaattcaccttctattttctatattgatttttggttttgccttcctgcacttgggtttgttatgcttttattggaatccagagttgatggctccttacatatttatcttcactaatctaaataacttagcatgttaattcactacaatgaagaatcctgatcatacatctagatggatgaagggcgcccttaactaatcctttatctagggctgcagttgccctaaaattaatgctgcaacccaattagcatcataaaagagatcatcatatattccctatatgtcgtcaagatcagggtttacaattctgacgaaaaccggtcgaattccgcgaaatttcgagaatgtatatatatatatatatatatgtatgtatgtatgtatgtatgtatgtatgttttgatgattctaattgcatgctcactcttgttggattggttacattgatatattctagggttgtcagatgtggtctgtcacgtcctgataaatccatcccgaattaaaaatcattcgctaaaaggaataatagaattaattaaaatgcgaaaagaaattggcaaacgctaaaaatacgtacaagaaaaattcaaatgtggcccggagaatttttgttaaattctccttggtctaaaaaggagccctcaaattttacttgaattttcagagcaccggaaatatttattaaacaacaacaacaattaacaaagtttattaaaaagaaaaacctaaaaataatcctcttcctcctttgggccaagcccagcccaaagtctccctttcctccctctctttctctccctctccttctctccctcctcctcttgggcctctccccctctcggcccagctccctcctccctctctcccgggctgcctttttcccccccctcttccctcccggcctgctcggcccaggccgccttcccctcctctcttcctgggccggccgcccggcccaagccgccctgccctagccgcgccccgcccgtgcagcgcgcgtgcgcgcgctgacgccgccgcctgaccggtgggtcccacgcgccaggccgggcgtcgtccccttcctcccgaccggccgtcctctctccctctcccgtgaaccctagcgccaatcctccctcaaatccgcttgattcactcggttaattccaaaattgattagggggttttaatccccattgaatcctcttcaattcccccgttttccccccttgaatgccgcccccaatcgtcgggaacggccgcgccaagtccggccgccttcctttgccgccggccaccattcccgtcgccgttcccgcgcctcccgtggccggctccctcccccatcctataaaatgggatcctcatcccccgttctctcgttttagccccatcccgagcctccccgtggtccctagctccctccccaccgtcgccctttctctctccggtgccggccggcctccagccgcctttcccgcctcgccggagcgtcgtccggccgcgccgtcaccttctcca

SEQ ID NO: 4346 - DNA, 22742 bp, Oryza sativa
  unsure (1)..(22742): unsure at all n locations
cactcctcggtttcgccggaacgccatcgccgcgaacctctacatccgcctcgccggagttgttcggccgcctgtccctcctcgccgtgcaccggtcgaccacacctccaccacctccggcatcgcagcggcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcgtcatcctctcgtcgttcccggtcgtcgtggcgttcgtccctccgtcaagccgttctcgttcgtcgtcctcgcttcgtcaagatcgctgcagccccgtcctcgtgttcgtcctcggttccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgctgccccgttctcgtcctttcggtgtcgcccgtgcccgttgtgcggttgacgaccccggtacccgtgtaccggtgtcggtagtcgttcacgcgcgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccgtggaccgtctctgtgtactcggtctaccgtggtcctttaggttgacatgtggggtccgcatgtcaacagcgcagccttcctgtctcttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatctttgaacatattgaatcccagtttgtaaaattatgttgatttaaattattgcattaccgctttatttaaattcccgcgttatcactgttttatttagccatgcctatttacctttgttatgaccttaatattgttattgctattatttccttgttcaccctagaataaataaaaccccaactagtgggtactctattcctggttccactagtatgaatttaggtagatgcttcgctgattaataggacaacattaggtggttttataactttagactttgggtattctcatatcatttggacaccatggaatggttggcttatgttggaattggacacacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccggataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgataaactctgaattgtatcaacttttggtgtaccttgcctcctgggacaaggaataatacacgcacgtcaggaacgcctgttgggtgatttccggtcgtgacatggtcagcgtgaaagagaaccaaatccaccaaatgcataccagtcgaagctgggattttcttggaatggactacaggcaaccaaatggcctgcttgctaaagctaaatatggggatggcactataattggtgtcattgacacaggtaattatttgggaaggcaattaattagtagtaccttatttgaaaaggcaattgataattatttcctgcatggttatatagccgttccaatttcattgttttgttgattatatataccacgcgaattgaaaaaatatagagtgtttgtttggttatccgcaccactctaaccaatgtaggagtcaatcgaccatttcggcggcctgggtaggtacaaatggggttatttcattggttagattggttggtcctagatatggtgagatatcgtttggatgagtgtatgagaagcttctgtacatataagaggttttgtttgattggcttataagtattgagttcagccatacaatatactgctagtatatactgcaagtatatatgatctaacggtgtagattgatttaattttttatttaattagattgcagtataaactttgaaagggtaattttatcttttcttcgttattctatcatcaaatcgtgctatcgtcatgtgccttgtcatcaaatggcgctcaggatgctcctcccctaatgcacgataagatccaggaacgggtactctcaattagattcaatttgaaccaaaaattactaaagtgttgttttaattttctatcaaattcctaatatatatgcccttttatatactgccagtatatactggttattgtaccgtaaaaattctctatttttaagggtggcaacaataattgtaacgtcccgccttcccccaggctgggctcgcttacatctgatagctttcataggtcaattagattcaatttgaaccaaaaattactaaagtgttgttttaattttctatcaaattcctaatatatatgcccttttatatactgccagtatatactggttattgtaccgtaaaaattctctatttttaatggttattgtaccgtaaaaattctctatttttaagggtggcaacaataattgtaacgtcccgccttccgggcaggcctatttttaagggtggcaacaataattgtaacgtcccgccttcccccaggccgggctcgcttacatctgatagctttcataggtcatagactgccctcacagaccaacacatgtcttttctacacactttgtcctcactcgtatgcacccgggaagaattttccggtcggtcacccatcccaaattgctcacatgtcttttctacacactttgtcctcactcgtatgcacccgggaagaattttccggtcggtcacccatcccaaattgctccaggccaagcacgcttaaccctgaagttctttggagattggcttccggaaaagaagttgcaatttgttgatatgagtattctattaatcctattaagccctaggccaggatgttacaataatcttagttcaagataatttagggtgaggaggcagatttataactcatggagataataataaaatataagtctcagattcagcctattaactttttaataaaatttatccaatgcttaacaagttgcttggtgaattagtgaaacaaaccggttggatggtagagttgtctgttcatgactaggatttttagtacacacgtatttatgcaaacacaaatatttcttggtaaaaaataaatttaatttatccccaactgctgctagtttatactccgtccattgcacattataatacgtttggccactccattctagattcactaacatctatataaatttggatacatatataaagcagttatatgaatctattaaaaaaacccaaaacatcttataatatgaaacatagaatgtatttgcaagtctatgtcgctaggacacatctgccgtccataggatttctacagaagagagagtcgtgctaaagtatatataattaaattctacgcactccactactacaaaaatcgtttttctgtacgagggggtcggtaggttccatgcgggccgcttgtggcggcgcctgcaaaaaccgccccccccggggcgggttgattagccgcatgcgatgatccgccatatatgctcctccaggcccgagcttgaccatttgaaaacgaagctttctctctctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacacaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacatcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagttttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgcaggctgccaaaatttcccaagtcgccatcgccgtcgtccccgccaccgccggctcctccccaaagtcgccccgccccacgccgccgccgacgccgccgtcaggacctctcccccctcgccgttgccgtcgccgccgccaggacctctcccccctcgccgtcgccgtcgctgccgccaggacctctcccccctcgccgtcgccgtcgccgccggcaggtcgccgtcgccactgcacggaactctcccccctcgccgttgccatccccgcccgccaggtcgttcccgccgccaagtcgtccccgctaccgccggctccttcccgaagtcgccccgcccctcgccgtcgccgacgccactgccaggacctctcccccctcgccgtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtataattttgagaatgtttaattgtggattgttaaatggagatttatgtttaaattgggacttatgtttaaattgggacttatgttaaattgggatttatgtataattgggactttgttaaattgagatttatgtataatttggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaaatgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaaatatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggttagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccggctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaactaaaccaaatctcatttcttctttattcattgtacagtatgcaattccacgaagctgatagaactggagcaaaggttggatacgtcgatccaacaagaatatgcaaaacacaacacaccatagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacaattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacggccgcatgcgcaaatggtgatctttgcagaccatttcgcgcatgcgggccggccaaccgcatgtgaagatcgattccgcccgtatgaaaaacgctttctgtagtagtgctctatcatcaccttaattaattgtacttttgaatgaaatagtcggtacatgcaacttgataactgtgatttatcaaataatatttagaattttaattaatttgctattttcttataggtgtcacgcctgagtcagcaagctttgccgatactggatatgaccccccgccaaaaaaatggaaagggatttgccaggttggcccatcgtttgaggccataagttgcaaccggaagtttatcggtgcacggtggtacatcgatgacgagattctaagtagcatatccgataacgaggttctttctcctagggatgtcgaaggccacggcacgcacacagcctcaacggctggcggcaacatcatccacaatgttagctttctggggctagctgcagggacagttcggggtggagcgccccgtgcacgattagccatatacaaggcctgttggtccggttatggctgctccggtgccaccgtgttgaaagccatggacgacgctgtctatgatggtgttgatgtcttatcactttctataggtggtacaaaagaagatgtgggaaccctacatgtcgtcgctaatggtatctcggttgtctacgctggtggaaacgatggtcccattgctcagacggtggagaaccaatcaccatggctagtaacggtcgctgcaaccaccattgatcggtccttgcctgtggttatcaccttgggaaacggcgaaaagttggtggtatgtttgtattaattagataaataatatatatgtgtccgacgatataatgccagctgtttgcaatttgtttatcgatcatgcattaatttgattatctccatctcatctctgacgacacttcgcaggcgcaatcctttgtcctcctggaaactgcaagtcagttcagtgagatacagaagtacacagacgaggagtaagtgtagtagctaggaaatcaatactaattaccatatgattcaatacatatacatttttttcaattaagataatagaaaaattctggcctttacctagaagtaagctcaagtcaaattgttatttcgtacccctccgttttataatttcatattataagttgtttctaatcaaagttttataagtttataaccaaatttacaaaaattgatatagtaatattttaaatataaaacaaacatattattaaaatatattcaatgttaaatttaatgaaactaatttagagttgtagatgttgctaatttttttataaatttggtcaaacttaaagatgtttgaataagaaaaaaaagttaaacgacttataatacgaaatggaggtagcgagtagcacatatatatgtcataatttggatggcaagatattgctaagagcaaatcctattgcgaaatcttcatccataattgacaaagagctatgtaaccatcatctctatataaagacatgcgtacttcatcttatcgtttgtccttctcaagtagtaaactttagtggaatcagccatatacaaaataatactacctccgttttataaatagatgatgccgttgactttttctcacatgtttgaccattcgtcttatttaaaaaatttacgtaattataatttattttgttatgagttgttttatcactcatagtactttaagtgtgatttatatcttatacatttgcataaaatttttgaataagacgaatggcctaacatgtgagaaaaagttaacggcgttatctatttaaaaaacagagatagtatatcatatataaaaacatcatgtactagctaggtagtgtataaaatgatttgctgctgctgctgctgctgcagatgcaatgccaacaatattatgaacagcacggtgaaggggaaaatagccttctgcttcatgggagagatgttgaataataagcagcagacatcataccctgatgtcaccacggcagtggcagccaaaggaggcagagcagtcatcttgccgctgttctacaccgaaacaattctccaagatgatcccatcatcactgatttggatattccgtttttttatatctttttttttgcaattttatggaacttaaatggtattcatacacacaattatcaaggagttaaggattggtattgtcattttacagttttattttctttaaggtgggaattcctagatttttctaattagtgtataatttctctcttctaccttctagaaataaataaggtggtaacttaattttagaaggatctgcaactagtacaaataaataaagaaaggcaatttcctaatagatggagtactctatttcagatgcattaatttttttcttttgcaagaaaatttaattaacaatttcttcaatcaacaagaatgttttcacctgttttctcatcagacaatgttctgttaacataacacggcattctcccaaatttgcagccggacattgctgcaccaggggtttcgattttagccgctgctcagattccatattacaaaggtgtttcctaccatttcgattctggaacatctatggcttgcccccatgtagctgggatcattgcggtgctcaagtccattcatccaaaatggtcacctgcggctctcaaatccgcaatcatgacaacaggtaattaattatctcttttttttttataacaaaaggctttgtttggaacgtagagatttgcgattatatatatttcgttcaacaatcggctcacttgattgaccttattggatttaaagaactagccaacaacttgtgattctagtttttgtgctaatacttcattcaaatggaccatatcggccataactttctttttgcggggaaggggactttgattaatcaatacaggccagtaaattcagacttaatgtgctctatttcaaatggactttctgttggaattaatgaataggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaagcatgtgtggtggagagaagagggaaaacacacgcgctcgcctcgcctcgcctggcctggcagggcaggtggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgtaggatatgcgaaaatcaatctaaggtttgcctcctactctgtactgcgccgtcgctcgtagactactccatcccgctcgctggcgtgcaccagcgatcgggagagcaggtctccggaacctctgcctttgacgtcctgcaccgggagaaggcggcaataaggtttttgggaagcgcttcgcgcgactgctccttgttcgttcgcgacggctcgccttcctcttcgctcgcgtgtttcgtgccttcgtagacacctgcgaaaagtttcgaccacgcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctgattttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctatttgtgggatgcattcttagcgttcttggcgatcgtctggtcgaggtgtatatgcatatgaccgatgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaagtaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagcgccaatgttgtgcacaaggcccagaacaagagtaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttatgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaaagaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaactgcacactgactgacttggtgaatgccatgttggacaccgcgggactgcctaaggcatggtggggggaggtattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatccgaggtactggacatgcatgttggtataattatggagtctcgtgatgctaccttctttgagagctttttcccaatgaaggatacacatagtggttcgaaccaaccctctgaaataattcccagttcaatcataccaccagaacaaactgaacatacacatgaacttgtctctgaggaggatgtcagtgaagctcctcgaaggagtaagagacaaaggacggctaagtcttttggtgatgattttactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacgagctcctaagcaatggcatgagaaatttgctanacattgacctctccaggctttggagtcaattatgcgtatccatgtgtgtattatcgccatggtgggggtcagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggaaaagatcttgaatcgctttggctacattgatagtaagccttttccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctggaaagaacaaaccattaataaactataggagagtaccaatatatataccctctccaagtgaagatgcatatactctcgtgagctgcaaggcaggttggctatgccttaatgagttatgttggctttaattagaaaagatgttatcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttacaattcaaggcgtagtccattgttcaagttgtgagtaagtgtagcttggagttctaggtggatgttcaaccttaattggtctccatcgaa

SEQ ID NO: 4347 - DNA, 8243 bp, Oryza sativa
cgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttgcctcctactctgtactgcgccgtcgctcgtagactactccatgccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgatggctcgcctttctcttcgctcgcgtgtttcgtgccttcgtagacacctgcgaaaagtttcgaccaagcagcaggtcttttcgtcacctcggtacgtgttcaatatgttgcgcatatttgatctgttcatattattctgcgtagtttacatgtgtagatctaatgatgcgttcatgctagttttcatctgtaatatcatgatttatttatagaataaattaaatcattatatgcccataatctcaacactttcatcaccaagccagaaccctgatgcttgccccgaagcaaccagcatgcagatgccaacttaattatggctcactatgttttgttttctctgcacctttttcgttctaacagctagctagctaccctatgtccctatctatcgaatagtagcaccaatttgatcaagtactaagaaaagaaattccacacctgagcaagagataattaagatgttattatgatccaaaatgtgccaatattgttctataatatacttttgttttcggatgtcgacatagggtcatgcacatcatgaccaataattactgaccgatagcagtcggggaagatctacaggcaaattatccgtcaatttaacattctgacataaactagctttctttcatcgacaagcattctatgggcaaaacttaggcagcaatctatctattagcaacacgggatgaagattatgcttgggcgtgggtacgggtggatgtcgggacagctcggctcggtctagctcgttaggataacgagctagctcggcttagctcgttaggaagctagctccactagtacagatccttctatctgtgacgggctctaatatgcttagaaatagcgggccgtcacaaggaagtcatctcaatcgggccgaaaagtgcccgattgagatatagtcgtacagacatgttagatgggtataaaacttaagactgtcacggatgacatctatcagtgacgggccgtagtttaggtccgattgagataacattccatatctcaaataggcctaaagttgcgggtcatctgtgacgggcactaactttaggcccgattgagataacattccacatctcaaacaggcctcaagttgtggcacgtcacagatgaccatcatccgtgacgggccacaactttaggcccgattgagataacattacatatctcaaacgggtctcaagttatggcatgtcacggatgatggagtcacggatgaccattatccgtgacggaccacaacttgagacccgtttgagataacaactaggcccgtcacagatgactcatcagtgacgggctatatacttaatctttatcgggtattaactaaagcccgtcaccgatgactatttttctatttttcatatgaaatgtttatatttgtaagttgactatagcaaaataattaagtacagtataataattcattttatgagtcaaaataattttatggtagtaaatgatttcaaatggaaaaaatatcaacaacaaagttatataacttatcaagatttataacttttagtttggtcatgtttctatataacatttttttgaacagtttgaatttgaatttgaaaatatgacaacttcaaacaacattttcaaatactaaatgatttcaattgaaaaagtcattaacaacaaagttgaataactcatcaagatctaaaacttttatttttgttatttcttcatccgacgaaatgttagtaatattattaacaaattttacatatatgtgttatagtttataaaaccagataagagatatgtcaattttgtgaacagtgttactatcactttgtcgtatgaagaaatgaccacaataaaagttttagatcatgataagttattcaactttgttgttgatgactttttcagttgatatcatttagtatttgaaaatgttgtttgaagttgtcatattttcaaatttaaattcaaacggttcaaaaaatgttatatagaaaaatgaccaaaataaaagttatagatcttgatgagttatacaactttgttgttgatgactttttcagttgaagtcgttcactgatctaaaattctatttgaacttttcaaaatttgaatttcaaatttcaaattgtttaaatagagtcagatggataaatgaccaaaataaaaattttgcacctcgatgagttatacaactttggttttggtgacttttctatctgaaatcatttaataatcccaatttgacatcctggcctagggcttaataggattaatagaatactcataccaacaagttacaactacttttctggaagccaatctccaaagaactttgatgttatgactgaccgggaagcgtgggtgcacactaaaaaataaaatttatttattaatttcaggatgggtgactgaccggtaagcgtgggtgcacatgagtgagggcagggcattaactatagccatttctggattatccgcgtgggtgcacacgagtgagggcagggctagccaaaaaataaaatttatttatttctggattatacttatctgtgacgggcattaactggctagccaaaaaataaaatttatttatttctggattatactcatctgtgacgggcattaactatagctatttctggattatccgcgtgggtgcacacgagtgagggcagggctagccaaaaaaataaaatttatttatttctggattatactcatctatgacgggtattaactggctggccaaaaaataaaatttatttatttctggattatactcatttgtgacgggcattaattatagccatagttaatgtccgtcacagatgagtcatctgtctgtgacgggctatagttaatgcccgtcacagataagggtcatctatgacgggcgctagttgtggcccgattgagataggtcatccgtgacgggctatagttggactggtcgtctgggtcaaagctatcggtgacgggctttaattagggcccgattgagatagattcatccgtgacagccgtttacccgattgagataactcttcacatctgtgactactagcctgtgacggatgccgtgcccgattgagatggtgttttaccacccgattgagatgatggtatcccttctagtgcttgttatcctagcaagctatcggcacggctcgttgtctagctttaaccggctcgtttggctcgtgagccaatgaagtcatgaatagtactggcaataatctgcaactgattagcatttcaagtatagcagcatcatccaacaaatgaacatataagggatttgagcgacaatttacagacatgcaggatcatctgcatgaatcaatatatcatgcaaaatctcagaacaacaacaacaaccaaaaaagagaagcacacagtatcacaaactcacagtagctgccattctatatttccaatcacgatagagaaagcagtacataatatgctactggatctcattttcctcctccatggcggataaggacacgccggcgagcagcgtggacgtggtgcgcggtgcgccatggccttcggcgacgggatggccaagggcgtggcgctgtggggacgggcgacggcgccgcagcccatgggatggtggtgggctgctggcggcgctagggagattgagattgggcggcggcgtggtgataggaatggttaccatgggttatgggctagatcgcaaatgggcattgttaggcttcctctagactcctctgtgctgttgttatttcttggctcatttagctcgtgagcggctcatgagcccgcttgaccccctgctcagcacgctaacaattttcaacgagctgaatcgagccgaaccgaccatgaatcgagcgagctaatgagccacgagctttctatccacctccatgcgtgggagaatctggagagcaaagcgtagagaaacaaatgccctttcctgaacctgccgacacacgtatggcttcacttcttgctgccccactcaactcctctaccgtctcttcatgtgctatctgcctctaccacctccctcctgcttcggcgaaattttctaccagcaaaggtttgtttaaagatctgtgcactggtaagagtttatctgccgggaagcttaaatttagtggccaattggtctgtcgaaaatgtctttttctgttggcaaagaattttattgacatgttctttcccactcacttgtttcctattgagaaaagcctttactgacaggccgaatgacatcataaacacataacctttgccgacaattgagctgttggtgcatttaggtcatggtgcagtgatgtaatgaagtttccagtctaagtccaccaaacacacaagtatcttggacctccaaatttaactttttcctgttttctcttgttgctaatcccctggtggccactcgccaagaaaatatgttcatttgatgatgtatatattgagctaataacattctgaattctgatattttatatttcaaaactttttgcattacatatgacaacaacgggatgccaatacaagctaatggaagagttcaaaagattgctgatccttttgattatggagcagggtttgttaatccggtcatggcagctgatccaggccttatctacgacatcaccgcatctgattacctcaaattcttcaactgcatgggaggattaggctcaagggacaattgcaccacagcgaaaggatcacttactgacctgaacctcccatccattgccatccctaacctcaggacattccaagctatgacacgcactgtcaccaatgttggccaagttaatgccgtgtatagagcattcttccaagctccagctggtgtcgagatggccgtcgagccaccagtgctggtgttcaacaagaacagaagagtgcagagcttcagggtgaccttcaaggctacacgaaaggtgcagggtgactacaggtttgaaagcttggcgtggcatgatgaagcaagccactgggttcggatccccatcgccgttcgcatcgtgattgaggagatctactccaagatctcctaattaattggatattggatatatatgctagctactaatgatgctagttgatcaatggtcgaatggaataaatgaaggcgaattcatatgctccaatatatagcatgttatatgtgtttctggaatcttgctgcatcttattccaaatccaagtggcgtatatctgttaaaatttatggttgaataatatatctaatcttgtgttagatgtttgtgctgaataggggaattaccatgtgatcaaaggaatcattaaaacttgattattaatatgtacggaaataatccctgcaaaaaaaatatgtatgaaaataaataaaaaagggcatatatgtttcgatacattgtgttttctcattctgaattttagactttgattcgaggattagttttaaggattttcttagccactttcgtgatggctctttttttatgaccattaataagtaaacaatctatgtataaattaaatttattatttattaaaagtcaaactttgagaattcagagttgctttggattataatactccaatactgtgccagggttataatagcccatgtaggtaacccacagtccaaccaatgggacatctcctatttgccatggctcaatttggaggacaccacaatcaattgatcgaagggtccttaatcccttatttgttatgtcatcaagattgacagtctaccctaaagaggcagaaatctgcatgtgaattagtactaccacaggctgggagtactgttatttttgcccattttgttggaagcgaatgtatgtcctacaattacaggcttatcatgtgtgatgcctgccatgtgcaggcttatcatgtgcgatggttgccatgcttggatagattgtacctctctttggcatatatgggtggacctgatttaattatggacgtaactactacacagctagtggtagctgttttgtctaaaccagctaccactccatctataagaggcaccatccacctatacttcaaatacaattttctcttaaactactcatccgatctacgatccgattgcaccgttgtgttcgtaacaattaaatctttagaacaagatctcacatgattatattttgatgaaaaatcataaattacttttatgatatgtctaaattacttttagttttcactaagttacttcttagatatataaaagtaaatttagtaaaacctaaaagtaatttacatatattatagaagtaacttagaacaaaaccaaggtaactttggcatgtcatttgaagtaaatccattgtagagataaaaacatgactctatctataaattaaattaatcagtataaattatggaattaactaaaataataataaaagtaatcaccttagagcattatgaattttcaatgaaaaaaatgcattaattaaagttactttctttttttttgttataagttacttctattttatatgtaaattacttttaggctttactgaatttacttttatatgtctaagaagtaacttagtgaaatctaaaagtaatttagacatatcataaaagtaatctgtgatttttcatcaaaatataatcatgtgagatcttgttgtaaagatttaattattacgaacacaacggtgtaatcggattgtaaatcggatgagtaatttaagagaatttttttttgaagcatagatgatagaatatttcccctacttgctcaatggagtaagtactagcacgtgggtgtctctggttaagactaattggagaggcctctccaattagatttaccgtttaattatgttaccttccaactttactttttttttctctccacgttgttgccttccatcgaaggtccttacctacacaaggagaggtctctgcaagtttggattattaaaatactcatgtgcctccttttcttggagatttaattatggatattttttttaataatggaatttattttggcttttgtttcaaagaagcacataacaagatgagatgactgtaataaccaattattacagagattgcaagtgagatgactgtgaagtacataacaagaaaacttcttaaactaccagcctaaagacattcatccatagttggcaagaatatacataaccgttagtttatctcagcgacttgcaaattttatgtagtaattgtctttctcaaatcaggaaacaaaatcttcgaaataacagccgatcattagttatgctgattaaatttctctcacatcaccgctgatgagaaccccaacaaaagaaatatcagagagtaattagtcattctcccaaatcttgccaccgccataacaattgaaaccgatccagcgggacaacggcaccaagaatgccgcaccaatgggggacctctaatacaatgcctccaaggtcaataacatctaggagtccccatagttattccaaacatcgggaattaggtcttttcttttcccacatagagggtggaggcccatgctgctgccttcttaatttgtccatctgtcgtaaaatataacaactatcaatcaagattcatcccaaaatatatcaccttcttcattaacattctctttcccaaccaatcacaattcttcactattcaatttttccacctacctctacttctaaactaatcacaaccttccccatttaattctacctacttcattattattcatgtccaatcttaaagatgcttatattctaggacggaggtagtacctgatatggagggctagtactaggtagcatatctatgggccaataattaatatcttagtctggaattaggagtatactcctactttgcgatgacatttta

SEQ ID NO: 4348 - DNA, 6593 bp, Oryza sativa
ttctccagtagtgcaagttatagctatttgtattagagtttcgtgagaaacttgtgagaggagtgctattattgtactttgtaaatataaatagaagcaataaagttcaacatactttcaagggtacttcgatttgtgtttagtcaggacgggcggtcataccggcagcaccactatgcttagaccggcgacacaaaaagcggatagaccagcacaagacctacagtcaaactaatctccatcgaattcgagggtaacttttaattccgctaaaaagttttgttttttggtgttccaaccattcacccctctagtcagcttagttcttactgttcgatcctacaattgggagtgctaggactcctctcacctcaggcttgaggtagggtttggcgccagggtgcatgagggctcatagtccttatgcaagggtaaccgaaaaatcagactgtgacaagtcttatgtgttgggtgcggcacatagtgcgggcttcaaatgaatctattcgaacagccgtgctcgtggttaattgagcgcctggacttgtactattattgatttgcctcataagttctaatcttgcttacaataggattgggaggaaatgtgtgaccttgcccaacgtgcgggaaggtcggaatggtgggaaatgcttaaaaccgaatgatagggtaaaccggaccaagcgagacttggggaagatggatgaaacctctttgattaacaacaacttcaacttaacgttgtttttagttaaaactgctaagtcataagttcatgaactgaattatgaaatctagcttttatgcaaataagccgagccatccttgaacccatgtgtgcactaaatgcatcctggagtagtgacttactaagtacggttttttgggggggttaacccccctaccccttgcttacttaactcttttagtagaagatattggagtcgattcgcacgtttgctatgttgatgaggaggtgtcaaagacggttgagtagggacctaggttctccagtcgttgcatgtggaataagatggactgccgttgcttcgcttccgctacttcttttggtatttggtaatgtaattgaccatacttggtctatttgggtcccactcgggcaacccttgtattattgatgtattgtaaaacctttataacgatgtcagctatgtgatatgtaactttgccatgtgcataccatcaaccgatttagggaatggtactgtaaacacacgaggttttcggtgtacaaaactggggccgacacgctgtcgctccagctcatcgacgagacgctgccgctgcccactcctcctcggagccaccaccgacatccctcctcgtcgccgagacaccgctcccgcccctgttccttggagtcgctgctcctctgcttggagccgccaacgcgtgagagagagagagaggaggagggggagggggagggaaatgggtggaggaggagaggataaggatcggaggataaggatgggacttagatgtttagtttaggctgatccacaggcatgatttcataggcagctttgcaggcggaccacttaaatcctccgcctatgataatttatatattttcgtagacggatgtcttaagcagtccgtctgtgaagatttattttggcagacggatgatcatcccatccctcacttaggacaatggatgctgtcatttgggggtaaaatttcggtcttcctgtaaaatgacatgggtctcgtcaacgaaaatcatttttctagtagtggtgattggtcacttgcatgagttcctggtttgcatggtcgaaaacttttatcttatgctattgtagcctaccaccagttaccatataaatttctgcattcagttctgcggggtgccaaccctagtaatctatatctagtccattattgctttgcttcttccttttttatcttgatttggtggtccagaaatctggattatgtagatggagggctgctataattcttgcaacccgtgacaaatcattcaacaggtatgtgcgcgtcaacgttcacagcattaacaaagtagcgatttactgagatgtctaaactagaaacaaacctatgacaattcaacacgatgtagctaatctttccccagaaagctagtaaaagcattgtttttcatagcctggagaacattgaaattgatcgaccttgtgctgtgacgacgtcaatttgaaagattatacgacgacgtcaaatctccgaccgaaaacaggaggagaggggtaaatggatgatcgacctgcccgtcaaaaagttaatagttttctgggtcctgtcatatatattgctgaatgacacacacacatataaacaaaacctacatcagcaattgaggttgaggtagattcattaattaattactactactactacctaatacttaaaaaattcacttgcctttgatcacgttgctgtattataatcaggtagattcaacggagagtgacaggatttcttcaagttttgcgaagacaaccaaaaagttcaattgaacactgtacgacagatgtgatacatatgatcgatcgacgaatgaggcgatacgatggaagaaaattgtagtattcaattaaactctgtcgacgattgacaagttgagctgttagtagctagtaaataacccgcggcagataacaccgaaaacgtgcatggtttttcctggatctcttctatcgatggatgtataaatagctcctaccttggcaagctctaactatcatatcgcagttcatttcacaaacggtatatgaaaccatagttcatttcaatccttccatatggctcaagctggtgtacatagaggaggctgttgccgactcctctttcttcttgttactgctcttttgttgcgaagatcctgtgttgttggacagcaaagccaatccaagaaagtatactggttttattataagtgaaatgtacttttctgtaattttgaccccatatatattttttaaaaaatgccgtaacatcttgaaaaaaaggtaatttcattgaatcaatgttttccactggagttttctttattgcccattaagaagttatcggaggcactattagaactaggatggtaaaaatgtcaatttcatattataagtcgttttggatttcttatgtcaaattttttgaccaaatatagtaacatttatagcattaaattagtttttattaaatctaacattggatggtttttttttgttttatgttgaaaatattgttatacttttttgtttataaatttggtcaaaactaaataagtttgacttcaaaaaagttaataatatgaaatggaggtagtagtctatgtgcctctcggtatctaactataaaaatgctcccatatataccattgagtcaatatatagctaagacgtgtgctggtggtaactactactctctccatttttaatgtatgacgatgctaatttgttgagatatgtttgatcattcgtcgtatttaaaaaatatttaattattatttattttattgtgatttggtttataaatgttctttaagcatgatttaaatatttttatatttgcacaaaaaatttgaataggacaaatgatcaaacgttgataaaaaataaacatcgttatacattaataaaatggagttagtatatgtgtatggagaggtgtatgcatggctgattgacaaactatacaatatttgaagatttacattgtctaccttggggagagacgacacgatgatgctgatgtcgtcactggttcccaccatgacatgctcgcctctgttttgggaaggtaagaatgcacatcgttactctgtccatttacaaatattagtcgtactacctaacaacacatcgagagttggatcactatctgctcactgaaagtgtgatggatctaagtacaaattttatgtattgcaaaatgtgatatggaatgatattttttaaaaaaatatatatagtagtcaaaagtgacaatgtttgtttacgattaaaaatggagaaccttatatgcaaccgagcaaacgaacgttatgaaagatacaaatatgtccgtatattattaagaaaatacaaaatcaaaatgatgcccttgataatataaaaccttaaaatgaaagggtacacaaatacaacaactggtaggcaaagaaaggaaaacaacgttgctttaatggaaacatgcatggactctgaagtagcgggaataaaattagattgaaaagggcaaatgagtgcataattagtaaatttgtgtatatgcgtgtgcgttttcctgtgaggaagaaaaatagccacacaaatctttttagcaagtaatatgtgcagaagaactgcatgctaatgcgtctatatgttgattgacaaacaaactgtagagtaagatttgagatatcgtcactaacaatattactacgtgcatatctacggtgaactaaaaattatttcgagtattattaaaataaaatatggttgcatctttgaagcaaggaggtggctcttgagtccatcgtgtacagctacagacatagtttttctggctttgctgcaaggctcacagaagcacaagcgagcacgatacgaggtaattaattaatcattttctttaccgataaaaaattaagaggacacatatatattctaaaattaattggggcaccatgaatcatactccctccgtcccctaatataagggattttgacattttgcttgcactgtttgaccatttatcttattcaaaaaattttgaaattattatttattttatttgagatttactttattatccaaagtactttaagtatatatttttgttttttatatttaaataatttttttaataagacgagtgattaggggacggaggtagtgtgtgtatgtatgtatgtgtatattctgacaattttaattatatttaatattctagggttgccagatgtgatcagcgtgagagagaaccaaatccaccggttgcatacgagtcgaagctgggatttccttggaatggactacagacagccaaatggcctgctagccaaagctaaatatggggaagatattattattggggttatcgacacaggtaagtaaaacactagctacatgcatatataacctgttcaaatattgtaccacgtgcaacgtaccagatctatactacgtacctgcaaccagatattccctatgataaagctactcataatataggacaatatatattttggtcaaatttttataactttaatgattaataattctcaagtgtttagtttaaaagtaagaaagatattatgcatagatttgcattgaatagaactggggcggaacttcaaaatttacaataataacagactaattttaaaagcagccctacactaattaatactttaagtttcttattccagctctgtcattcattatatagtagtactactacattaacatcgtaaattatgataagtttagttatgggtgaatagctaatttagtccattaagttttaccaaaggctcaatttggtctttcacgttttattttgtccacatagctcctccaaatatttgttttggcttaaaatcatccttggacccacttaatatgccatatggctatttctagtcagtatttctattaaaaagtcctttttgcccttaatttgtatacaactatatactagacaagagtaagtcaacatgaataaacaacgttacagatgtacttcctattatttcaagatgtgcacatggaacttaagcaattgctatcgtatacacttgctagtatataattattttcattttacataatatactatgtattatctataaaaaattgaagcatgcaatttttctcttatatatgcgaatgatgaggggtataagtgtcatttatgaagagagttgttggttcaaggataagtttgaactaaaatgaaaacttaaaggactaatatggatagattaaaacattaaggactaaactgagccttagatgaaacttgaaggaccactttggctattcacccttagaatacattgatgataatgtttgagcatattttagattagggacaattgtttatttgaccccgttttgaatcctaactactaatttgaccctactttttagagtttgcttatttgaccgtccttttcaaaaagaagcttccgtataaccctgatctgttaagggcatttaacgttgttaactgaagcacaaaatatctcttctgttcttactcatttgaccctattacatatgggacccacccgtcagttctctcttcttctctcctctcttttcttctcctctcctctctttcacggatcagcggcgaaccggcaccgatggggcggcggcttgccgcggcggcggcgctctgagggggcggagggagggagcggcggcggcggcggctgacggagggggcgagttgcggcggcggcgcactgagggggcgagcagccgcgccgactcgtggagggagggaggtgcggccgcggcgcaggcgagtggaaggagggaggaggcggcggtgccggcgccggcgcaagcgcgcggaaggagggaggagg

SEQ ID NO: 4349 - DNA, 541 bp, Oryza sativa
tgtgaagctccgaaatttcacaaaaaaatccggagaatatattaaggttcccggccatgatttttaaaggaaattttttaattccctcattatttcacttgattaaattgttttaacttttatttaatttctagaaaatgcattattcaatgatttttaatcccgaacgaaaatcggggggttacacgtgcgccgggtgctgcgcctttccgccacgcctgcctcaccgacgcttccacctctctaccatggccgccgccgtgcgcgcctactgccggcccatccccacgcgccgctacccgcctttgcctccgtctccgctgccggctgcacgagcgcgccaccggtgcccgagtgagccccgccttccccgccggccgttcgcgctaccttctcctccgctccgccgacggtcgccgagcaaccgccgcgccgccagcacctgagcgtcgtcctcatcgtcaccatccactcctccattgccattctcaatgccaccgtgctggtgagctggtgaggagcggcgcggcagtaggatccc

SEQ ID NO: 4350 - DNA, 13055 bp, Oryza sativa
tttttttggttttttttaagatgtacatatgcaaagtttatattcgtatgtataccaaattttgtattcgtacgcatacaaagtttgtattcgtgtttttttctctcagtttttaatatatacatatacaaagtttatatacacgtatgtgaagtttgtatactcgtatgcgaagtttgtatacatgtatatattttatacgttattttttttgtacacataaaaattatatatatacatatatactttggatacaatacaaagtttatacatgtgtatataaagtatatacatacgtatatatacatgtagtagtattgttgtagtagtagtactccttccatcccattttaaatacaatcataagtctccgtgcccaattttgatcttccgtcttatatgaatattttttatgattattatttttttattagatgataaaacatgaataatactttatgtgtgacttctatttttaaatttttttaaaaaaaattaaataagacagacgatcaaagttgggtatgaaaaatcatggctgcacttaggccccctttgattcaaaaggaaattcataggaattttaaaggatttcattcctatagaaatttttcctacatagccatttgaatcaaaggaataaatcctgtgcaattcctatggaatgcctaatgccatacaagttttggaagaaatctagcataaggttgtaccgtatgaaaactttcctatgagtctccacctctcctctaattcctgtgttttttctgtggtccaatcaaacggttattcttgtgtttttcttatgttttgcaattctctgttttacccttgcattcatattaaaatcctgcgtttttcctatttctacatttttttaatcatgtgattcaaaaggtgcccttgaattggaacagaggaagtactactgtagtggtagtagcagcagcagcgcgccagtagtagtaccaggagcagaggagcgggaggagcagtagcagtaggagcagagctgtaggagcagttccacgttaaaattagaagtttgaagaaattcgaatgatgtgacaaaaaaaagttggaagtttatgtatgtagaaaagtttgatgtgaaaaagttgaaaattttttaaaaaaagttggaatgtaaatagggcctaggagtaggagagtagtagtaggaggtgcttagatcaggggtgtaaaatttggcatgtcacatcgtacatatggacatatatttaaagtattaaatgtagtctaataataaaacaaattacataatccgtctgtaaactgcgagacgaatttattaagcctaattaatccgtcattagcaaatatttactgtagcaccacattgtcaaatcatggagcaattaggtttaaaagattcgtcttgtaaattagtcgcgatctatgcaattagttgtttttttagcctatatttaatacttcatacaggttgaggtgagatctaaacagggccatagtactactactagaagagcagtagcagcagcagtagtaggagcgcgtgaccagtccactcatcaggggcactcctagcggtctcccagtattccgagcgccaaacatgcgtcagcccagtcccaccctaccctactttctatcatcccactcttacggttatcggagtaaatgatctactctgatcgcgtatctctaccacccaccctttcgagtaaatgtttttctctaatgtaatccaacctcacccttgcgcatactatcatgtctattcatgtctatgtgagattcttaactatacccaccatccccttgtattcctctccaccacccggatttttcggatctgaccaccaccgtatggagaggggctgtttccggcgatggcatcgagggaggccggcgagggcgcagagcctaattttacgaatcttgcctaccaaaaaccaggagcagaaagcgagcggcaatggtgcagttctggcgatggcaaaggtgacgagttaggcaggactcccatctccacgatggagggtggagatccggcattgctgtgaccgaatccggtgatcccgcagccggatgtggccatgtggcacgggacgacgcatgcaggcgcgccacggcggcttgtggcgcgggagacgacacggcgggcggcacgagcgttagcagagcggccggcggtggccgggcaacggcacggattagccgagcgatgaccacagagcggggtgggtcatggcgacctaacgacggccagatcctccctctcccggccaaatccggtggtggcttggcagctcttctgccaaggttgagaaggagagcggacggcagcacgtacgtacgacgaagcggagcggccgttgaaatgacgtggtggcgtgcgcccgtgggacagctgtggaggtgccggcgcgaggtgatgcagtcgtctgactgctggccaactgctctgctctgcttgtttcttttttttttttttgtaaaagttttattcacgtggttggtacatatgattcaatgtcgcatccggagtatacaaaaatattattatctacatattattctgttgtaaaaaatcattttggccctaggaaaccgaagtacagagtaaataccaatccaaaagcaaaacgaagtacatcaatgcatatttcatgtgggaataatttctttaccacatgttaaaaaataagctgaccgaagtataccaatacagattatcatgcgggagtaattcgtttactacctgattaaaattagtttttatctaatcgaagtacactaatacaaagagtaattcctttactacctgatctctttctagagttaatttcttcatgaagtcagcagtctgttagtaaatgatttactcattttttttggctaattgtaaatgatttactggtactggtttcctattagtaacgggaacggtttagagagagatacgggagagggacaacagaaaaattaaaattgccgtgaggataggagagcccaatagaaatacgagggggaagaggaacggaaaaggcggaataggaacggaaaggtggaagcgagataagggaaaaaacagaaaaaccgaaggtatgggatacctgagacgctcgaactattgttccaagcgattttgagttcgcttcaacaaataaattacaatgttctcctagcaagcaaaaagagagatattttttcccaattgattaaccaaggctactaactaaattgaccggttaaaattattctttctcagtctcggactcagtactttcgatctcggtcccgttcttttcactttgatccacccctagatggatggttggacgacagatatgagggagcgcacaagtgctggggagtggggcccgtctggtatttcagtctttttaggtccctagcggatataagccaaacaagaatcggtctttcttaagtacgacaccgcaggttaaaaaccaatgccggacaaacaaaaagaaaatttttgttcggttatttttttgccacccctcgcaagaccctgcaattcactaacctccaatgtctgttttgtgctttgtccgtgaatgttagagctcgtcacttgccaattttcccgtatcattttacttataatcaatcactgtttaatagattgtttttttctgcagctaatcaattacgttataataaacccttttttctttaaaaatactaaataaaccgacttagctatataattttcatgttaccaacattaagaaactacattttccatttgatttttattatttatctcaggattttagctaatagagttatattttttttaatttcatttttcaagtatttatctcgggatttgagctaatcgagttgtttgagttagcatgatgattttgcttcttggcttttgctgatggcgtggcatcaaccacgaaacaattcatgctgaatatcctactttcaattgaagtggttatactaattttctttcctagctttactgatctttcataaaaggtagttcggcattttgatttggattgatttctttttggatgagttgtaactatgaatttttatttttttagaaacatcatttttttttaaaaaaaatgctcatatcacaaaaacaatcatctcataaaatttgattgtttccgtggcaacacatggacactgtgctagtataaatattattactcttcccctcggttccaaaatatagcaagctggggagggagtattgatttttgatcttttgtttatttgtaaaaaatatgaatacttaaaaggatgtcgtatttatcaaagtgttgcatattagccatgaaacttttgttcatagtctaatcatttaagaaaatattttattggtgatttagttattaaagttgaactagataattatttaaaaatggagggagtatttctcggttaatgcaaggaaaaaaaaaccttattagtcccacaatcttccactgtaagtaaaaagagtactgctatatatacgacatacgagttagttgtacaactcatatacaaatagaaacatgcaaccataaataaatcaaggagagattatattcatatgcactatagctgtttgcaaccgttgattaaattcagtagtacatgagtcggatagctagggtcgtatacatagcaatttccaaaaaaaaaaaaagtttcatgacaaactacaacccctgacgaggttgcttatagggtgctcatgaattagtctctgatttggactgatcccatcccacaatctgtatatctgctggttcatgattttttttttcatgaaccagtaaggtaataaagtggcgcttttttaagataaaaaaagaacttccatgacgagtttatcaaatatcaaaattgttaaatttgtagaatcatgtcagaggtttacagatccacaacaaaggacatgcattcagatttatatatgacagacaaaaaaaaagaactggtcttcatctattccattaaaaaatcatctgaatcatgttaaaatgttttttttttcatacataggaatgcgaagccgaagattgcttataaaatttacatcccatctcaaagcatgatctagatagatttaatccattaattccttacaagcatacaatttttgagcaagcagtaattgaaataacagtataaaattataagaggttgcctgcgagaagggttagagcatctccagcaaagcccctaaacatagaccttaaacaactttgaggggttgtgactaaaaaataaagtccaacagggctcctacttaaggccccaaagtagaaaggctctcaaattctctcccacagcccctaggcctaggggctatatccccagcccctatccagttttctttggcgtgaggggatgtttccatgacgtgtgctccttcccacgcgatcgcttgcacgccgccggccgtcttgtgggtgattctgctctaatccggccatctccctgctatagtattggtcacctacatggatgcaagtatgcatagatgtttcagcgtatcgatgagacatcgtttggttcctgttaaatgtcaacagccatctgccgccagtggccaactgagatttgatttggctgatctaggagttactactaccatctccttgcatatatgcctgcagtaccgtgtatgcactggatattgtctgaatcttgtccagcccatcatatatgattatatgcatccatatatatatgtacaggtatatcattggatgttgatcgtaggatggatggatgaactgctactgctaccagccacagcagatgcactgatcgagcattctagcgagtaatcatgcactcacactagtgtatgtatatgcacagatcaaatgtgatatcagaaaaaaaaattcaaaattcaatttgaattgtgttgtttgaaattattaatttaaatatgattaaattctatgcgttggaaatattaatatttacattattgtgatattaaactaaacataaaaaatggattataagatgaaatagaggagaaaaagaaataggggctaagaattagaggttgttgatggagttagaaccatttttagagtcttaaggaaataggggcagcccccatttaacctttagggactttaaaataggagctattgctggagatgctcttacaaagtacaaacaaaaaataagcaatcatacaaatttattccaaaggacatggaaacatttgagaaagaacagcaaaaataaaacaatcaacctcattggtaaagcacaagttttatcccaaagaactttgtctgtgcagtgcaaacatccatgcatatgcaaatgttaattacatgggcagtctactgtagtatctgtatcagtatcactccatttccatatgaaatgtgttttgactgtgtattaggcatatacagatgaaatagggcaggattcaggaggaccaagttttagtggcttcgtctatgagtgtctgatacagctcctcaaccacattgaggaggaaatggtctgcaccatgtcgcgccacgagcgaaactgacacaggaagaccattgcgcatgcccagcggaatactcacctgcagcacataggcagaacacatcaaaaaaacattagtcaccccaaccattgtcaaggtagaattaataagaaaagatagattaacttgctagctagttctacctggcaaaacccggataatccagcgatggagagaagtgaaaatgctcttgctcggaaattttccagaggagcagcttccatgcccaccttgggtggaggcccaggaactgtagggattgcaaggattccatgatcctatgaataaacaagcaagtggctaagagagctggaaactacttatctgataattgacacaaatcaccagaaaattattggctgcagaagaatgcaggaggaaatcattctttcagttaccttcagaagagcagcaagtgcagacttgaattcagcccttatagcttggaaatcctccagggattcattatccccagatgcaatggcctccagtattctctcccgtaatccagggcctaggttaggttttacagtgttgacccactctgcatggtttgctttgaactgagacctgaagtacacatagttttaatggattaatttacagttttatctcccagactccttgtcctacatatgcaactctggctagtgaacgagcacaaatcctatcactagatgctgctgaaaattattggatttttctaccacgattatgaacaagatgattggtgtactaaaagaatatactaaactatttggcatggtgtgcagtagtcagtagctagcactattaactcaaaccttaaagcaatattactagatatcctgaataagctagctgtaggtgaaacctttgaaggcctcgcatgacatgtgaaatgacggatagagctggcacagaagggagttcgctttcagagaagtcagtgatgaactttcctatgcttggaacattatcagagatgaaatctccaaggttcctattgtctaatatctgacctgtgaaaacaaaggaacaaccccatcagacaagatgtatggtagaaagcaagaattctagagctctaagctagaacaacatgagtgcgtagatagtactactcactatcaaatctctttgctaccgaagcattgatgatttgataggtgcggtcgtcgagagagcctaagatctggaaacagtccataggaattgtgacttgagtaggttgcttgacaatgtcatcagggagtggcaacagcactttggttacacgagacaacgtagataaatctctggaaaaccaccctgcacaagcaattgcatgaataaaccagaaactcatcaatcagcaccactcgcagtagtaattaatactgattaacaggtctttgttttcacctgattgtaactgtgctgaagtaatttgaccaacattatgcagtaacattaagggtgtaatttgaacagaaacaatacctatgcagtagtaatcaatactaaaagggaaatggaggagatagtaagtgaataattaccaacagtatcaaacatttgcgccatggggatgacattctctgcagaaaccaacccatgggaagggcggagtccaaagatgccgcagtaggcagcaggcaccctgacgctgccgccggtgtcggtgccgagggagaagtcgacgaggttggcggcgacggcgacagctgaaccactggaggatcctccggggactctcccaggcgcgcaagggttggtcggcgtgccgtagtgcgtgttctccccattgatgctgacaacaacaaaccaatcctagctcataagagttaagacccacaaattttgtgacaaccaaccttttacaaattttgtgacaaaattattggaaatggggaaaacaaatttattttggggggatagttggcttggtaggaaaccattagctgagcaatatcctttcatttataacagtaccttcaccaagcatgttacagttgccaaagtgacaaaagaggggtgaaattggatttaagtttaggagaattcttcttctttttttttagaaacaaagttcaggagaattgttatgggtgacaacttgctttagcatggagataaactttcaacagaaagttcagtcgattgtactgaataatctgaaagataaattaatctggaagctgaccaaagatgggtgctttactgtcaaatccttctacagggcattaaaaatgcaagacttagcttatccttccaagaagatttggaaattaaaagtgcctctaaaaatcaaagtttgttctttctgtggcttgtgtttaagaaggagtattctgaaaaagagcatgggggtcgcagtgggtacctgtagcccatctcgtccatgatggtggtgccgaggctggtggcgccggcggcgagcgcggcgaggacgacgggggaggtgccggcggcgggcgcgtgggtcctcgcccagtccgggttgccgaacccggtgacgcggccggcgatgtcgaagctgcgaattaaccaaacaagacagtgagtattcgtcgttcatttgggggagaaaggaagaagaagaaggcagcgagcgagcgagcaatccgtacatgtccttgatggcgaaggtgaggccgtggagagggagttgctgcgatggcggcggcggcagcacgaacctctccatgaaggcgccgtagtctcctcgtcctccacccgccatcgccatgtcgagctcgagctctctctgtctctctctgccgcgtcacctcggctaatctaatcgtcttgttagcatcgaagctgggctgggctgggctgggctggacgatggccatcgcggtggggccagtgatgaggaaagtgaggggctgatcagattgacgctatttttaattatatcacttttttgggtaaagttataaaaaaatatttacgtttagtttgttgtcaaatttggtagatatataagaaatcctgtcaaaatttggtaagacaggccctaaattctattttggctacaacctaactttcatctctcgttataaaatcagatacctccaattctcgactattaaaaccgggtaaattttgtctccattagactgtttggatgacgattttatcacatgtgatgcttacgtggtacgttagatgggtcttcatcttttgtgtggagtgtgtggcgcttgcatagtattacatccagcaaaaaaataaaaacaaaaaaatttaaaataagtgaaccatgtgtaattctatcggagaaaacaatagagttaatgagacccgcatgtcattctctctcctcctcatcgcttctctccctccctcccctcttctttctcgtcgtgtcattctcctcagagagcatgaacacaacggcagtatcatgtccggtgattgcctacggtagggaccatgttgtcgacaccatcatgatggtcttgattagggtggtggtgtcctttacaggtaatgcggaaccttctcataggtgagtttgtggcaccgaaccgcacctcactagaagcatgaaataggtctacccctatagggctccaagtcatcagcccgcgaccaagacatgaccctcgaaccccactccatccacatcacaaaggacccttgttagctgtgagtactccgagagctatccgttgggcatcaccctttcttcgcagcattaatactggagtcaatcgaggcactggagaggcggactgaggtggtggaggagttgaccaaggtgttgaggaggagggcatgctcatggaggacgacgataccgaccgaccgcctggtgccacgtggtagcactgctagaccgggtcgtcatcatctctctattccaccaatctgcgcatgccatacgcagccgaccaagccgaaagctcctagggatgtgaggcatcgcaaagagcgctagggtcgacatggctcacacagatctagacgccgatgcttggggaccctatcccctactcagtttagatcgttattggcatcgtgtcaccgtcccattgaattattttattatttattttttcttgaatgtaataccatgaaagcaccacatatgacatatacatcatgttttgcctttttcttttcttttcatggatatgtttgttgccagataacacaatctttctttacggccacatgcatgtttgtgtgggcttagactctggcgtattattttgattgttttttacgcaaacatattattctgattcaagccaaagctcttatgtttattaacttttctgtagatgaattgaaatgaactgaaagaaagtttcaaaatataaaaaatgacacagcatcatgtggcccaactcgaatgttaaataattattattctctccatttttttttagaaaaaacggtgttgttggtaaaacgtagagcaccatccattttcacactttgacaacctttttaataaaaaaaaactataaatacttacttcatccgtttcacaatgtaagtcattctagtatttcccacattcatattgatatgaatgaatctagacatatatctatctagatttattgaatgtgtaaaatgctagaatgacttatactgtgaaacagagggagtacttagagagattgtattatcaacgtatgttacatattagccataagtatctatgaaacttccgttcatagtctaaacatattaaagttaaagttgaaacaacaataatcagcgctaatagctacttgaaaatatagagaatatttaacattttcactgttaatggcacaagacgagaaaaggcttgatagtcccagaagccacacaatctccgcgattccaaaaaaaatccatgacgaggtttatcactattgttaaatttaaaaaatcttgctcggaacaacaatcaagaataggtttgtagaattgtaggtttacacatccattctttaatttggtgacagcacagaaaatgcattccgatcaatataacagaaaaagagcaaaatcacatcttaaaatgttttttcatgcgcaggaacatgcatcagagacatcttatttcaacgaaggagctagattttatgagtattcattaattcctttacagttttgggcatgcaatagttgaaagaatccacacaattatagaggtcatcgacacgacattaccgtgcatagagattagcatggagttcccagcatataacgaggaaccaagaacgtagaaacatttgacaaatactatcaaagagaaaacgatcgatctcactggaaaaacatacaaaagctttaatccaaataacattgtctaaaacttaacgtgcaagtgtgtcacatcatcatccactagcaattattatctaaaatattttaaattatatgactcactagcaactattatgtggagtattttaatctccacatcattttcacattatttaaacatatacatttatctgatgtataacatacattcatccacgtatttcgcagcaaagtgcgaggtatcagctagttcatgtatatatgcatatgcaagtttacattgggtggattgtatcaccccatttccattattccatatatgcaatataatacgtgtttagactttgtattagtaggtatatacagatgaaatcgggctggaggattcaggaggcccaagctttagcggcttcgtctatgagcgtctggtacagctcctcagccacattgaggaggaaatggtctgcgccatgtcgtgccaccagcgaaactgacacaggaagaccattgcgcttgcccagtggaatactcacctgcagcacatacgcacaacacatcaagaacactactcacattttctaaaattaaaaacataaaaacactactcaaaggtggaactaatcagaaattgatagatcaagtacctggcaaaacccggatactacagcgatgtcgagaagggaaaatgctcttgcttggtaattatccagaggagcagcctgcgcctgaatgcccaccattggtggagggccaggaaccgtaggaatcgcaaggattccatgatcctatgaacaaacagggtaaagggataagaactgatctaggaacacctaatctgatactccctccattctaaattgatctacataaagttttttttgaggttattcctaaatgatctacatatttgtgttcattcattaagtctattcattatttgtgcattggagtaaatggacattgatgcatgcatccatgcatacaagtatttataacccacgttgtcggtgatatgggaccgggagtatcatgaccagaggcttgaggcagacacaatcgcccacgtggcctggcaccttcggggacgtcgggcccgagggtgaggtgtccgccctcctcctgatttcccccgaggggggggggtcgggttgcgcttgcccggccccgagggccgaggcaccccgaccccttaaggaagtctgcgccacatatatgggataagtgagcacagctgtgctcacctaacagcatttattgcagtctggtcaagcgtgtc

SEQ ID NO: 4351 - DNA, 17201 bp, Oryza sativa
  unsure (1)..(17201): unsure at all n locations
caaaaacacagagtagggtattacgcttcgcagcggcccgancctgtatacatcgccgtgtctcgtgtgtcttgcgggcgggtgatttttccacatacagagagagagagagcttgggattgcaccctaagcccttggtcgaaccggcaaaggggggcttacgcagtctcccggtgaggggccacgagctccgtcatctggcgcgccaggtagggggctcagtgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacttcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcgtcggctgctgcgcgccattcggccgccactccctcgtcgacacctccaactcgggaggatcagcatgagagccggatgcccgcatcgacatcgagcgccggcgtaataaccggcgtactccccgcgcaacggagggcgcctcttcgtccagagtgtcacctcgacatggacgtgaggatcagccctccgtgcccccggccggtggtgttgcctgtagagcctttgtggcgagtctcgggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgttggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggccctcaacatcctttcccccgcggcttttgatgccatcaaggccccggggatggtgctccgaccgtccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctaggtatgcccgcgttggtgaagttcatggcggcggtccactacgcctacctccagatgaagatgccgggccccggtggccccatctctgtccatggcgatcttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccggcggatatgcccggggtccccagggaggtgattgagcaccgtctcgccgtacgaccggatgcaaggccgatccggcagaaagtgcggcggcaggccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttatcatcagattcgcatggctagggaggatgaggagaaaactgcgttcattacccctgtaggaacctattgttatacatcaatgcccttcgggttaaagaatgcaggtcctacttttcaacgaactactcgaatttctttgggtagccaaataggacgtaatgttgaggcttatgttgatgacttggtagtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaacatgcccttactcagctaaaggcatatctcagctctcccccggttctagtcgccccggagccaaatgagcccctgctactttacttagcggcgaccccccaagtagttagtgcagcgttggttgtggagcgcgatgaagacaatcctcattccgcgcacccccaccctgtgccgacttggcccgggagcaagcagggaggagaggcccccgagtcaaacggtggcctaaggcccctgacgaccggagacggccctctgcccgcttgtcagacggtgctgagtgcccccgaccctcaggaaggccccgaggccactgcgggaaggccgcacctatcgccctttggccccgaggctaaccctgtgctgactcgacctgggagagagcagggagaagaggcccccgagccgaacggaggcctgacgcccctgacgaccggagttggcccgttgcccgcttgtccgacgacgccaggagtccccgaccctcaggacggccctgaggccactgtgggaaggccactcctgtcatcctccgaccccgaggtcatcggtacagaagacaagtgccccccaagaggccacttggacgaagaacgccccggggatacggcccctagcgaaggggatcggccccgccgaaaggtgcagcggcctgtctattttgttagtgaggccctccgggacgctaagacccgataccctcaggcccagaagatgctttacgctattctgatggcctcaaggaagctgcgccattatttccaggcgcatcgggtcactgtggttacgtcttaccccctcggccaaatcttgcgtaatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaattcccgaggccagcacggacccctcacagctgcctcaaaccgcccactgggtgatgcagttcgacggttctctgtctctccagggcgccggtgcaggggtcacgttgacctctccgaacggagacgtcctcagatacttggtccgtctcgattttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgatcccataggggagacggatgcgcctgaccggcccccgaggcccgtcggagtccaggcctcgggacccgaagggagcgctccaagctcccttagattgattgcttggatctctgagatccaaacatacctcacagatatgactctacctgaggaccgcgaagggagtgaacgcgtacaacgcatttccaaacgctacgtgttggtagaagggaccctctatcggcgcgcggctaacggaatcctcctgaaatgcattcctcaggaacaaggcgttgagcttcttgctgacatccatgagggcgagtgcggagcccattccgcctcgcgtaccctggttggcaaggcctttcgtcaaggattttattggccgacagctctcaatgatgcagtcgatctggtccggcgatgcagagtgtgtcagttccacgccaagcaaatccatcagccggcccaggccctgcagatcataccactgtcatggccatttgctgtctgggggcttgatatcctgggaccgttcaaacgggccctgggcgggtttgagtatctgtatgttgcgatcgacaagttcactaagtggcccgaggcttatccggttgtcaagattgataagcactctgctcttaaattcattaagggcatcacggcccgttttggagtgcctaaccgtattattacggataatggcacccaattcactagtgaactcttcggcaactactgcgaagacatgggcatcaagctctgcttcgcctcacctgctcaccccagaagcaatggcccaggtgagcgcgccaatgcagaaatcctcaaaggccttaaaaccaagaccttaaatattctcaagaagcacggcgattcatggatcgaggagttaccagcggtgctctgggcaaaccgaaccacaccaagccgagcgaccggggaaacgcctttcttcctcgtttacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgaccttgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggccaaccccgcacccccctcgggtgtgcaggattggccgggggctaccacacatgcacatatattcatttttcctttatttcagcatttcaatagaagcagtttcaattttctaaaggttgtgtctgtgccgttttttccttttgaagaatcttgacttgaaataaggtcactcatgcttgaccttgccctcgggggttcggttcggtcagctaaaatcgccaaacggggcccagaaccgagccgtgccccggggcgtggtgaactccgggggggaatcggcaaaaacctacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggggctcattctgacgcgcccaggtcgccggcctcgttgccaccgtcgcttgcactgctggcgttcccctcctcgtcggagtcgggggcgaacgcgagccgaggggccgagccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctacgaggcgggcggctaagtcgctttcgcccgcggccgccccaccgatatgcgccctcgcgtccagctccttttcccgtgcctcgaggtcagcagcccgctgctccagtgcggctctctcggcgcggacgcattcaagattgcggcgcgcctgctcctcctgcgccgcctcgcggagggacaggctgtccgccagccgtttggtcgtggcctcagcctcctcgagagctcgctcccgctcagcgagtgtgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggagaggtgggcccaggcgatgtgcccgcggcctcgtcgcgagcctccctggaggctgtcgcctgagggttgcccgagggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcctccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcaaagaaagagttagagctcaggcggcgaaggcaagaggaacaatggcgaaaggaaggaagcaaatccttttctcgatgcttttatacccttgccatcgctggccctggctcctcgtttctcgcgcccactacctcgctccctcgtatctcgctatctcgctccctcgtttcccgtgcccacgcttccactaatcccattcgcccgcttacggcgcaggaagtggatatgcggttgtggtaatcgaaatggattgtatcgtgcgcgcgttaattacgctcgccgactgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccatgtggcctggcaccttcggggacgtcgggcccgagggtgaggtgtccgccctcctcctgatttcccccgaggggggggggtcgggttgcgcttgcccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttaaaaagagaaaggtgcatgtggtatccccttgagatataaaaggaggaccttgcccatttagaggggggtttttttccttttttggaaggctgaggggaaaggaagttaatcctttgtaacttgtccatacacaaatccacaaaaacacaggagtagggtattacgcttcgcagcggcccgaacctgtatacatcgccgtgtctcgtgtgtcttgcgggcgggtgatttttccacatacagagagagagagagagcttgggattgcaccctaagccccttttcgaaccggcaaaggggggcttacgcagtctcccggtgaggggccacgagctccgtcacacgtgcaatatcctgatttgctattggctaggaaatagtggggatggtgcatgcatagagtttgttgctagagtaaatatagtatgagagagttattagctttttttggtcttagtgtacctatgaaatatgtatatcaatttggaatggatggagtactaacaaacacacaaaaaattaaaaataaataaatattgcctgcagaagaatgcaggaggaagtcattctttcagttcagttaccttgagaagagcagcaagtgcagacttgaattcggcccttacggctagaaattcctccaggggttcatcatcccctgatgcaacggccccatgtatgttctctcgtaatccagggcctaggttaggttttacagagttaacccactctgcatggtttgctttgaactgagacctgaaatgcacacagttttagtgttttatttgatctccctgactccccgtcctatattgcaactctggctagtgaactagtacaaatcttatcactagacaacggatatgccgctaacaattatcagatttatctgcctgaattatgaacaagatggttggtgcaccagagtaacagtagaattccaattaaaactgtttggcatggtataaccttaaataaatacagagtattaccagcagcattactggttaccttagagaaatgttactacactagcaaaatgctcatgctttgccattggtaaaatgtccatactttgcgttgcttatgcttatttgaatataagttactcactttattcaaacaaacattagactattacataaaaatatcaggagcttatttgtaaaacattttgtcttttatagtagtatagataaagatatcttgattgaataagttgtaagtgagacctcagaaggctgaacatgacatgtgaaatgacagagagagctggcacggaaggtagttcgctttcagagaagtcagcaatgaacttccctatgcttggaacattgtcagagacgaagtctccaaggttggcattgtctattgcgtgacctgtgaaaaaaaatccccatcagacaagatgtatggtagaaagcaagaattttataattgtaagctacaacatgagtcaatagacgatttggtattactcactaccaaatttcttggctactgaagcattgacgatttgatatgtatggtcatcaggagaccctaagatttggaaacagtccatgggaattgtgacatgagttgggtgcttgacagtgtcatcaggaagtggcaacaacactttggttacacgagacaacgtagatagatctctggcaaaccaacctgcataaacaatagagtttttcagataatggaaatgattcacatctccagtctctaccaacaggctcaaaaccacttagtctaaaaacgataaataaaaatactcgaggttattttccctcgtaatgatatccaatttgaaaaaaaaagaagaaaacacatagattcaatctataacgatgatatataggaactaggccaattgcataagcaacaattgcatgaagaaatcagaaaaactcatcaatcagcaccactctgaatagttgtcattaataacagttgcttgtttgctcctccctgtgattgtgctataatttgaccagcataattatgcagtaaaatcaagtgtgtaaatttgaccaacaaattatacaagtatatagatgcagtagaagacattaatcaattaatggtaagagggaaatggaagtgaatagtaataataattaccaacagtatcaaacatttgtgccatggggatgacgttttgagcggaaacgaggccatgggaggtgcggaggccgaagatgccgcagtaggcagcgggcaccctgacgctgccgccggtgtcggtgccgagggagaagtcgacgaggttgggccccccgggngggnnccngnaacgggcganncggncggagccactggaggatccgccggggactctgccgggggcgcacgggttggccggcgtgccgtagtgcgcgttctcgccatagatgctgcgttgttgcggccaagaaattcaatcggattaattcttggatttcttatatatacacccctgacctacctgtatgccatctcgtccatgatggtggtgccgaggctggtggcgccggcggcgagcgcggcgaggacgacgggggaggtggcgccggcgggcgcgtgggtcctcgcccagtccgggttgccgaacccggtgacgcggccggcgatgtcgaagctgcgaattaaccaaaccaaatcaaacagtgagtcgtcgtcgtcgccgccgttcttcatttgagcgagcatgagtagtacagtacatgtccttgatggcgaaggtgagcccgtgcagggggagttgctgctacgacggcggcggcggcggcggcagcacgaacctctccatgaaggcgccgaagtcttctgccatggcgtcgcgacgcgtcactctcactcggcggctaccgcttcgatcacttggtcctccactcctcctctgcttaatttattaaggcggcagagcggctgggcctgggctgcacggcggcggcaaatggaggcccaattagcaaaacagcagaatataggtactgtatgactgaattatattccttaacattaaaatatatatttacgatcggaacaagtttttttttttttgagtaacaaatctggttaaagataggaagtgcaatgcttggaatcaaatgtactctaaaaatgtacacggccgctacaggtggcgtgtcagtattgttgtcacgccaagcaggctgacagttcagattttagaaataatttttgaaaatattattttttaaaatcaaaaaggttcaaaaaataaaaaagcctagtttcgacaagatcagcacgatggcacaacactgaggcaatataacgagttggtttggtttgtggcctaaataggtcattgccaaattttagtaatttttggcatgactaattttggtaatgcaaagttatgtttggattaaagccaaaatagcctaagttcactattgaaatggcctatttttttaggcatgccaaaatttggcttcaaagcaaatagatactaaacactattaaaattgctaaatattggtaagtctaatttaggcctcgaaccaaaccagcccaacataacagcagaaactatttagaaaacttcgcgtgcatacgaaagtcctcattggggatagagggaacagaattttcaccgaaataaaaattccttcagaaatgaagcggattttttcttttggcggtccaagggagtcataatcccttgtcacggtaattccctcatcacatattactagtagcagctctctatgtttaaataaacatgaattgtgtcgtttgggtgaagcaaaatcatgctgctcccctacaccgccggttcaagtaaacattatcaggcagcatggagctccaaggctgggcacaagctttgaagagagatgaatggtgttagccgttttcagctcgatcataagcattggatttgtgcttgggtgtaaacgtaaacccttctggaactttgccaagcaacatctctgagatcctgatctgtacgtacattagacaagatatatattatcagcttgtgatagctagtaaaagatagaaaccatccaacactcagaacgaggacagcttacccagtcagctgctgaatcagagatcattagggtttcaagatcatcacggccacagtagcttgggggcctccagttcaaacgttgcgggatcacatccaacaggccaaccggtatgtagcggcaggtgtagcttagccattctagtaaaaaatagcgtgttgtttcaacacctgaaaatacacatgataatttgatgatcaagacaaccctttcaaaatcaatttgatttcatgccgagcatttcagtgcagcaagaaaaaaaaaactgtaactcgatgatgagcagatattatcgcattccaggcctcacaaaactcataatctgagccaatatctggcaatagagagaacctacctttggaatcggaaccccagtgttccagaccaaaactcacaaaatctttaagaatattgaatctctcgccagatgtaatatcccagtgcctttgttctttaacctcagtaaatatccaaggctgtcaggtgaaaaaaaaaaccatgcattagcacaaaattagcagacatgaacttgagggaacaaaagcctgacattacagctagcaattatagcatttttctcatgatagatgttaaagtacatatactgcagcaccaaactaacctttatgagtgcacctcgagcaatcatgcttgtcgatattttagagcagcctgaaacatgtttgttccagtcagtaaaagagaatacatcaccatttccaacgacatgcaactggtcaggggctttctggcacactggtaaatataatcccaatcagcaagtttgctgtagcgctgttgccgggatcgaccatgtactgttatggctgacgcaccccagtcatagatgtcggaaactatagaatcagcacggttccttccctcaaagaaagcagttcttacctggaatcaagcaacagagatcaatatgagcaaagcagtgtttatttccattttaatatgtcatacatgtcttagcagccccctccccatgtaccttatctctaattaaactttgcattgattaccgatcatgagacataaaatgttcaagcaggctaagtccacccatagatagttttccttccaaaaagtacgctaaacatgtaaaatatttggtttttcaaagctctgattctagttcaaccctgttgaccataaatgtgacaatgcattggcagatcgacatctggatgaaatcaccaaagccagaacttttgtcctcaagtgctaattagctcctaacagagtataactgagctactgcaccattaccttaacagttaaaggtttttcagtaacagtggatgctgcttgtacaatacttttgatcctcataggttttgttagcaatgatgatccagcacctttgttgacaacaatatcaattgggcaccccatatttatgtctatgaaatcaactgaacattcgttatccacaagttcaacggttcgtgctactgtatctggataggctccacaaatttgcaccccaaacaaatcctctgatgaatgccgtcgcagcaaagcccactctgnnnnnnnnnnnnnnnnnnnnnnnnnnnnnnnnn

SEQ ID NO: 4352 - DNA, 438 bp, Oryza sativa
aatacaactaatattcataatacccataatacccttaggaaaccctatccatccacccaactatatccacatttctctctctctccttgtggcgaccgcggcgacttgcggcggctgcgctgatggggcggcggagacagtgagccggtgccggccctggtaacgacgacgacgacgaggagtggcgacgacaagttcttctctcctccacggatccaccacaggagaggcggcgagacggcgagccggcgccggccctggtgacgacgacgacgacgagcagtggcggcggcgagttcttctcctctcctccacagatccaccacaggagaggcagcgagacggcgaggctgagccggccctggtgacgatgacgacgaccaggagtggcggcggtgagtccgggcggtggggctcgagctgccgtcagcggatctg

SEQ ID NO: 4353 - DNA, 419 bp, Oryza sativa
aaggggatgctcaccaagcggcccgcggcggagataggtggctgacagagggaggcgagatggcggcggcatcccacgggcgaggacaatggcgacgatttcacggcgtccggcataggaggaggggtggccgagggtcggcgaaacctgggaagcgatttgagggattagcgaggagagtgggcgaccggagcggcgagaaaaccacgccgaagatggcatttgaggcggaactcaccggtcacaaagaggaagggaacttcggcgcgtttccggcgatgggaagtggtagccgacgagcagtggggcgcggcgaagccgacgacgacggcggcgcggtttggaggcgacaggagtggcggcaggaggcggccggaggcggcaaaaacgacggcggccttggtttcgcagtggggagg

SEQ ID NO: 4354 - DNA, 84512 bp, Oryza sativa
  unsure (1)..(84512): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacgttctgcataaatttagaacgatcaaaaaaaaagataagtatagatattgtattctgtttaggcttaattaattgattcagaaaataaaatagtgaaataacaaaaattgcagcacattacaatgatacacatgcatatcttaattaacgtccacgaactgacctttcactttgtggcagccatggcccatgagccgctgtccagtttctatataaggcgtttgaactgtttttaacaatgtgtgtgtgcagcagagtttgcaatcttacatggcttctaacattagtgcagctgctcccatgttggtagaagctttcgatgcctcagtgtggggcgacttctttgtgaactatactccagaaccgttacaggcatgtttatattattgtttatgtgtactactcacaaaatttatgtagacacattctctagctcttaatatacataagttttcttacatatatgtaatttcagtatttttaattaatgctacagcataacccccaacacatatatagtacgttcatagtactcactttggaaatagattaaagaaatacttagttcatataaatgttagttttagttacatacgttgctttgtaagaccattataactaagcaacccagaataatttatatatcacatataaattaaggctgaactaatctaagcatccattactaaggacctcttcggattgagggatttttagaggattttcaagggaatactgtagatagaaaatatttcctttctgtcattcggttcatagaaatcaacccaaaggaaaatcagaggaaaaattcctttcctgtggaaccaatagagaaacaaaggaaaatttccatccactcctacctcattttttctatttcctatgtttttcctctgcctatccaaacacatgtttaccaatcctatctacagaattcctgtgttttccaatcctccgttttacacatacattcctatcatattcctacgatttttctattcctacgtttttacattcccgtgatccgaataagccctaagtgtagttagtggtagtctctcttctcttattaagccacatcgcctcagttatttctaacccttgaatgattatctatggtccaaattatcttccatcttttattctcttataaagtccctccttttccttctctcattgacccataccacattagttttgcttttgaataagtaatttatatataattgaaattgttataaaccacatcatattgattgtttgtagctttttgtaatagtcgatcaaagataaaatttatgtaaagtatttatgttatttctacagttattatacaaaactctcacagtagtatgcagggttttatctagttattaatgctacagcataaccccatcatatatatagtacatttttcatagtattcactttggaaataaactaaagaaagaattagttcatataaatgttactttttttaatggtacgcaccagacagtgcgaggttcatattgatagagcagaaaaaattacacgattacaaccctaggaggttgtaaccaggaaaacgaagaaaaaatagccacccccacgcatcgacagcaccaacacacatacccgggagaaagctagcatcaaaccagccaccgctaggccaacaaaggaactacagccgatgtctcccaaaacctaacactaacaaccgacaccaaaccctcactctagccacctctttgggattgagggaaagagggtgagagagaagaatggaaccgctctcccccctaggccctccgacgtggccaactagcatacgctagggcgccgacacaagaggacatgcatctagagagtaagcttgcaccagttgtctaggaggattttggcaagggggttgccttgacgacgtctccatggagaggagtgacaaaaacactggcgctgccatccgtcaaggtctcaaagagagacgagattgggttttcacccgacagccccattggagaagatgagacggcacgacaacgccctcaagagggaaagagaagctcgaaaacgccatcgttgccggccgggccaaggctgagcaaggttttcacccgccgcccgccgcctacgaatccacagttgacgcacaatgttagttttcgctatatacattactttgtaagacaattataggtaagcaacttagactaatttatatagcacatttaaattaaggctgaactaatctaagcatccatatttcctaatttgcagcagtctccattcgtgttatattcatttactgtatcctaccaaggatatgattaattatacatacgtcgggattgacaattaactaagtagtatgttgtaggaagaaaaaaaatccattaaactatttcgtcggaacacttaatcctctaaactatttttttactcgtttcccaccccaaactattgaaaaatttcactttacgctttaacactatttctcctttatgtttccctctacatatataagacatttttcactaaaattctggtaggatgacagatgcattaaaacatacatctcaacttttttttcgatttttcttacagtttaatagagaggtaagaagcacttaagacttatttaaacatcaagatttaaaatccaagcaaatagtcatgaaacattttgaaaatattttagctttgataatgatatcatctatggctctaaaaagttttagcttaaaatacaactcgtataaagagtaaaaaaaaggagataaatgaagtgaaccatttttaatagtttaattatgaggtaaaatgataaaaaaatagttaaggggggttaactactttagtgaaatagttcgggagagtacaatggacttcttttccctcataaaaaaatatgctagaaattcatatgatttgatccccttgtgtgttagtcaataatagtcagtgtgtgtgcagaagtcggaggaatggatgagggataggctgatcaattgaaggaggaggtaactttgctatttgaaacttgcaaggatgtggaggaaaaattgaaacttgtggatgtgctccaacatttgggaatagaccatcacttcgagagacgtattgccgttgctttaagcgacattcatggtgctgaattcaacagctccagcctccatgatgtcgcgcttcgattccgtttgcttcggcagcatgggctatgggtttctccaggtatagtatgtgtgtaaactgcaaattaacctaacatatataattggcattaactctaaattaatttgtatctcatgaagtggagaggctggatgcaatgggtcattttttttcaacatgtaaaagaattggattgaaatcgatgattttgtattcttgtgataaaaagatcccgcatgattccttgcagatgagttcaacaagtttaaaggcccagatgggagattcaacgctgaagtaatagatgatcccatgggcatgttgagcttatacaatgcagctcacctattaattcatggcgaggtggaattggaagacgctattttgctctcaaggcatcaactcgaaacaataatagcaagaaatctcaagtcgtcaccattatctcaacaagtaacacgggcccttcgaatacctttaccacggaccttgaagaggatagaggcgcttaattatatagcagaatacaatcaagagcaagcatgcaatccctctgtgctccaacttgcaaggctggattttaaccttctgcaacttcttcactgagggagctcaaggaattttctcggtatatttaattttcctaagtacttgtttcatgccacacattaatcccctctacttccatatagctagcactagtacagattcttctatctataacgggctctaatatgcctagaaatagcgggccgtcacaaggaagtcatctcaatcgggccgaaaagtgcccgattgagatatggtcatacagacatgttagatgggcataaaacttaagcccatcacggatgacaactatcagtgacaagccgtagtttaggcccgattgagataacatttcatttctcaaacgggcctaaagttgcagcccgtcacagataaccatgtgacgggcaccaactgtagtcccgattgagataacattccatatttcaaacgggcctcaagttagggtccgtcacagatgaccatcatccgtgacgtgcaccaatttgaggcccgtttgagataacaactaggcccgtcacagatgactcatcagtgacgggctatatacttaatctctatcgggcattaactaaagcccgtcaccgataagtatttttccatttttcatatgaagtgtttatatttgtaagttgaactataacaaaataattaagtgcaaaataataatttatttcatgagtcaaaataattttacgggtagtaaatgatttcaaatggaaaaaatgtcaacaacaatgttgtataacttatcaagatttacaacttttagtttggtcatttttctatataacattttttgaacagtttgaatttgaatttgaaaatatgacaacttcaaacaacattttcaaatactaaatgatttcaattgaaaaagtcatcaacaacaaagttgaataactcatcaagatctagaacttttatttttgttatttcttcatccgataaaatgttagcaatattattcacaaattttacatatatgtgttatagtttataaaaccagacgggagatatgttaattttgtgaacaatgttactgtcactttgtcgtgtgaagaaatgcccaaataaaaggtttaaatcttgatgagttattcaactttgttgttgatgactttttcagttgatatcatttagtatttgaaaatattgtatgaagttgtcatattttcaaattcaaattcaaacggttcaaaaaatgttatatagaaaaatacccaaaataaaagttatagatcttgatgagttatacaagtttgttgttgatgacgttttcggttgaagtcgttcactgatctaaaattctatttgaatttttcaaactgaatttcaaatttcaaattgtttaaatagagtcagatggagaaatgaccaaaataaaaattttgcacctcgatgagttctacaactttggttttggtgacttttccatttgaaatcatttaataaccccaatttgacatgttggcctagggcttaataggattaatagaatactcataccaacaagttacaactacttttccggaagccgatctccaaagaactttggtgttaagcgtgcttggcctgaagcaattttaagatgggtaaccgatcaggaagttcttctcaggtaaatttattgcccgtcacagatgaacatctgtgacttctagcctgtgacggacgccgtgctcgattgagatggggcttaccgcctgattaagatgatggtatcccttctagtgtaggatgccacgatatattttgtttgtgtatcactaacaatatcataaattaatttcttttccaatatatactagtcaatgacatcatctcaaattgtcacataagtatataggcaaatatcattaaattttcggagttgggtatggtattctttgtaataacgttgcggggatgtggtcattatttaagttgtcgtgaactcagatttgtactactagtgcaggatatataaaaaggccttccaactttcaaaaaataaattccacactattattctgacttctacgtggtttctctttgtatgatttactagttgatacccaacgctttgcagcgggatatgtgaataaatgcatgttatacattatagaaatgatagatgtgtatgtttaaataatatgaaaatgacgtagagataataatttgacgcatattaagttctaaaaatacaacaaattgtaaatgatatatcatgtttgcatgatatttaaaatgttctagataataattgctagtgggtcatgatgtggcatacttgcatatgctttaaaatactctagataataatagataataattgatagtggttgacgatgtgactacttgtatggtgtgctttagggcatgtacaatggtctttattagcggtctctctttgttgcattgagtctaataaagaaaagatgactagtaagaaagtattttggtatattaatgattagataccgtattgtcttaactattgtaacgtgatagcctctaattaacgtagagaccataccggtctctacctttgtacttgcccttaggagttagtggatatcaactatatatagatagtatagatatgcaatggaatattaatcagatgttcaactaattgatttagcaaatcacatcatcacaattccatgaaatgaagctgtgcatgcacacaagctagatatatgatcgatccaaatatgtacaattttctctccttctaataatatgtatattgatgtgcaaggctatttgtgcgttcaaaaaaataataaagacaattatgatttaatttattgcacaaagcacacattttatgaagatacaacaagctaaaagtatcccatattattttcaggtggggaaataatctatacggtgcagtggaactaacctactctcgagatcgtatagttgaatgctacttttggtcctatacaatttactacgaacagaaatatgcgcaagcacgaatcatccttgccaagatattcgtgctagcaaccttactagatgacacttatgatatgcatgctatattggaagagggccaaaagctcaatgaagcaatacagaggtgggaaagtatttttgcttactcttcctcatcccttaattaacggaataaaccatgctcatttttgttcttctagacagaattttaatgatttttttcccttccagaagaccatttactttaagttctaccattctagacatctcatgtttttttttcatgacaaaactacgttcatataattatatttttaatatttttatgaaaaatacatttttaaaaaaatgatacacatgtgcattaaagattgatgtgttgatgtcctaacgaagtgaaaagaaatggatcggagggaataattcttttttatcactagaatatgagtaaactacttgtgagaaccgatcctattgatattataatatatatggtcgcatccatcttgcaattgattaacttgtatgtaaactaaaatggttgtgcacagatgggatgagagtgccatttctgttttgccggagtacttgaagaattactatgccaagctaatgagtaccttcaaagagattgaggatgaactgaaatcagaggagaagtactacattacttatgctgtaaaagcggtacaatactagtactcatcaatcctttttactccatatgtatgtcatcctcgttaatgcaaacagagtcatatggacacttgctatgtgtgatcgtgatcgagccaacaaaagtataacaggcacaaaatcataggcaaaaagttgaagaacactcactatgtataatgtaggattgaaacatagcaagagccaaccaaaggtaggatgaatggtagtggtagaaaaaaaaatcttgtacaattgaaatttcaccgaaaaagaaaaggacaaaaaatggataactctttttgtatattgttctggaacaaatttaaagaaatcaaatcaataaaatcaagctgaattataaaagcaattctctctaatctcacagcataaactctagatgacaaagcaaaagtctaaagccctaatttttctatccacatgtgtgtccaatggggtccaggaggtgtgggacccaccaaacatagtgaggagagagtagaaacctaggtgcataaaacattgcgactatttcatgatttcatacaaaggggtgtaaagttcagacgtgtcatataggatattatataggatgtcgcatggagtgtttgggcactaataaaaaaactaattacagaatacattagtaaaccatgagacggatttattaagcctaattaatccgtcattagcaaatattcactgtagcaccacattgtcaaatcatgaagcaattaggctcaaaagatttgtctcgcaaattagtcgcaatctgtgcaattagttattttttagcctatatttaatacttcatgcaggtgttcaaacgttcgatgtgacagggtgtaaaatttttgtgtgggatctaaacagggccaaatacttcttccctctcatttgaatttgaatagaccaacctatataagtttccaaggcatgggcattgtggtgtgatatctacacattggcgtatccaaggggtggatgaggggaccacccaaatattccttggcccaaggtctatttattaaacaactgaggaattatatttgtacaattgaataaaaatttataagcaatgaagaattaagagttggaaacatgaaatgggtaattcaaaaaactaaatatcaaattggaccaccctaaaataaaattctggatacgcctctgcatccacagagtacctatagtttccatttgtcaaagtgaaaatgtgaaatttgaattgaattgacttgcttccagaaatttacataaaagaggactggttaaaacttgctttaatttttaaaggggttatattgatggacaaagttatgaaaaatttacattaatccaccgtaaataaactaatatttgaataaattatttaacgtgcatacttccgtagagtttgatgcaccccaattaggttttaattaattttcaaatttgactgttttgactgatttatttgacgtgccaaattttagttgttgaaatcaaaccaattttaccaaagctattagtaatgtctaattgtgagaattatcttcgaatttttggtggtacaaaacatgttgaatgaaagctaacggaagcccaaggaccagtactttccgctatatttggatttgaagggagagaaagaaaaaaaaagtgtagacgtccgagcatcggcagacaagagaaaacatgtatttgggatcaactaggagctctcagtgcaaataggctaaacagcatgtccgagtgtgcccgggagcgagaaagacatgatcaccaatacaggtttgggcctcccaaaggataatgaccctagtcttgttcttcatcactatcaagcaaattcgtaaaagttataattaggagctcttgagatagtaggaaactaggtttcttgcccatatcatgcatttcacccctctataggatctaaagatgtgttttttataccctacggctatcggctctctctcctacgactacgagagacaaaaatcctattatacaatcataagcctgagctaagtagctaactcctcgtatgatctattgtaacaataaatatctcatggggctccacgtcgagtccaactacagtctttaaaaaccattttccaagagaggcttggtcgtcttgaatacaccgtatcgcttagcattgctgagaggcaacttgaaggaatctatagttaatgcgatggatgggctctgcagcctgcgcatcgctcccaagggtgatgtggtgacaaacatccaccaatcttctatatgtgagaatgccacttggcccttaacgagatgacaaggggttcttacaacacgatatccgtagtgtagggtccaccccctttcctgggtgtgactccatggtgtaagccaaaaatgagtgacttatctgctccacttgaccatgttgctcaagatacacttagcagagtctcaaacatttagcttttcttgagctgacaaaaaaaatataaatcggttgaatgttcaagtacttgaatgctaattaatccaatgaagtggattttccttgttcacttagtggccgttgaaataattggagctaaaaaaccactaacaaacatagcatattatatattcggcttggatcaaggtgtcgcattaatttttattatcattcatcaagatttgtttttccttctcacctgcagtatcaaaggttatgcaagtcttacctccaggaagctgtatggtttcatcagaattacataccaagctttcaagaacatttggatgtgtccatcatctcctcgggctcttcaatgctatctgttgtgtcatttgttagtgccggtgatttagcaacaaaagaagcccttgaatgggcctttggttgcaccgatgctgtcaaggcttgtggcgaaattggacgcttccaggatgacttggctgcattcaaggtgtttatactattccatgagcaaagctgcagcaaattcattaatgttatcctctgtcggtgtccttttattttagcaaaatcttttatgttattttgacatgtgcatgggatataatataatcctctataaaatactactccatttgaactgagtaccttcgtttttttttatttgacattattagtcagttcaaatggagggagtaactaattaagtgtttgttggtcacagcacgggaagggcaaactagatatggccacctctgttgagtcctacatgaaggagcacaatgtcactggtgaggaagccacggctgtgataagtaatctggtcgaagacgcatggaaaactatcaatcaagcacgctttgagcgttcctcgcttgtgccggctgtgaaccgagtcgccaacttagcgatgagcataatgttcttctaccaaggcagcgaagacgcctacaccttcaacaagctcagcatgaatatcatcaagcagctgttcgtcaagcctatccccataatctagatattatactacactccatgtgccagcagtgaattcctatagtaaacatgagatgcctagatgatcttgtcatcatgcaacgtctttaattctttgtgagtgttgaataattgtgtgcacgcatataattaggtgtttgtgtcctcgcaaaaaagaaaaaagaaaaaaaaagtgtttgtgcttgcagtttgctggggtgttttgttgtcgtgcgtggcaaactgtttgccatgacttgtgtaattctccctatatttcagttcaaatggatcagaaaagatgcgcttgttgaggcagcacaaaaatctgtgttcatctctgttttcacagtaagtgtcatttcgttgaatacatcactgttcatcaaattgcaattttcgacgctgagtttggactgaagagcaaataaaattagttaataatctagggctgcttggcgcatgtatatgtgtgctcagtgctcatgtggttttcctaatattaccagcttgttcagagaacgtatggtattacggaaagtactacttactcttgtgtgctttggattaaaatcctctaacttattttcctctaacttgtgtcattgatatgtgggctctttacctatcgggtacacatgtcaatgactcaaagtcagagggaagtaagttagaggatcctcttccgtgtacttttgctgtttcttcggctccgtccattcagtccatggggtagaagctgaagagttttagcaccttgtataagtaataggtctgaatacgggcgtaaaatggatatccatcttcttttaaagaaaaatgatcagctttatctttaaagcgcatggtagatagaatcttgaagctgacagaaccgtcaagtttttatttattgaatcagttgttcaaaagtataaaaaaaaaagattgagagcatcaaaacttacaaatccaatgcaaaggagacggctgacagcccttgtaataagtttggcaaatcaatgaatcaagcagtttagatgttaccaggttctcccatcaggcattcaacaggtaatagtggatcgctctcggacaagcagcgtctgtcatcatctttacagttgcatgtcgtgtgttgtcagatgcttatacttctgatccacatttgatgatcttgcagcctctgtcaaacccttggtaacaaccaacttaagaatctcaacaccctcttctatggctgaatcaatctaggataaaacaaaacatgcaaagcgtaagactacctgtcacagcacaattcttcagggtcgctacatacagaataataaaaactgtgacagtgaaataattatgtcaaatatggtgcttccagaaatatgatgtaccagaatgattccatggaaaaaaacgctaatgagtgacagagattgtcataacaagtcctccaagtaccttcaggaaccccagcagttcaattttgaggacatggtgacattattacctaaaacaatttgagatttaagagatctcaagggctgtaaacttcacaggattggcttggcacaccacatggaagttgaccagaaggtaatcttctaaacatagacatgttgcaagcctataaatcatctctcatttgcgtatagcacaacaaaatttattcagatttaactgaagtagaataaatctaggtgcggctcacttccatgcagaatatagccatggttttggtcatatggatatatcccagcaaatgagcacgatcatccggtgagaattatgaaagtaaatcatccaatggttactgtacaaaaactcagaaaagggcatgacgctaacaagtactagccatatagatatttacccgttctcgaccggtcttattaaacttctggagcacaaaagctttggggtccatttggccaggtgggcgtccaattcctgaataagttaaagtataagaaattttattcacattaagggggggaaatgaacacagatgtcgaacctaccaatccttaatcgaacaaattctctggtcttaccaaaatggtatatcaagcctcttcaccctgataagcttgaaaagtgaatattttggcaatgtaaaaaaaaacttatttacaacagaaaataggatcatatagctaatagtaaaataaatgagtaaaataagagaacactaataagagtgtcattatatctggtagacctttcaagagaactatggctgtctcaggctatgtaaaagggaaaaaaaaagaacatgtccatatggggaaaatggaaaggtgcatgcagaaattgccactacaaacgagaaaaatttattaagtaaaaatattagaagggaacaatatgttgtctcttcctgatgaggttgtcagaaagttgcttatcaggtcagtcttttaaatgacaaattaatttcaacaaattacttcattaaaacacatgattataaaatcaacagacccattatggcgcccatatcctcctttaggttgtaaacgaagaactccacagggcaggtccatgtcatcaaatgcctaaaactcacaatagagaaatcagattgccatgtaacttagcgctcataaagattagatattacaatactaaccacaaggacgcgattaagtggtaatttataataggcagcaagtggcccaacctgcaataggccaaaaagggacttatcaccaatagtcatcagatcaggctcagtgtattataaccatttttttatttccagttaaagaaatttctacaagctgaattatacacgacctttctataaataagacacagaactaaccaaaacagacattggtatgtattttattctgtattgagatttcaagttcaaatcatagcaactaaaatatctgattgctgataggattttggttgcaccaaccaaaataaagctcagacataattgattttagggggaaatggttcttagcaaatcattgtgattcaattagcaccataagaaacattcatgcattcatcaaaaacataattgattttgttgagggcttgaagaggagacagaactgttggaagataagtagtggcaataaaccatgaaccagaacggttgggttttagagttcagggacaaaaattaaaccatgccaagagttgacacgaaatagacttattccaagatagtaaggaatagtagaaatcagatactaaaacatggaaagacttctaaaagtgatgcttacagattcaccactgagattcatatatgtttgaggcttagcaagcaaaacaggtacaccttcgaccattcctgcatcaatggaaagacaagacaacagtttcaattcagccctttcaaccgagagaacagagtatatattgctcaaaatataaaaatacattctctatgggatcagatgtaatgaaccagaccttccccaaatagtgccttgaagggatgcctggttagagatataccctgagactgtgcaaacatgtctatcatatcaaacccaacctgcagcgaaaaagggtgtcataggattctgaaaataaatgaccaagacaagaatgagatgcaaagcttacattgtgtctggtgcattgatacttctcaccagggttgccgagaccaacaaagagccatggatttatcacggagcatgacgaagaagatgaagataatgaggtctgagaggttgaagcatgacgcttggatatgaaaggggcaagtcttgtccaaagctttcctcgcatggctttactcgacgttagtaattccaaacatccaccagatccaaaaacagatgcggcagtctgcagcagaagaccagattattctttcggacacacaacagaaacaatagtatacatagcaatcaaaatgatgtggactattaataagcctcgctcattcaacgccaatacggcaatacacatggcaatcatggaaggaagcgcgccactaaccatcgccatgcggcacgggcattacgtcgaacagctctgatgcacacctacacggggaagtctaattcgacgccctaatccttgtaaatcacacaggtttagaggctacgcgacacaagatcgtcgagatgctgcttacatatggcggggacccccgctgcggagtgagcggcgacgagggggaggaagcaagcaagcaagcaaggagggcaacaagaaacggccggtcccctccgaggcacgcggcggggaagcaaccagccagcaagccgccggcgcaaaggaggcggacctcgagcgcgagaaatggaggcggcgatcgccgaggagggaggcagcgacgccgctgggcttggggggaaggcgctttcggagctggaagcgagggaggcggcggcgctcggggaagggagagggacgagagtggcggcgaccggcgaggatgttgggccctgtgggctatggtgcaatttctccctgggtttgggccgatttggaccagtatattttacttttggaataagtccacttaggccctctttgtttagacttataagccaacttataagtcaaaaagtataaacctaaacaaacaaacagcttttttgtttggtttttttaagccataagccactctaacactattaagccaaaagctaggttggagaagcttttttggcttatgtgagatagatgcatgactccaccattaaacttagaacattaaatccaccggcttataaatcatataagccaataaactgacttaaaagtctaagctaataagcctaagcccaaacaaagagggccttattatccctcaactttacgtcgagctcgtttgacatccctaaacaaatcacttttaaccgaaaattcatacatggggatttacagaaaaatcagttgagttttcatggaaaccagaggatatgtaaatcccccacgttccaaactccaatttccaaaggcttgtgctggccaaaagttgcatcatatcattcgttcatgtgcatgcacaagcacagccgggcggcgccggcgacgattattagcctctctcttagcttagctccggggagattataaaaagagcccccaaagcgccgaaccgccgtgcccttttttgctccatcaagcaatgcggtgcactgcagctcgcgcggccgactgcgcccctttccgccggcaaccgcattgcgtaaatgcgtactcctactacgtacccagcagcacagatcatcatcatcagtagtaaataatactccctccatttcaaaatatttgacaccgttgaatttttagcacacgtttgaccgttcatcttattaaaaaaatatgaaatatgtaaaactatatgtgcacataaaagtatatttaaccatgaatcaaatgatatgaaaagaataaataattacttaaattttttgaataaaacgaatggtcaaacacgtacttaaaaaatcaacagtgttaaatattttgaaatggagggagtacttttgtccgcgtagcgaatcaggcagcggttgtacacacatgtacagatcgatcatctctagtgatcagattaactaattaactaactagctttgatcacgaacaatgcatgataggtttagccaaaagagatcgagtagttcagtgatgagtctaagcaaattaaagatggtgatgatgatgagacgccttcctttcggcctgccatgaccatgagcatagtactgcataggagtacatgaccaattggcgcctgtggcctacgctaacccgctaacgcctaatgattccaagcgagagagtcgcagtccccatcgatgcgccagtggcgagacgcaggttttctccctctctcgcgtgttcgtcatgtgttccgttcgtcctctctctcacgtcaggtcgtttcagattagctctgaaatcttctcccggacaagttgctatatatccctgcattgctggtcatggggagcagtccggcatttgggggaactcaaacgttgtctgtgtctggcaataaacgcctgaagctcaaagctcgatcgatcagagagaaaataaatggagagagggaacaaaatgtgaaggatgatttgtgtaaaagttcttttttactaaaaaaaatagagagagagaatggttagtggaggttgctgttcacaaagtgaaattctgctactcaatgattgatagcctacgaatgtgatcaagcatcaaagttatactacgagccagtacttgaaacaacgagagagatcatcttagaattcagtaaactttaagctagtgagtgtatatttaactgcagtactagcagtgctgcttttcatgatacctgcatgtgtgtcctagcttgtttagtaatactcctacttaacagtgcaaagagtagcattaggatgaggataataataatagtctctatttctgaagaagaaaggctgaacacaatcgaatgggagcaagcaagcttcagtgtcggctctgtcattttttcaaataacaacaagattcttctgctctttgccaccctccttatgatttccagtctgactctgacaaaatgctttacactcacacactaaagaaatgtacttagccaatatagccattaggtagtttattaaaataaaccggttggtgacaacctactacatagagtatatagattggcaatttaattaggttgcatggcccacatgacagagaggagctaatgcatatgctggcatgctaagctttccaggcaatttgggtgccaaagaatacctacccttttgtttaactaagccttggcctttgcctttgcttctcttttgccttaagccccctcttttgatcctccttttggcttataaaaaacccagggcttagtcatgcaccatcatggaattttcactttcttgttaaacgccaatgctggtccacgggaatccagcgagtaattgcatgcaacaactaagatatcaatctttgttgttttgttttatgatcaaacataatttaagatactagtagtctcatctcaaaagaaactaagatatcaatcaagtatattaaatacaattattccccttcactttgtagcaggctattctcaatatggaatcaagatcctctgttggtagcaaaaggaaattacaaaactttaagactacaaaactcaacaagcaaaagaatagcacatcaagatttgccttaaaattaacatttctcatgacttaatgtgcattatgcaaactaccctgctgatgataagcctgctttggagtactccacatggtaatttaagatataaacattgtgaaccatatcttatacagagtcagtgccacaaatgatttgcacctcacatggcaccaattcaaccagcagggggcagcttttagaccagaagaataacagaaagccattgcccgtgcaaatttttatggcagaaagtttgttcgccctgggatccccacacacatacttcaaaattgggagataatcttgaggccagcggtatgatgagatatcagaccaaagtttagattcaaccatgctgagataaggtgacaacaagagcatcacattgttcatcacaaaatgccgcttgaggttagcaagaataacaaggtcgatcgacgataagcatttctggagttttacactcagtttattaattgaagctgattaatgttctactcatggaaatgaccgagtgtaaaaccgtacattaagctcagatgtgagaatagttcagttcctataaaactcctgtgttccaaaggagacattattagaagaaaaaccgttttatcacttgagggataattgctcttattatttgcaactctagagcttataattgatacctagctgctgtcacgtcctgatggagtagtgacggcactcgacagaaacagcaatttaggcgatggaatttggcaacattccctgtatttttccctgttcattgttcttgtgccactttgatccatatatatatatatatatatgattaatctttttccatgacacatttggcatgaatcggcatgattggagctaaccattttcccttccggcagttcttaccctgcatcatcagagtggtcattaggagagacaagaagcaactgcaggaaagcctacatgatgcgcactccccccccccccccccccaactccttttttcagattgtaactcatggctcatcaatccttcctagccaaaatgactctgcagcagcagcttgtgtgccctcaccatcatcatcatcatcaagatagccaaaatgactatgcaaattgcaatagcagcagtgtttttgttattttgtactactactactactactactagtagcaacttttgaacagagctagcttagcccatcagatattcagaatttcagatactcactcatgcagagtcacagcttgtatagttgtaatgcatgcatgtagctctagctttacgcacgcactcccacaccgcacactcgccagttagcccttaaatcctaattataagatttaagacctttctcttcacttcacctctctctctctctctctctctctctctctctctctctctactctctccctacaagtttcttgacacccaactgcaagtctgcaaagcacagaagaagcttagcacacgcttgcagctgaactaggagacaaccaaacaagccatccttttgcactgatcacacttactgttagtactccattgtgatttgtggagagagagagggagagagagagagagagagagagagagagagatgggcgtggcgacggtgacagagctgaggcagagcttctccgggaagagggcattaagaccaaccctcaccagccgccatgccaatgaatggtgagtacgccattgttttgatcattgttcatgtcacctgtccatgaattatggaagattttgcatgacaatcagatgaattatggatgattttgcatgctaaattgtgacatggatggtggccgtcttgttcttgcatgcaggcctccgaccgacgtctccagcgacctcaccgtcgaggtcggcacgtccagcttcgccctgcacaaggtaagagcaggttcatcttcttcttcttcttgttggttgcacgaagaaatcgagattaagaatggtgtgctaatggcgacggcatagctgctcgcgcagttcccgctggtgtcccggagcggcaagatccggcgggcggtggccgaggccaaggacggcaagctggcgcgcctcgggctccacggcacgccgggcggcgcggcggcgttcgagctcgccgccaagttctgctacggcgtgggcgtggacgtcacggtgggcaacgtcgccatgctccggtgcgccgcgcactacctgcagatgacggaggacttctccgacaagaacctggagctccgcgccgaggcgttcctccgcgacgccgtgctccccagcatcgccggctccgtcgccgtgctccgcagctgcgaggcgctgctcccggccgccgaggacgtcaacctcgtcccgcgcctcatcgccgccatcgccaacaacgtctgcaaggagcagctcacctccgggctgtccaagctggaccagctcaagccgccgccgccgccgcaggcggtggtggtggccgccgccgccgccggcgacctcgactcgccgggggactggtggggcaagtcagtcgccggcctcgggctcgacttcttccagcggctgctctccgccgtcaagtccaaggggctcaagcaggagacggtcacccgcatcctcataaactacgcccagaactcgctccacgggctcatggcgagggacatcgcggccgccgccaaatgcggcggcggcggcggcgacaccgacgccgtcaagaagcagcgcgccgtggtggagaccatcgtggggttgctcccggcgcagtcgaagaagagccccgtgccgatggccttcctgtcggggctcctcaagacggcgatggcggcgtcggcgtcgagcatctgcagggccgacctggagaagcggatcgggatgcagctcgaccaggccatcctggaggacatcctcgtcgccgccgggcccgtctccccccgggcggcggcggcggcggtgaagcacacgctgtacgacacggacgtggtggcgaggatcttcgcggtgttcctcaacctcgacgacgacagcaacgacgaggacgccgtcgtcgtcggcggcgggtgcggcgcgttcgactacgacagcccgaggtcccccaagcagagcctcctcgtgaaggcgtcgaagctgctcgacagctacctcgccgagatcgccctcgactccaacctcctcccctccaagttcatctccctcgccgagctcctccccgaccacgcccgcctcgtcaccgacggcctctaccgcgccgtcgacatcttcctcaaggcaagcaagcaagcaagcgacattgcaatcttcttctccgatacgactaactctcgatgattttgatcgagcaggtgcacccgaacatcaaggaagcggagaggtacaggatgtgcaaggcgatcgactgccagcgcctgaccccggacgcgtgcagccacgcggcgcagaacgagcgcctccccgtgcagatggccgtgcaggtgctctacttcgagcagctccgcctccgcagcgcgatccaggccaccggcaccaccaccacaaccactaacaccagcatcggcggcgcgcacgacgcggcgctcttcttcgggtgcgccgccgccgccgcggcgccgcggtcggggagcggggtgggtagcggggcgatgtcgccgcgggacagctacgcgtcggtgcggcgggagaaccgggagctgaagctggaggtggcgcggatgcggatgcggctgacggacctggagaaggaccaggtgagcatgcggcgggagctggtgcgcgtcggcccggcgaaccgcctcctccgcggcctcgcgcggcgactcggctcgctcttccacttccggggcgccgccgccgagccgggcctccagcagctcggcgccaaggccaccgccgacgccaaggtcctcttccagcgccgccgccgccactccatctcctgatcatggtgacgacgatggtgatggtgcaattaatgaatttttggatgttgttgttgttgtgaatttttgtgggatttggatgcgaatttgcagttgttgtaatatggggattgttattgatggatggatggatgatttcgatgtaggtgtacaaattaatgtgcagattatggatcatatgctaagtttctgtgatgtataagatggctgattgttcttcctcttgctgagagtacaaagctactaacacatttaaaacatgtcacgcatactaactgttgaaattctcacacaaaaaaattgttcaaacagcaaatcggaaaataaattgttcaaacaacaaagtagaaattgttgaaattctcacatatataaattgttcaaacagcaatgcaacaaatggtcaaattctctcacacacagcaatgcaacaaatggtcaaattctctcacacacaaattgttcaaacagcaaagcagaaaagttcaaacagcaaagcagaaaagtctaaaaaaattataaaaaatatcaacaaagcagaaattgttgaaattatcacatatataaattgttcaaacagcaatgcaacaaatggtcaaattctctcacacaaattgttcaaacagcaaagcagaaaagtctaaaaaaaatttaaaaaaatatcgctagaggaagggcttgaaccttcgaccttgtggttaacagccacacgctctaaccatctgagctactccagctacctgtccttttatttctatccttatttttatattttttttctgacagaggtgcactatcaacagagtaaattcgctcgacgaatcgataaattacccctgagagtatagtgtttcattatgtattacgcaaggagattctcaaaaattacctattttcttaatatattcaggtggggattctctccccccggtgattctctcactggatcatttgaatcgaccgtggtcggaagcacagcctttttcctccacgctagatgttagtgtgcgaggaaggccaccagcttggcatgctcaatctaacagctccgtgctccagggctccaggccatctcgcctccacggaccatggttccgccctcgtctctttctccctgagattgagcaccactactgtcgccctccaacatgcccctgcagcaaccctcgagttcgctcccgcagccacaatagaccatgccgtctgccgctgccgagttcatcgactacaccatcttacacctcgcctaccgctgtgccatggaggatgaagaagacgtaggggcagggggaataagtgacggaagttctaacggagtgctaaaagaagtagcggagatatactattaaagtgaaccacaaactttcaatgctataaaaacgaaaacaagaactttcgatgctatagaactaattttgccaaaaagacctatttctagatttacattgcaaatttgcattgcctttcttgggctgtgttgggccgacttctgaacagaaactgacccaatctcacaagaacaaaagttgcaagcttctaattcaaactgtattgaccttttcgattgggctcatagcacttgaagcccaacatgtgcttcacaaggcctattttttttttgttaaacctattttttatatataaaaaggaaatgaaaaaggtattcatcccagtaataaatagttggcatttaggatgattaggtcaaactttattcccatatattgtttagtttaaaaaaaataaaaatgttatacatagatttattatatttaaaaatacaatataataaaattattaaatattataaatttattttaagatatttcttgaaaatttattattcattaaaaatccaggaatactgccagggctttgcctagcagtttaattttaaaatgaaagagaatatttacaaagttacagggaaaagaacaaaagtgaaagaaaaacaggattcctatatagtttgtatccaatcggaaactagttgtttgagaggatctttcattttgcacatatgcagaagaacttttttgaagagcaatctccatgattggaaggtgggctgagtatattcaaagataagtccattcctttgcttccagatatgccatgcagccaagaagaagatctccagaaatccccgatgtacaaaccgaaatcttgccaggaccaccatctgaaaaaaattccaaatttcggttctattggatccctaggtgttgccaacaagttgcactaaatggtcatgtgaaaaaaagatgtagtcttgtctctctctggccagtatcacacaagacacatgtaagatcatcatcttctttggcgcagtgccgtctgtccaacatatcacatgtgttgagtctatcgcagaacaagagccatgcaaaaacttttatcttcatgacacactttgtcttccatagccacaagagaggtctggggggttgcaaagcagtgaagtttggtttgtaaaacctctttggtgtgtaaacatcagagttccatataaagctccagatgtcacctcttccagattggatttttaagctatccaagttttcttccagctgtaggaactcagcatatgcctcaggcgatagggggagtaagaaagaatcttccaattgcctagaacacatatccttgaccgaatcttccttatacttggccacattgtacaaatgtgggaagcttgtgcatttgaattcctcattccaaagatcattccaaaagaggacagttgagcctgactgtattgtgcacttggctatacccctgaagacatctgtcagaacaataatatccctccaccaaaaagatcctttattcatgattaaatgtgggacttttgaagtataatatgattctgaaatcaatttaacccatggcaaatctgcagctttgtaaaactttacaaggtgcttcaagaggagggcagtgttttgcactctcaagtttcttataaaaattgataaccaaagtttaaagtttgacaacttgcaaataacattattaccattcgccttatttaaaaacaattatgtaactattttttaaatatataacaccgttgactttttatatacgtttagccattcgccttatttaaaaacaattatgtaactataatttattttattatgacatgatttatcattaaatattttttaagcatgatcaaacgtttataaaaagctaacaacgtcatatattaaaaaacagtaggtagtaccatatttttcagtggtgaccagaccctgataccaaacttttaataatatcattttactttcatttttaaggatctatacaggttgtcgagaccaatgggacaacggggtgtgcgatactagttgtgtaagcttacttggtgctcatcatatttctaactgttttgctttagaaatggcttaagctttgcgactaaatatatgagagaaaaaaatctattatctccctaggtagatctacccaaaggaaacatttcctcaacagataaaggtttttcttgcatgttttgaacgtaggatgatgtgtgagaactacaagatccttagcgtagaacttaaactcacataaatagttcaaggatcaagtaagtgatgcttaacaacactacttcatatccacaaaatatcgtacttctgattttccctttcagaaactctgagggataatacaaataagatttgcttaccttacactgattatgtcacaatctttactccaacatactagcaaggtggactcttaacatgttactactagaattagaaagtggcttctgggatttagttgaatgatcttgcttctttgtattcttctagttcggccaacttcctcttttatagaagctggagagggaggctcaactttggcttcatccttatttttacaatactgcagcatcacgggcttgctagagagttgtgcgtcttctattgatctaagtgtcatagtgattcctaagagcacggctagcttatcttttgcagtgatttgtcattcaccacaagtaggtttagactctttaggggaattggcaaattatctgatatacttaaaatataaaatattcagccaattattccatatcttcgaaatattctatcatagatttcaaaaacctttcataagaaatataacaatacataaagtaccaataactttataaatgtatttaatatttttctttggaaactccttattctagtaaaagttgatgaacaaagttttaaaagttggaccgtaaggttcatgccttaagtgccaaatatttcctatggtcataaatatttagtgctcttttgaaatgcgagattgaaaaataaagtaaaagaaaaacatataattgcgaagcgtgaaatgattgtttagtaggaaacatatagaaatcagatgagaagattgacccaaatgatttatcttcaatatataggttaattaattggagctctttactaactttccttcagaatccattctaaaaaaagaatttttttttaaaaaaagacatgattgaatcattttttaaaaagactttcctatgaatttttggttcggattgaatccccaactattttatgttttctctacagaacaaaaggccttaacgcagattcgatcgaaaacttctttgaaactttgaccatacagttgtccacgtaatcaacgacttagatacattgtgcgtcgatggtccatgccaatttgtcgttgatgagagacctgcaggtaaagctccctctcatcattgaattggtggtaggacgatagatctgaccgtcgcactcatgcagtcaaacagcaaaaagaaccaaactacaagatggcgagtagctaggttcacttattatcagcatcacagaaaaggtttaaaaaaaaggagaggagaaactgataaagtaagaaagaaaaggatgtatctccttttatcccataatatagtaatatatgattaaatgaaaaatttaatcgtaaaagcaatctaaaataaaacatctaatagtaaaataaatttagacaaaagaaaaataaatttggatctatcttaatttattttactattaaatgtctcatccgatcgtatattgatttattgcgagacgaaaggagtacgctgcatcactcatgtatgatgatggaatgaattcaccaagctaatgcaatgcatgaatcatggaagctttcggccacctcgcagcaaacacggagcagcttagctagctagctagctaggtacgtagcccacaaagttaagatagcgtgagtctggtcggccgggcacgtacattgagcatcatgggcatctcaaaccttctaatatatgctagaagcttaaatatgctagctaaccacatccacggtaaaaaacatgagacgcataatatttgacttctaggttgatgaagaatatttgacttctaggttgatgaagaggaggtggctcgtaaatcgtggggcttgttcattttgctaccattttcaaccttatctttggtaaagttactttaaaaaatggctacatttagtttgtttccaaattttagtatgtactccttccttccttaaatgtttgacaccgttgactttttttaaacatgtttgactattcgtcttatttaaaattttttgtgaaatatgtaaaactatatgtatacataaaagcatatttaacaatgaatcaaatgatagaaaaagaattaataattacttaaattttttgaataaaacgaacggtcaaacatgttttaaaaagtcaacggcgtcaaacatttagggatggagggagtacatatgaaatcttgccaaaatttgacaaccttgccaaaattttggcaaccttaccaaaatttggcaatgccaaaacttggtaaggttgaaaatggtagcaaagtgaataagcccgtaatatttgacttagtggtcgatgaagaggaggtaactgggttgggaaatagtccctctaatggaagtgtacattgtgtgatattgctattgatattctgtgaacccatatatcaatgaccacattataatgattttgtactaaaatatactaacatcatatatgggttgtcccactagtgtcatttcaccttaatagtcggtcagtcggagcatttgccttataactcatatgtatttattcttcaacatgataagttcctagtggttcggcggttcgagcttcgcctttgtcgacctcgtcactgcacctagtctagcatcgtgcccgacgccatcgatatcatcccctgtccatctcttccacatcctcaacgctaccgatctcaccatcgaccatgcctcaatccacttccaggtacgctagctcatgcttgctcactcgtcacctcatgacctctgccctttaatcttctcaccgcattgaggtctcaccgtggcaggtgacaattggttatgagatttgatgcccatggaggtatatctctttgatggtgatgagatcctagtgttcaagttcgatagatagcttccgctccatgagggcgtgctaaagtatggaaaagggagagaagaaaatggaagccgttccgtttaaaccaaacagtctcccatgcacagtggcactattttattatgtttgggttaaaggttaaaaaaagatactgactttattgtattttcataaaattaggtacgatattatccagttttgcatacctgctttggtggccggccctgattggggactggggttcttttattacttttctagtttccatagcatgaaaacatatatgtttatatttcttagctcaaaccaatctacctatgtatcatcatgaaacaataatagttttatgtacaattcatgaaaaaagttttactccacctaaaaattaggttaccataaaatcctggtaactaattaagcttaatggtttcttgatcctacactaactagagatacacataattaatagtatatgcatatctataaccctaccacgttaattaacatcggggtttcccaataagactggaaggtacaacagttgcagaacattccagaacactcatcttgtagttagaccatcctattaatcaccgtacgttagctgtccccttgtgtgtgcgctttggcttccttagctcggtcgtttaattacctgcacctatatgtgtaaacatcatcaacacgtatgtccctaaacgtttagcctttctgtgattaattaatgcctagtttaaattattaaaaattttaattaaccatgccactttgggtagccgagaggggggacgtgtcaaggtctgaaaagcccctactcgtagcacacgtacatgtcaatttcatttttgctcgtactgctaccgaaatgacatgcatgatgcatggatggataatatatatgctgagttggtgcccttttgttattcctcttcttctatatttattaacttaatgatcatcgaactagctaagctatatgcctaagatgctttgcatagttgcattggctagtactgtatacgatgtgactttcatctaaaagaaaatacaatgtggccttgcacgattgatctatctgttaggttgcttgctaccttgtgtttcttttggagaaaatatatagttttgttgtggtctcgaccgttgaagatattgatgtcatcacaagacgacgacatgatctatgttaaatttgtttcttttgtttttcttctttttgttatacacatccttaattaggttgcttgctaaccttatgttccttttagacaaaatagttgtgttgtatggtctggactgttgaagatattggtgtcatcacaagacgacgacatgatcgatatgcctatgttgtcttttatttttcttttgtttttcctccttttgttatgcacatccttgatggatgtggagactatgtgcaatttcactactcaataaaattgatactaatataaaaagtaattaattaaaggcatgctaatagttaggacgtgtttaatcgttcattgtcaaaataaacattaagatgaagaatgtggatatgtaatatttgatttgtgtttttatcaaaatttggtgttgttctaagagtggaagttttgagagctactaaaatttgtagacttgtgtgggtggagcatgtttgatgagcatatgtgtacttaccaccgggaaaccagcagtaaatgctcactagccaatcagcaacaatacagatttaatttggctctacatgcaactagcgccagtaatactattggtagaaacgatataagccattattgattattaatttgattttaaggatctcaccttaattattagatacaatattaacctccatttggttttactactagctagctagctcattgagttggcagtttaatagctttttctattgaatggaaaaagccctactagccaaaattaagaaagaggttaaaacttggaccttagcaagagtgagaaatcttcataattggctttcttttagttacctcggaccgaagatcctgaaatccttttttctctttcctttcgctttatagagtttaccccttctctactaaatgaaattgacggctcgccgattctatcaaaaataattgaatggaaaaacaatgaaatgtggagagaccgtagtcaaagttgtctggatatttgattatacttggtaccaaccatacattgcccgccaaagtttggcatagagtaagatggtaaagctgtatttggtttaatgacaaacattaaaagttatatgctgtaagatacaaagatggatattaattaccaacaaatcgtaagatagcaagcacttcgtttgccatcttattcttacaattttgctatatatttcttgacaaattttctcccaaaaatttgacatatataattacactgtaactataacgtaactttcaaaaatctctccgtaacatgttatttcagtaaaatggaggttgtgggaactaatcctctcacatgtgtgtctgctgtgatttttttcttccccacttgtacaaatcttataacaatctaacgatttaaaattacgtgaaagttacatacaagttacactatagttatatgcaagttataatgtaattacacgtaagttacagtgtaattacatttgtcaaatttttaggagaaaatttatcggcaaatgtataggtggtccctattcttatactccctccgtttctaaatattcgacgccgttgacttttttaaatatgtttgaccgttcgtcttattttaaaaataagtaattattaattcttttcctatgatcatttgattcatcgttaaatatacttatatgtatacatatagttttacatatttcacaaaagtttctgaatgagacgaacggttaaatatgtgctaaaaagttaacagtattaaatatttagaaacggagggagtatcaattaacaaattctggtgtagtgggcagaatcgatccaaaaattgttgaaaattaaagcacgcgtccgctagctcatacatgcatgatcgatgcacactacgaggtaacgaggatatcgatcgttaattcgttgcactttgcggttgtttagttcttttccatggaaaagctagcggtttcttcagttctttaactaggagaacatacgcgcacccaccaagagatatagtcccaatctcagttgatcagttaggaggaaaggccggcgtttctaatcacgacgaattaagctgatgactaattaagatagtttaattgatgtgctgcagtgcatgcaatcagatataatttagtcattttaatttcagctggttacactaatttctcgtggtggacgcggaattttaagactgaatgtatttactcaacaattgtaaagcattactccctccgtcccattttaagtgtaaccatgagttttcgtgcctaactttgatagtccgttttacttcaaattcttttataattagtatttttgttgttataagatgataaaacatgaataatattttaatcgtgacttatgtttttttttcaaaaatattttaaataagacgaacgattaaagttgggcatggaaaaccattgctatacttaaaatgggacggagggagtatgtctttgatacttacaattgttactagatctggatctgatctaagcccgttgaggaattaatatgaagtgtggtagcctctcacaccatcgtgctagttccgctccttctactcgatgccctctgctacagctcgctcggcatagccatacatatgcctacacactactcccgctaaactagatttgtgcatgtcggtagagattgaagatgtaaaccatttctattattaaaaaaactagctttgttgtcctaatcctagtcacctctatatcttagtcatagctgctccggcttatggtcgccatggtggagcaaccgacatgtcatcgccgcatctaagcttatggtggttggatccggtgacccggagggatacggatacggaacaatcgtgaaaggtagtgatggccatcgctcgttggggtcggtgagtggggagagaaaggagaaagggcataaagagagcaatagaaggtagagatggataatgtgaacttatttcacttggagcgctagggcgacttgctcatatagttctacttgttcattaaaaatcagcactaactgggatcattagttaggtttttgtctacccttatacacgcaggtctaggagcgagaaatgccttataatatcgatttttgtttaaccggcactaatagggcgcgttacattttattgcaggtcatgtggtagtgtgtgcaataaataaaatatattgcctcgtagaaaaattcaattgcgtgtggcacgacaggatgtaaagatctaacgaatgatcggtcttatataaccactgtatagatatgtaacaaatgtgtggaggagagaagaaaagagagaatagtttgactctttcgagaacaacatgggaactcatgagaaaagtaagcctatttttttcacccttgagccgtcttgcacccatgttattatcgtcatgttggctcctagttattataggatcccaagatattgttaatttgactgcttgtccactactttgattcatccagatctggtggctggctgaggagtcagggggcagatgatctgtcaggcgaagtggtcgctggattctgtccatgggcacctgtcttcactagctatggccgcatgccacttgtaacacccataaataattagatgcacttcatatataccatgggcaattgggtacagtatatgcatgcaacatatagcctgatctgatacgagcgtttatgcatctagtaagtgagatgctagctttctttcgttgttaagcatatcatctcatatcggaaacctgatcgatcggtccatgcatggatactatatgcacacgcatgacgttatgctagatagctagcctcatcatcgtctagtgctctgccaattaagcgagcaaatgtgagactatttaagctgccgaagtggccgatcgagcaaccggattggttatctatctctctctaggcccaatcgcctcctgaaaacatgccatctggcgcatgagcatgcgcccatggccagaaaagcgaaatgagtgagcgaccaactaggtttccattagtaggtgcttaactatatttattaatacacaacattttaaaagaaaacttaatttggagtagcactagaccgatctagtttgaaacatacatattattgagcgagattagctctacttaattatagaaacaaattaaatattgtgataaataaacttcacaagttacttaattctaagcaataaatacaaaagtttattttttaaaaaaaatcgaaacgtgaaggaaataatttgtttctacaatccggtctctgaaaataactacttagtctaaggagtactatgctaaccatgtactgatctgctctcgggcagttttacgagacctatttagattgtgcttgtctaatacacacgctagaaaatttttacatgcagtatagtctattggaaacatctattgatggtcaactaatattcacagatatataaaactataactaattaatagatatatttgtcgaaatcaatgttaaaacacaagaactttgtagataaatgattttctggcatttttataggcgccacttttgtagatttcgattcccacattaatcgaaatttcggcatttttgaagatggcccaactattttgggaagaataaggtgagggtaggaaaaggattgaggaaggaagttactaatttggccagcctatggcctgcccttctcatgcaaagtgccagataccactatccctgtcgttcatggccacaaatatctcatcccttataagttttaaatgattttagtattaatgatatatttagttgcccattcttttcatgttgctcattttgaatgataaaaaacgtcatatttattagttcgtctactttcccttaaataatctgtggctttttgaggggcaattctatatagttacaccagcagcaagtcattatatgactaatggtttttcacatcatacgcgtaaatataagcactatgatttaaactttagtgtacagagaatatctggtggcagcatcatcatccattgcatccactccccctcttaagcgagctcgtccacaacggcggtagtccttgggacggccacatatccctcaatggcaggcaagtggaagggcaaatctagcgacgtgtgggcaagaaggcggattccacaacgcgggtgatggaatgatgacgaccagaagtgtgttgcttctggctgcgacgacaatgttgatattggtctactgttgttgaaaattcttacatgccatgttctaccgtcatgctctgaatgtgtatttaaataggtgtctacatggtgtgaaaattggtttctttttaacaaattttttttacaaggtctgaagggtgccgtttgcgaaaatcgattttcatacgtggatctattagggcatcgccattttcgcaggcgggcgttgaaccgcctgcaaaattgattaattttacatgcatttggtcataggtgggacgactgacctgaccataaaattttgttttgactgtaaagcagtgtgttgttaatttgtcactcatatcgttttgtaatatatattttttagttttgcatgcagacactagtaattagccgccgtttagtaacaaaaaaaaaaccacaacatatttcgccggagaaacacgtcaacggctgagattaccccacgtaaggcgtaacgtaggtcgccccacgtggacggtgcggatctcgcgccggcacacccaggcctaaccgcgcgtaggctgctgcatgcttttgctttttgacgcgcgcgtacgcgcctacgcgggggagacaaaagcttactactagctagtagctatagggctaagctgcgcgtcgtaacacactttcaccgcgggtccaaattaagctaatccactttgccggtacggatttttacagcacacggatgggtaaaaaaaaagaggacaggattggactaggggtttttttttttttgtttacgtgctgcgtgcgattgcaacagttttaatttgtcctcctaattaactaattaagcatgcagctaagcttgagactatagctggcctaaaacgctttcttattagttaacccatttatctccaatgggaacttcaaagcaaagatatggggtatccacatgcatgcagaagtgcccaaccctctttttaacttttggtcgcgttagtgtgttagtttgatgttaaagaaaacgatcgaattgaaaagcactttcgataattaagcgaagtttcggtcgggtcacagacgatacctgttgtgttttggatgtcgatcgatcgataaggtactctctccgcgtcgttgcaacttttatcgcgctaatttctatatgggactagctgggagttgtcgacagttttttagtccaaaactttcaaattttttgactacagaatttgtcatcaatggttataggggaacaatccacactagtacaaaccatgaattttagtgtctaagctgattgaacaacaagaaattggtctacatgtagaagggaaaaaaactttcaaattcaaaagtaatatgcgctcctaaaaaaattgcaaatcataattttatacaatgtaactaccctataactatcgtgtaactactctgtaactagtgtgtaagtgctatgtaactagggtgtaagtgttatgtaactactctataattaagatgtaagtgatatataactagggtgtaagtgatatataataaaaaagagttattgctaataagaaggtgcatggcttagcttaacgtgtgcatcatgttcgatgactgccttgcccatgcgattttttttattctaggtgtatatgttgcacgaatcctagagcacatctaatggctagaaaatcgaaagttttccaaacaaaaaactgtcaacagttttttagcaaaaccggaaaaaaaaaaagggggcaataaactgtgcatactaatttgtgattgtagtttttgagcatatctatccgtatgattttcatacgtccaattaaaacattttagtaattctgtactccaaattttaaaagtgacagaagacacaattatttatgatagagtactgaatactccctccgttttatattataagttgctttgatttttttaaaaaacaaacttcttataggaatatagcaactcctataagaccagattagttgtattaaatataatattaaatatattttgataatatgttattttgtattgaaaatattgttgtactttctgtaaatttagttattttaaaaagattaactttgagaaaaagtcaaagtgtattgtagtaatataaattgtataggtgcatatagaaaagaaagaaaatatgcatattttttcagaaatttatttcatagtattacaattaatcacaccggtatatatgatataaaacaaatcatcagattaatagccaaaattgtgttttggggaaaaaaatcaaacctggattttgtgactggtgattaattccaaacaccaaactatttggtggctgtttaattaccgtggtggatccataaaattgattcattggtatcatagcatactaattatacttaaactatagtgttataatatatggataagcagtttaaccataggttttgctgaaagtcgtcggtgtcgtctgacaccgacgctaacacaaccgcccctggctgtttacatatatatattatcactctttcaatctcacatattattgttttttttaaaaaaaacatctcacatattattaagaggaaggctaaatgcagacctactcaaagttgaatctccatcaatgtaaaaaggaaaagtcaaccatagaaacaaaggtcaaagcacctgatcactcgttcatctcgttttagcaacaacatctgctctcaagctaagaaattgccatgataattaaatagggagaagaaaatatatacctttaattaatcaactggtgtagctagctagattaattggtttgttatagatgttcaatatattcacttagaaacaacaattgaatgtatagaaaaacaaacaagagttatccatcaaatataagactactttcaaacaaattttgagctagctccccaatttgcgtgccaagtttggatagttaagagttttttaatgctgaaattaccgcctacatgaaattttagctagctaggggtttgaaactaacatttgtttgcaatccaaattcaatatctgaggaacaaattaaacgtcgagactctgccatgtacatagtttggttcaaaccctcataatttttttctgagtgatcaagaatgtatgtattgaatcgatctatgcatgccaagctgtcaccaagctatacatacatatagctacatatgcatatatattatcatcatgcttccattattgggacttccatcgacacatgtagagggtgaatttccatgtgtcagtcgaagtgccctagcctaatgtaacatgtcatgaacggatgaccgacacataggccagtcaaaggcatgaacagtagagagggtccaggggagattaggccggggatcaatgcaagcaaaagtgagtgcgcccggccacacgtatgcattcactggcaaagctcgatcaaacaagcaaatggaactcgatcatctctccggcctctttaatttagctagctaatcttgagttgatccggcgatcgagcgagctactaataatataaatgttgggctctcctttcttggccctataaataccagggacgatgcccaggaagagcaacctgtgtcagttcaggtggtagtagcaaacacacacacagctagctagagggttgatctcctaaattgctcttggattaatactggtgtgtagagcaggagaggagatcatcctctgatcaaactctaattaagctagcatctcatatcctccaagatggttcaggcattggtctttgctgtggggatcgtaggtaacacacatgcacacactagctaattcgagattacacacttctataacaactaaccacatctagcatgcagtagtattagtggtttccacaacaagtatagtatgcatccatgcatgcatgcattatacttcaatttgccactcgaactaactaattttccttattgctggtaaatgatttttgcaggcaacatattggcggtcttggtcatccttgcaccagtgtaagtacctactagcttcatgagcattgagctaattaagtccatgatctgttaataatttgcatgcatcttgaaaaaaaaagagagagaacatgttaagctaattaatggatatatatgatgtgaatgcaatgcaaattaatgcaggccgacgttttatcgggtgtacaagaagaagtcgacggagtcgttccagtcggtgccgtacgcggtggcgctgctgagcgcaatgctgtggctttactacgccctcctcacgtccgacctccttcttcctttcatcaactccatcggctgcctcgtcgagtccctctacctcaccgtctacctcctctacgcccccaggcaggccatggctttcaccctcaagctcgtctgcgccatgaacctcgccctcttcgccgccgtcgtcgccgccctccagctcctcgtaaaggccaccgaccgccgcgtcacgctcgccggcggcatcggcgcctccttcgccctcgccgttttcgtcgccccgctcaccatcatcgtaagcgcattaattcattcctcacatagtcacatacataatacctccgtttgttaatagaggctaccattaacttttaaacataaaatatataagatataaatcatgctttaaatatttttaagttataaaacaactcataataaaatagatgataattatataatttttaattacacaaatgatcaaatatgtatacgatattatctattaaaaaataccatagcttcatctaactatatatctgtttcattaatttgattataagataattaattaattagcatattaacaagaactaacatcaagtttgattaaatttggttttgcagaggcaagtgatcaggaccaagagcgtggagttcatgcccttctggctctccttcttcctcaccctcagcgccgtcgtctggttcttctacggcctcctcatgaaagacttcttcgttgccgtacgtcctattattttctcttttttacttgtttttgtcccgttctttctcaacatctctagctagtagcaagcaaggagtccatccagccatgcaagctactccctccgtttcacaatgtaaatcattttaagattttccgtatttatattgatgttaatgaatctagatagatatatatgtctaaatttattaacatcaatataaatgtggagaatgttagaatgacttacattataaaacggaggaagtagctagctagccagcttaagggcacccacaatggctatctataggctctctacaagagatccatgtcagcatattttactacttggaagagattaaatgaagagagagagcaaagctatctactaacctggagatagtctatagagaaaaacgaggcaatggattagacagctatagatacccatgtagacataccattgaagtagtttactattaatctagtctattgctgagatgtacatgttttatagatagcaccttactttaccattgcgggtgctctaagcaactgttaattgttgtgcttttattaggtagtaataattaattaatcatgcatggatagtgatgtgagctagtgcgtgtcgcttgtgtcaccgcccatgagccagatgttttctgccgagaggcgagagcacagcacaaaagatcaccgccactattcatcacttgtataacctatctttcgccaaagcagagcttacgtactctcgcaagcctaaaaagccctgattaaactacgtaaacgtactcatcacacacgattatatttaaccaggagatttttgttgtagccagctgcatgcatccccgcatatattccagtagtaattaattagaacaataaattaagctatatatattgattaaattacggatttgctagaaaattttcacaagtttttttccctagctcaaaacttttctcgaggcttgtgcatgaagaaaaaaattaataaaaataaaatttcacacatgttacgtgtaaaatttcaatactagttgaatgcaagttttatagtgttgtaagttatatcgtagttaccatgtactccctccgtttcataatgtaagtcattctaacattttccacattcatattaatgctaatgaatatggtaaatactagaatgacttacattgtgaaacggacggaggaagtaattacattttaattatattataacaactttttagcgggaggggtttaaatactcccttaaattattaatatcgcatttatatgcagacgcccaacgtgctgggattgctggttgggctggcccaaaaggggctgtacgtggtgtacaagaaccccaagaagaactccgccgtgtcggaggcggccgccgcccagcaggttgaggtcaaggaccagcagcagctgcagatgcagctccaggcgtcgccggcggtggcgccgctcgacgtcgacgccgacgccgacgccgacttggaggcggcggcgccggccaccccgcagcggccagctgacgatgacgccatcgaccacaggagcgtcgtcgtcgacatcccgccgccgccgcagccgccgccggcgctgccggccggggaggtggcctgatcgatcagtgagagggtgacgtattgagctgcttgtactgcacgcgtgatgaccacgactgaccagagtgacctaattactgtgtgttagctgcagctcattctagctgaatcgcatgcatcttagctaattaattattatatatatctgcatgcttaattaattaagtcgcgatatatatgtgactgtatgtatctgttgccgcgttctttattctgagttgtaggatgattagaattttgctagtgggctaagtacatgtatgcacatgatcatctatcagctgctggtcgatgcgtgtatcgccgtacgtgtatgattggggacacgtgtactgcatctgcatgctagtacgtggcatctcagtttatggtactagctagacactgtactgctctccaatcaataaaagcccatgtatcaattgtttcgtctcttcgattttacggagtaatttattttgggaaatttacggagtaattactaatgtgctctgtgtaactaccactttcttaatacggaagaggcttctctgacgtaaagagacatgatcactgacacgtgtgtccataaagataggacctacctgttagggatattcacgtccctctgactttatgtcagaggagctctgtcctttagtactgctcgttaagcttagtatgcatgtaaacttgtgttttccagattagattgactattgattcgatcgagttcgattatttaccgtacagtagaatttgttgctttgatatcttcttgaactggtcagttttggcgtcgccggtcgggcggaggcaaaatggcattggcatgcagatgaatcggggaagcatcgttcgaccggtgatatacggcatgatcgttagcaagatgaaaggcaaaacatatgaagtttaatagattgaaaaaaattggcagtcatgcatccctgatgacgatatctgtcgcacatcaatagtagtaattcagaaaacaaaaagaaataaaagaggagactaaaaaaaaatcaagagtagtaattgagaagtcaacataacaaaatcgagagtagcaattgagaataaaatccaagagtagtactaactgataagaaaaaataaaataaaaattaattggagagtgtagtaattgagaagacaaaataagaaaaaaatcgacagtggtaagaccaaataaacattaattggagagtagtaattgagaagaaaaattcaagagtagtactactaattaagaagacaaaatacaaaataaaatagaattaaaaattgagagtggtactccctccgtactataatataaggaattttgacattttgcttgcattgtttgaccactcatcttatttaaaaaatttgtgtaaatataaaaaatgaaaagttatgcttaaaatactttggataataaattaagtcaaaaataataataattccaaatttttttgaataaaacgaatggtcaaacagtgaaagtaaaatctcttatattaggagtttgagggagtaattgagaagaaaattcaagagtagtactaattgagaagagaaaatacaaaataaaataaaaattaattggagagcagtaattgagaagacaaaattaaaaaaaatcgagagtaataagagaaaataaaaattaattggagagtaattcgagagtagtaagagaaaataaaaattaattggagcttatattaggagtttgagggagtaattgagaagaaaattcaagagtagtactaactgagaagagaaaatacaaaataaaataaaaattaattggagagcagtaattgagatgacaaaatacaaaataaaataaaaattaattggagagtagtaattgagaagacattaaaaaaatcgagagtaataagagaaaataaaaattaattggagagtaattcgagagtagtaagagaaaataaaaattaattggagagtagtaattgagatgaaaaaaaatcgtgtatcagagccaggtttcgatcctgggacctgtgggttatgggcccaccacgcttccgctgcgccactctgatgttgttgtgggtgctcccgttgcacccaagacaatcaattcacttcacgcgctctcgcctatcgggctatactgctgtagggtgtggctgtggcggaggcccacgaagaaaggcccacaggagatcgaacgaggccgcgtaccgcggacgtgacgcccacaacgcaaacaccgttggcgtgacccccggcctgcccgctcccgtgtcggaaccgaaacgcatcgcataacgggtcacatcttttttcgtttatgcttatcaggccgggtttagatcaaaaaattttgaataaaaatatcacatcaaatatttggacacatacatatgatactaaatatataaaaaaaacaattacacagtttgcatgtaaattacgagacgaatctcttgaacctaactacgccatgatttgacaatgtgatgttataagtaaacatttgctaatgaaagattaattaggcttaataaattcgtctcgtaatttacatgtggaatatgtaatttcttttgttattagtgcacgtttaatacttcaaatgtgtgtccgtgtatttcaaaaactttacaccaaaaaaattaaacacacccttagataaaatttgaattttcaacattaaatttaaagctgatttgaagttttctttatcaaattttatttttaagtcttttaatcgctaataatatatatatatatatatatatacatatatatatatatatattaatcataaattacttttttttccgtaaataaacgatgggtccgcatatctcaaaccaaaccgacccgcaggtgtcaggtgatgggccccaagtcggcggccacacaaggaaacgaaacgacccggtcacgcgccgccacccaacccaacccaaccaaccaaccatccaaccaaccaaacgcaacacgcacatacacagctagtagtagtagcctagtactaggagtagctctagctaagctgagcctgagagagagacaggagggagagggatagaaacagaaatagagataatcggaggggccccgcggtaaaaaatatctgcggcgaggtcgaagccggaggaggggggcggggcggccacagccagcgtcgacggggagccgccgaatcgcgtgatccccttcaaaccctagcgagggagcgggcgatttggagctgggtggcggcggcggcggcggcggatgctgtcggtgcgggggcggcaggaggaggggttccgtgtgatgggccacggcgacgtcgagctggaggagggggaggccttccccgacgacgacggcggcggcggcgcgctctgcctcgatcccgaagtcgccttctcctacatcgtgagcgcccccacccatccttgttgcctccctctctctcgcgtggcctcgcggaaatgaatgaatgaacgaatgaatgtgttgatttcggcgccgttcagcgcgggggactgctggatcggtatggttttgggaggagatgcgcggcagcttttgcacgatttcgcagttcgttgattggtaggcaggatgttggtttagttaaattaagtggttaccatcaacatctcagtttcgtctttgtctcggtagggtgaggaagcgccttcgttccattcgaattatttggaggatgaatggtgaactctgctcgtttaggtgattcgtgtaagcgcaatgatcaatttagtccaagcttctttcattgcgctgtcctcacaagtgaagcgatgctagcttgcctcgttgtttcggttatctgtgatgtgttgagtttactactaatccacttttggtgtgcggtaaaagccaactgactaaacgacccattaataaacattaaattgtaataattcccttttaattaaatgcgcaagtctttaccgacttataagaattgttatccatttttggggcattcatttcttgttgattgaccccatctggtatccaaagttctgacttatggtcaaaagggtgtttggtttgcttggacaccctaactaaaagatgttgaaattctgttaaaggcaggcacacacacacacacacacacatggtctttttagtgtttttaggtgattgctgcagttattgcctccgagaccagttactccctccattcacaaatagatgccgttatggaatgcgtgcaatgaaatcttgaaaacataaaccctaatttgcaaacatactaagatttgaaatgtaaaaatgttattactagatttgtaacgaatggtgctttcatattgttatatttcaaatttcttttaataaatgtatggttggagaaggcaatgataaaacatatgaattggagactgtgttgatgtcgtaaattacaagtaaaaacgaactgagagcatttattttgaggaaacccagaaacctttatgtttgcttgtgtgtgatatgtccgtttctgtgatcaaagcatttatctctggtcctcattaattgctttccatgttttttttttctcaggatgaaaagattcaacatgttcttggacattttcagaaagactttgaaggaggagtatccgcagataacctaggtaaagagctagtagttgctgtacttgtcgcttttgttcattgcatttcagtcatattaagtgggaaaaactttttgacaggatcaaaatacggtggatatggttcgtttttgcccacataccagcgctcacctccacctttgcctcaaagcagaagcccacccaaggttgcaaacgttggcacttcaagatcaccttatcaacaatctgctgaggtgctttattagttttccttgtgctgttaaccaatgtatattctggcgtatgttcatgtgtcatgattacaaatgcagagcatgggtcaatacccttcaactgtggcaaatgaatctatctcccgaaataatggttccactgcaccgtcatctggtgatttatgtaaaagagaaatatgctcaagcacaaacggtgagaaggactctgttgcttgttctgattccttggacagctcatttaatggtagtgaccagaagacactcaaagttcggatcaaagttggttccactaatactttggcaagaaagaatgcatctatctacagtggcctgggccttgatatttcttcttcttcatccatggaaggaagtcctgatggtcatgagggtcaatctccagtgtgtagtaatgtgccatatgaatctcctcggaccatcctgcaggtataaatgctttataaccactgaattatcacttctatgtcattaagcatagtcaaacaatggttataatagcttatatttttatctgcatgatcaatcagatcatgacgtacttttcagttcctggaggattcttgctgtcacctctgcatggaaacattctgaaattgacgaataaggtcaccccattggttaacaaatgggaaactaatctggacttaaaaaatgtacctagagcagttgatggccattcagaactttctctttcgtctgggcatgtcaaagcccatgtggctaagaaaatgaagcctgatggcaagaaaaagaagtccatagatacaaagactagaaaagatgcaaataatactagtgcaatattgggcaaggaggctaatgtagaaatacctggcagccgagtgattttatcagacacacatgatataacctgttcttctggcgccccaaccacagagttaaaaggtgtaagtcaattcacagaagaatcaactaaagatgctcgaccgaaacaacagatgggctgcaatgacctgggaacagttaaaagcgaagcagtcaaaacagaagtaacaaagcatatagaagaaaacagtagttttgacagttcaggaaatggttgtttagcaccacgggggaaagtaaaacttaaggcgagtaaagtggacaggacttcagaagacatgaatataagtagtcacaaattttctccgtatgataggaagaaagaaagcaaagtaaaacctatgagaacatttgagcctgccatggatgattttgaaggcaatgtggacaaggactggggtgctgggtcatcagatgatttgaagacaattcatggtaaagaaacctttgccagtgagagaactgtggaagataactctagaacggaggtcaaacgaatgcagaaggaacacaaagctaattttgtagcaccatctagtttcttagaggatggtaattttacccattcttctgtactagttaatgatggggcaactgattctcatttgaagtctaatcattttgaaaataaatcgaaagaaaaatctcataaagaccttagtgaaaatctgcctaagagatctataggaaacaaggaaggggcttcattggagagtgtaagtgttcagggtcaacggaaagagaagatgatgaacagtgataatgagaaggaacttcatataactgggccagcaaaaaaggagatcccttccagtgtaaagcatggcacatttccaggttcagaggaacagcagttgcatatgccgtcaaatggcgggattatacctggacctgcaaatgcagcttctcttcctgcacctgttttgatagaggataattgggtatgctgtgacatgtgtcataaatggcgtctcctcccctacgggacaaacacttccatgcttccaaaaaagtggatatgcagcatgcttgactggctgtaagttctagttcagtttgattagaattgcatttatccagtgttatgcctcaccatacatgcttgcttcaattggcaccttacatatgttaagttgtccttagtacatggttaaacgttgttaaatatagttatttgatctggaatttctttgtacaccttaaacgatttctgattagacaggtaatttgactagattctgatatctccccccgaacacccatccaccccgccttaaacaaaaaaaaaagtatttttaagtggtccataagctgtgcaaattcaacattgaggtagcactctaattcaagggtcatgcagttttctttctctgagtggtctgacaattggggaagaaaaaattccattactgaaaaatacaatccaaatttgtctttgcagacctgggatgaacaaatgcgacattagtgaggatgaaacaacaaatgctctaaatgcactttatgtcactcaaatccctgccgctggtgtttcttcaggtggccctcacactgcgcatgcaagtgtagcagcatctagcacctacaatataagtggacaactgggacagagtaggaaaaggaaaaatgctctgaaagacgaaaactgttacgagcatgatcaacaagcccctgcaaaaatgactctcacgagcaatcaacaagcccctgcaaaaaatagagaagttgttgatagtgaacattatactaatgacagagatcctgtaagcacacatgatctggtgccacagagcaaatcagcttctgaaaggcataagtctaagcacaagagtcgcagtagccactcagatggaggttctgctctctttcatgtttattgcttatatttagctgatatgtattatcttctgatatttttcagtaaatactgtgtttagttatttaaattgtttactgacatataattcctatttaaatacaggagatcttacagaaaaatcgaagaagcattcaaaatcaaaaaacaggagaggaattgatcgagatgagcacaaaacatctaagaagacaaaaaaagaggatcgacattactttaacaaagattggaaaaatgaatacgatttagctggcaacaaagttcgtgatgaaaccaaagctttatctgcaaaagcaaaaatgtcaaaggactcatgtgaacaagatgagttttctttacgcaaggaaaaagcttcaaggtttgatattttggaaaaaacaaagagaattaatgatgatgatgtggcctttcatgagaagatgaaagaacatcgtgcaggcatagaaacattagatttgtctggcaaaaagaagacagtgaaggaatgggaggataaccggctcagttcaatggaccacacaagcaaagggggcgataatgagaatttgaacgagagattatcaaagataaagaagtccgaagctaggcctgaagaagttcaggatgcaaatgcattattttcttctgctggaaggcgtcaagataatgagctagttgctgacaacaaatttgttacttgtaaagaaggtccatcagaactatgggataatcaacctcccagacaggtcttgaacttggcggaacccactaggagggatgttgcctgtcttcagtcttctacggttgcaacttcaagctcttcaaaggtctcaagctctcggagaaacaaaaattctcgagaagcaaagggctctcccgttgaatcagtatcttcatcaccactgaaaaattcaaacactgataagatttctaaggccaggaaaactggaaaagatggagaattgaatgctgattcaagcatcttgcataccccaatgaaatatccaacccacgaagttggtttactacatactgggcagcaagctgtgggtgaagccattctgcgtggttctacaaataactccggtatggggagagtagataatcaattgtaccctggtgataaaaagatcttggatatgcatggccctacactacaacctgatcagcaggattgttttaacccgagggctacagctgattccactggacataaaagtaaaaatagtgctccttcacgccaaggtagaaatggatccagtaacttgatttcagagggaaataagcagatagagatgtcatccagaaaagagaaattacgtcctagtattgataatcaagatatgcaaaagtctattggtcaagataatcattctcatatgaaagaaggcaaatcagaggttcacaccactagagtaaaaccaggtgcttcaaaaaaccacacacaattaaggtccaatgttgaaaatggagattctgcgagtccaattaggagggatggtaatatgattgcatttgcactcaaggaagctcgggatctaaaacacaaggctaatcatttgaaggttggtgacaccaattgtgttaaatgttgtctcaggcagcataattgtgctgtcaattttgcttggaagtatctaatgacaattttccctgcaggaaaaaggacttggacttgaaagtatgggcctgtactttgaagcggctttgagtttctgcatgttgcatctcttttggaaacttctaatctggacaattcgagatcaggcgatgttgctcagtcaatgaagatgtattctgaaactgcaaaactctgcaggtgagctacctgtgatgtccattgaataagtctataaagtttatatacttcgtttcagcaaaagtttatataaagttgtcataggtacaaaagaaagacacaccacgattcaccaagggatgaaaacagtctaggtatttaaaaatacgaaaaagtccactttactacctcaaactatttcataagtccacttcaccccctaaacatattgtaggctcacttttttttcccaaacacgcaggagatctgtgtatcatttcattaagcaaggaataaaaggtcggacttacaaaacaaaaacacgccatcacacccgctgaaaacacaaaaaagacccacccacattcgccccctcctagggcacaagtattgccttggccaacagctcttggaggttagaagctcccgccatacaccatagtgtgccctcattgtaggctcacttaaccccctaatctattaataccagcccacttagcaccctaacccagttttgttaggtggtattgccagcgtggagtggttttgatcagtcaagtcacgtcttgtgcgccagacgcagcctggctatgtccttgctgtggttgaagcttgaagggcagcaactgcgtcttcttcaatgagctgttgcctgttggtttctcacttggacttcgtcgtggttgtggtcacctgtaatttagagggacagttggcagcatgccgaaaagtgtaggatggatgatgtcacagtaacaggcccacagcatcggctgcatcgcacagcgctggtgcagctatggcaaccaaaattctgttacgcagcaacatccatctgatctgactattctttaaaactggatttaacatccatcttctgtatctgatgttgctgcaatggattattagttactaaggatgcggtagtggctgcgatcgctaggatggagaattggagacggttgacggtgggcaggaaccttgaccacagcctcgccacgtgagcaaatgcaactatctggaagcagaaatcagaaagccacgcgaagcatgaatgtcatgatctatcctacctttgctccgcctggcgcctgccatgacccttatactccacctcagcacatatgtgtggcgtggctaggtttaccggtaaaaactactcgacactggcaataccacctagtaccaggttagggtgcaaacatatgtctgcacaaataaactaagggattaagtgagcctaaataatgtttagagggtaggttggactgtgaaaatagtttgaggtagtaaagtggactttttttcaaacaaattgaagataaatctggctgttttaattaaactacactgaatgatgacgaattggatggttgcatctaatcacgtagtgaatactcatccatattaaattgatcagagttttcttcacgtatggttagctatgtctaactttgaaactatatgaactaagctttttaaatgcagtatactaaaatgcttttttttttatttgactgtccagcttttgtgctcatgcctatgaacgatgcaataaaatggcttctgccgctttagcatataaatgtgtagaagtggcttacctcaaagcagcgtattacaaacaccctagtgcaagcaaggatcgacaagaactacagtcggttgtacagatagctccaggtaattgatgtctaaaaaaatgtttgttctagcttgtaaactttaatttgaaatatttgaatcctttttattcctgctgagcttttctgggagttggaggctgcttctactatcctttgttccgcactgtgtcactcactggagttcgagtattaccaatttatttatttaggatgatgagcaatttggtccccaactttctcacttagctcatcaaaaggaccaattttgaccatcaattcagttgccttacactaaatgattaagatgaaaataaccgcttgctgcttcttgacttgtttatgcgaggtctgtgtgcatccaaacatgtagggactggatttggtattcatagagaataatgaattgcattctttgttgaaagagaacattgattgtgtgtgtgatatgtaagggaatggtatattttgtcttctcatggcattctgagtcatctaaatcccaagtcagtgctacttgtacgccacatcagtaaaaggaccatttgatccaaatgtataagttgatggacgaaattgactattttaaaagctcacagactaaagtaagatttgaatgtaagttgtgggaccaaattgttcgtcgttttcctatgttgtgcatcaagaatgggtagaattttggaagtccaggcacagggctcagctattttttttagataatgggaatttataaaacccggcttctacaccaacaggggtgtatacagccacagaaattccgagtgaacaagctcagttcttacacaagtttacaaacaaaaggagcacagaggctcaagcaccttacataaaactaaaagagcacaaagactccaaagcctttcaaagcgaaaaagaccttccaaacaaaccaacgaccacattacccccttaaccgctttctcatgttccatcgatctttaccaaagaagtgcacgacagttttctccaacagtttgcatccttccttcatcacatcacaaatggctatgcaacttgtatttatgtaatcatagtaatcatagttttgtattatgtaactacaaatggtttactagataaaccaaattatacaaaaaatacagttacaggcatatactagtaatggatttgttggcctagagagtgccgcatgcctgcatgtggatatatggattatattgacctggcattaccgaatatctaatttggtttatacgattcttggtaaatccattttgctgatatggctatctggtcactataaactgtactccctccaattctatattaactgacattttggacagcattgcaaataccaatgacttattaattagtcaccatatttcctgttatacccttattaaatacccatatagccttttccgctggatggagacgaagcaacagcatttactgtttgcatgcatgcatgaggggtattctggagaaataaaagggagagagttgtggagaaagctaaaacgtcagtttttgccatccaaacagcattaacccataacgccagttaggccgtgttcgaatgtccaacaaaacttggatgaagttttggattaaagtggcacgcttttcaaactgctaaacggtgtgtttcgtacgaaaactttctatatgaaatttgttctaaaataagtttgaaataattaaaactcaattaatcacacgttaataccatctcgttttgcgtaaaaaacttaatcttcatcttcatcttcatcttaaggagattcaaacaccaccttaatatagaactggagggagtaatcaaattatgcttggtgcattctgcaatctaaccatttgaaaattgataggtacttagtttttttttcatgatgtaatctggtttctaccaattttgttttctatactattgcattgttatcaattctcagacttcatagtatactctgaaaattttatttgtattaagtattttatggcagtgtatggagctttatgtgtatattatttcttatctttatataggtgaatctccatcatcgtctgcctcagatatcgataatttaaatagccatggattgtcaaaggccctttcaaccaagggtggaaactcaccccaagtggctggcaaccatttgccactggccgttcgtaaccaagcacacttattgaggttacttgcctatgtaagtaccttattgcacatgtcccaattaattgttactttcaatcaagctatttacctttagcctgggacaatctttttattactaggttccttcatctgtcccttcatgaaaacatgtttatagatatggatatgcaagctgttccattgtgaactggttctagtctatgggttatgtctctgtgctgtggaggcttgtttcgtacaggcagaaccaattgcaatttaatacataatctcttttggggatttgaacaatgtatattaacgactatacccttcaaattggaaatgaattagtaggagtttgatgcagtaacattttctttagctcaattagtacaggcagtagtggttatttgtgctatggtgctactgctatcctgtgctttggaatctatttagtgagggaaatctttagtgattccagtaaggctttgctgttaaagctaaaaaaatcaactaatattttaataaaaaaatatagataatgagtgcttttgaaaagtcactgcattgccaaacagggcctaaaatcaggcagttctcaatagctaaattgaaattacattatcaatggtcaaaatggcatttaactcattaacattttgggtaaggtgtaagtggctacccgcgaatccacttatagatcaaaataagccgcgaactcgcttattttgacctataagcgggttcacgggttagccacttacatccgtaattttggttagtagcgaaaccatgaataccataaatattgcaatttaatacagtaatatgaacagcatccgctttgatgacaggagttgtttacactttgaccatagaaaatgtaaatgatagtttggtcaaatgtctaccaaaattacttttggtttggtgataattgggtcagatgtacataaagtgaatatgcaacttaaaaaacaatcgagagtggtactggtacctaaacattgttgtccctgttttggacaccatcctgtgcttggcaaatatgcttccacattggtccacaggaagcagatagcatggaaccaatttttaattgaattgaatatttatttatcatcatcaataactgactgtgattgtagtaattaatgagttagcataatgaaacttcagtgctttgccatcgaataatgatattcggaatctaacttatgtttgttttttctgatctttagacaaatgatgtcaattgtgcattcgatgcaactcggaaatcacaggttgctattgcttctgctgctagcagtcaggaaaggggaaaaactgtggacgatggtcttgcttcagtaagaacagttttagattttaacttcaacaatgtcaatgagctactgagacttgtccggctttctatggagttaatcaacacctgatatgttcagaattgcatgaaatggcaccccatgaatagctattgttggaatgcctggctgcagttacctcagcatatttacacggtgcaaaagagatgggtctactaagtctgcgtgagctccataggaactgggaccggcttgcctggtttatgtacatttagaggcatccagcgctttttcatacaaataggatcaccacttcggattaatcttatacgttttggaggcattcagtgtttttttttttttttgggtacagtttggagcatcttcgattaacctgttccttttggaagcatattgtacagtttagagcatcttcttggcagttggtacgcaattactgtgtgaacggatccagctgaggtagaaccggattttcatgcgtgatggtttgaactctggcaaccattctgtgtaggtaggcaaatgtgttttatcgggaacatatgggctccatatcaagcattcccctgccatggttctatagattaggtgaatctttgactgacgcttacttatactaacttcgaagcagcataataccttttattggtgttactgtggggcactgatgatgtgccagcactcaagaacaattttgtaattggtaattggtaagttccacctgagtataaaattctgaaggctaaatggttagtccttctcgtctttccatgacatttggtacagtcttgagcaggggggatgagagaaatgagctgtgctaaccaagataagtattctccgtctcctcaagcaggtattggtatttttgaattagcaattacaatattatcatcatcagttcatgtctcctgctttaagcaaagcatatatttttcatttcattccgaccttataattgcccacaaaactatcgtagactgacccgttatttgaaagctaactattttccctgtttggagatgctgcctgaatttccacttatttgtgagcaacatatgcctgcagataaaataatataaaaaggtatctatgctcattaattggtgctgaattgcacttatgtagacctacctcttggaagcctccccctagtacagttttcttagtacaggttaagattgaacttggctcataacagaaatcctctaacaagctttagccaaccttatacttgattgatttgtcctgcttcgcatttgccacgaagtgtgaaaccctattgagcatactggaaaatggtgatactccacctattaattactccctcccccaaaatataagattctagaattgagtcttgtccagaatcatagtattaggatgtcttatctggacacagattcttatattttgagacagagggagtagtcatgaattgccccttacatgcgcatagcttctgaaattcactgtgttgaataaatgcattaaaatggtgaagtttttgtacttatacgaaatctcctgctgattatggattgtttgtttccaggtcttacgaaatggaacggtttggaagcatggtgggcaatgaattctataaccctgtaaatctcatgtacagtagagattaacctgtttgttcattacagtaaacagaaccagcacctgcgcattgtcatttacccgaaaccaaagagattttttccacgtgtttctctgcaaaacaaagccataaacctgtagatattatttgcttgcaatttttgtcagctcctaaacatagtttatggattatgatatgtaaggattaggctgagtacgctttgccgcgtaaatattttacgcactaattatgtgcccgatcaaatgagtataatcattatccgaaacattcgttttgttgcccttgtttaacacactaattggtgacttcggcaccctaaaaaaaccgtccatttttcgctggatgattcatctgtcatttttcaaatcaagcgccttaattttcatccacctgattagtgaataaatattccgttgcatcctagggataaacaagaagtatagttcggcttcagttggtaaacgtcccattccagttgtagtagctatgctgttttgtttgtggcacagaatcttccgttttactccgtaatgattctttgcaattgcatagaaacaacaaattaaagacaggaaagcgtgaagagacccctcttggacctagctcgtgatcctttttccgatctaccctaacccagagataaaatagtcgctagtgtacaaagcatagcattaccaagattttcgttatggcagctccagactccatggcaggtaaaaaaacagctttgacagtgcatgctcagtagaagctcagaagacgttgcaaggaccagtgttgcaagcaagttccattggaatttggaccaagtaacaaacccaccaatgcgacagctcaacatgtaaagtaatgacggcttcagatcagcttatcaataaacacggcgttgtcctaacacaggcagagggaattaagaaagctagaccatagcaattactcacccaagaaaattagtccactacaattcaaataaacctaactgataatttaatcacctaaagtcgttacagtgctttccaccaagggtgttcctcggggccaggattacaggagaatcgatggagttcctgagtacacatcagagtacttttgggcatgtccagttagtgaagcatgatgaaaaatttgtcgcgtataatacaggtaaactccaactcactggaagggtcaaaatcaaaggtgagacccttcactggtaggtctgcacaaaccggagaaagcagctttccggataagagggtgaatattcccaacgaaaatctcctgatccaacatggcaatatgggaccagatctgcaaaatatgtgtaatatccaattagtagaagctatggaggccatggaaaagaaaactacttaaaacgtactgcagaaaaatcagtcatttactaagaccttgagttcttttgtaataataaaacaattttaacatgcagcctgtgatatttggctctagtacaccgtagcctggatatttaaatgctaacacattaggcttctcaactttctcctgactgtaagctgtttggaacttctaggccatttgtttcttttctttcatgtttgcccttgaaaaaaataaatactactacacctctcacaaataaatgactattcttttttccagaacagtgtaaattaagggtaacagaatcatttgagcttttttcttaactacggtgcacaagtataaaatgatttacatttggaatcaaagagagtatacagaaattgtcagacagatagtttaactacactggagaaatccagtttggcctaatcatttataaaaaggaatttgatctaacaggtatccatattacagcatgataactctaactccccacaggtcctcacctcagtagcatattgacgagaaaacgacttgagatagcccaatgtgcagagacaccattgctcaagctctccaacattgtgactgattttcttgttttgaccattcagctgactgctaaagcatgaagacaagttagcagccgaataatgacagccaagcccctaatgcaggcacgaacatatttatactgaacagtaaatatgggttcctggcacttcaagacataggtgaatactgcaattaaatcatggtcagctgatattaatccatccaagaacctgtttgtcttgactggtatctagcaatctctactgaattttttttctacattttaagagtaaattactcttatagatatatgcaggactaatacaaaatcctagtctactagagttcatgcaagctttccacaaaaagctcgtttcagaatgaaccgcccatgaaaaatagttgtccatcctgtaaaagtagttatcctagtaatagcattgcaaacaaaataataaactgacctatcgttatctcctccattttcattgtctatttccatggttgttgcttcagggtcacgggctgaagaatttacattcgggtctccagcacgtaaattaggaacatctccatcagcagaaataggtggcaaacgttcagttagcacttcaacaaagctcttgaatagtaacctaagcaattcctgcaaaaccacatgaagaaaggatgctcaactctattattatggggcaaagtaccaagcaacagtacaaaattaaggtgataataaaagcaacggagcaccttgctttcttcaagccctcgagcaaggagggcctcctttgcttctaaagattcttcagtggttacttctccttctttcgctttgtcagcacgcgcttgaagtcgtcttagccttcctggattttcagatggcacaggttggccatctacaatctcaataatagatttagcctcctccaactctctggcggccttttcactggcctctttagcagcttgaagacctttcctgagtgtctgaatttctttccggaggtcaaaaatccgattgtatgttttactaacagcatttctaagaatctgcataagggaatgtagatcagaaagatttaattaaaatattgagctatattataatacagaaaattaatgaaggattgtcttggcagttctagatggcttgagtatttcaccattcaataaaagtaactaaacatgcatgcacaaagcactgaaagcagaaagctcctacagtgcgccatcactcacaagcagtataggtttgttttaaatgcagaataggtttggttattcgatgaggataaaggatgtacctcccatggacgatctgaaacatgaaattgatcaacattagcaggagaaaaaacccatttgactatagccagattggaaagtaggcgataacccatcatcctatcaatagctatggcaatcatctgggtactgttcttccaataagcactgacttcatccatcaacaataactgcatttcttcattcgggcacagctttgatattatttgaccatatctctccaaaacagtgataagatgggtgaaactttttgagccaatgtccagaagtgtctggctaactacatcaagtgcaaatttggcaccatttacaggaattattttttcgtctacccatgaaataatatcaccttgtgtcttccttcctctaaccatggcaacaagttccttggagagtctgtggccatcagtgctttctttgccttcatcactatgatatctgaagttaggcccagcttttgggggtaacagttcttccaattcaacagcatcctctatgctctgggaaagaaataagagacaagatccaattcaaatgactgttggtccatcagtagaaacagtgagaaggaatatgcttccttgcatatcactaacctgcttaattttgtcaaagtaggacaagcgaatttccctttctaatacttcttggacaaaaacacgctgtggagcccattttggaaggtccttgacgtaagcccactcctgccaaggccaaatgaactgaaaatttgacctgccaaagcagaacaatatcgatcacaatttggcagcaataagacttgaagtttgtcttgagggtgatatgagaaagaaggcgacgatttttttaaaggttttggaatatctcatgtaatggtccacaagaaattcccaagaaaaagacgtatagatagtaaacaacagaaaaaatatgtatagcaggtcagacagtaaacagtagaacaatcaacttacaagtgatgtgaaaaccataggataagtcgggtgcggcactccatatccatgttgctaattctgtcaaaaagagcatgtactgctcctaccacaactgaaggaaatgcacctggcaatgcctggaatttagacaattaactcagtgtatcatcccaaagaatactaaaagtgccagaagctgaattattctttgggcgttgtacttatgcattaaaagcataattgaatacccaaagaatgcttttaattgaatacccagaagttaaaaaaaaaacggcagcatgcgttccccgtatccagaagttcatgaaagatcaatataggtcgaattagctttgcaacagtacagagaactgattgtttttttctgataacctcagctcaccaaaacaatcttacattaggccaatatgctacatttttgtatcaacagctgttcttgaatatagttcagagatgtacaacacaatgctactaacattttttcacagaagctggttgtttaccaaaatgaaacaataggtggtgtttgattcattgccaaactgtcaactcaagttagggaagtttgactttttgaggcaagcgtttggttgcaagccaaagttatggtgtgccacacttcactattcttatgccccacaagtcagactcacttgcaagccaaaatttgccacaagtgtagctagcttttttggcaccacaaaaactgtggcaagccacacttgtggcatagaagtttggcaagttgagtaaaccatcaaaacagccatgatctagacaacatattgctaaggggggcatattagtctcaacaatatattggtatcacacagtaacgcagtcacaacaaacagtgttagctcacaagatcaaaagcatgaaaatagtaccttgcaaaggtcgataataaccaaggtatagtaaattggcctgaaagggggattcggcaataacagtagctgcaaaatatcaatataatacatgattaaacacacaaaaacatatgcttttcttgactagttaatgtgcaacatgcataaataccgttagcaggtagtatcctagctatgcgcatatactgatttgagccagtttgcatagagtggaatataacttagtccaagattttttgggtttttaaaccaaaactatgtcacattgaagctggttagaatgcgttgcatgaagggttgtttttcatagtgaagttctctatacaaactacactactaaatcaactaaaatcaaaaatcaaacactgaagattaaaaagtacctgtgaaaatatggtctcagccatcaggtattcataacggaaaggcacaggtaagctgaccagataaaatgcacattctttgcgactgtctttcaaagaaaaacataacaaagatagaatcagtaaacaagttgaaatttcactaatcagtaggcaaacattaaatcgtgtcaaaacaatttgctgatatcttttgctaccaataaagctctcgcaagaatgctcaatatataaagatatagtactacctccgttcttgaaacttgaaaagatgaaatcctagaatgcgtgcaatcaaacctcaaaatcttaaatcattaatagatgctacttcttgtattagtagattatgacttaaaatatgaaaaattattaggatttaaaatatgaaaaattatattagtagatttgtcatgaaaaactctttcatgtagttatattgttaatatttttttataaatatatagtttgagaaagtaatgatagaacatttgcattagagactacttcctccgtcccaaaaaagttgacgttttaaggttgacagccaaaattagtatcagggtaaaatgaccaaattgtccctaggatttgattcgacgctgagcccccatcaccatgccgcctgcatcctcttcgccttcctccagttgcctgcggtgagtgaaggtccgtttccgccaccctacacatgcgtccggccctggccgccacgccatgaccggcgacgactcggtgtgcccgccatgccgtgacctccgcagccgcgacgaccggcgactcggcgggtgcgggccgcgccgtgacctccgcagccgtgatacccgtcgactcagcgcgcctgcggctccgtatacgaccagcgactcagcgcgtgttcgctgcgccgtgacctccacagccgctacgccggccagcgaatcgatgcgtaccggctgcgccgcgacctccgtagccgcgactcggagcgtgcccgcctcaccgtcaccaacgccggtagtgcagaggagaggagaggtgaggaggatgaggagcgacagaggaggtgagagaacagaagagataaggtttcaggacgcgagacggcgagaggataaggtttctgtgctgttacgcgaggattccatcgaccggaagaaaaaaaaacagaaacatgggccccactttctctgattaaatatccaaaacgacttgttttttgggacatcggctaggcggtagaacgtcaagttttttgggacggaggtagtatgtcaatgtgtccaaaatgacatcattttgagaacggaggtagtgttataatgcaagtatgatcagaaccaaaacagtgccagcaccaaaaaggaaagaagaagaagaagaaactccaaatcttaaagcataggctctccacaacttattttgagaagagtaagtcttgttaggtaaaaccaagttaaaactcctcactggctacatccgagcaaaacatagcaatagacaataagacaaaagtatgggggctaaatatgaccaatttttgtttgtaagagaagcaagacacaagagcaataagaatatggtagtgcatgtttagcataaagactgacaagcaaatcttgtgacttgatggtcaactatgccttccatgaaatattagcaggtatgtaggtgataccctccagtctcaactactgtgaaaaatataaaggtgttgataatcttggaaaaattgaactactgaccatccattgaagaaaagtagcacatccaatatgcattcttcaacaacaaaacgatctacaggttgcatgttctgcagccaaaactagatggttagacataaaggacatggaatacagttgtcatacatattgatacagtacattagttgcaaaaagtacatatgagaaatgaatcaaaccaagaaatgatggaattgttactgttactgaagctgatgtgcacagtagtttctggtgtaactgcatgcaattaatatgacatgtttgacatcaccttggtattcaagattcaactttgaccgctacttgttatatgaatgtgttagcagctgttcgttcaatcattatataatataaaaatattttccaggacaaatctaatcataccattttcacatgactagtcatatacgacaagagatgtctgcctgtgtgactatttttgtctgacaaatggaacagctacaaggaattaattaataatattcgaatcattaaaagtaacagattattttaattccatttcacacaaagtcaggtattaaggaacatattggtccaatgttcagatattatttgcttctatctaataacagtatctgtgtaattgcgtctttatgaaataaaatttaattttagactctgggttgtacatactgggacagcatgaagcatataggaacacagctggcaacaaattgagcaaactcagagtgaaatattgcaatgtattatttaaagaagagttatataacaaaatgactttgtagtgtataacaaagtggtataaacttgaaaacgtgataatcaaaaacatgaaaagttgcactgatatcatgaacagaagaaaatttgcacattacctcagctttatttgttggaaatatgtgaagcctacgaagcctttgaggatacttcagatcagcttcatgcttttcttgaccttttactatttcagaagatgattgcgagatagtaggtggggggcaactaattggggagaaacggtgagaaactccagctaccagctgagcttcaaacgacaggtgaggttttggaactgccaaggaagtaaaatagagtgcagaaaccaattagacacaagcatgtctaagattttggaataccaccagcccaatttaatataagaaaaaggtgttctgaatgtaactattggatgcatatagggtttttgaaacatattgtgatataactctgtataattgtcacatatcatatgcaattgcaactgaaggtcaacaacatttgttcattaagaaatcatatggactatcgcataccactcttaaccttccacccattgcgagaaagaacttgaatacgctcccataaatcttcgatgaaatcctgcaaggactaactttaataacattgatctagatatcactagtggagtctgagttgataaggagaaacagtgtatgttcacctttttgttgggagagttgccttcatctgtttcaaagactgagaaagcaatatcatcaaaatgccttctaatgcttatataagactgtataccaaccagaactctctcaaattcatctggaacttgctgcatgttacatatcattagtgtattataccactggattatctgcagaattttctagtatacaatttcaaaatggcttcaaaaacgaaggtagcatgtcatggatcccaaggtaaaagaataattgaacaacgggtgctcctaaagtggaaatgtattgtattttcatatagtttcacatgtttcaaaaaattgttgacgcttcagctttccctctagctgctcatataggaaataaaactaagaaaaatgataaaacagaaatgtacatgaaatagtattcacatgcacaactaatttagatacagtgatacagtcatgctgaactgcatatgttcacatcagcagtaaagaacagcagttcaagttacctcaaacaattctgagccaccccatggaagggaagccaagatacaataaacatagaaatcagcacgtggttgccacgaaggatttccggtttcctcatctaatattgttgcagcagatgataatagtgcctcaaatgtttcaataatagaatttggcaggacaactttgctgcacatctacaaggcaaacattaaatagttatgaaaagaatggagaaaagaaaaaacaaaactatgttgcaccacaaacagctcaatcatatccatatagtgtgcaattaaagaaaatgtttgtcacgacatatgaagaattgaagagtgtagaaagaagtcactctgctcttttggagaggagacctaaagcattcacagtttataacttgtcaactcagtcctaggtggcaatttggagaatcagaactaaaaacatggctcaagaaggctctaggtgctagaggatcgggcagggtcggtgcctgcacaccgcctaggtggcacctaggtccaacataattagtcaattaaaagcaattagcaagtatatgacagagaagttagataaatgaacactaaaatagtagcacaagagtcgccacggatagttagctgcctgattgaccatctaatgcctaatcggaatggctacccagcgcctagcactaacttttagaatgcagaccaaaagtaaagattatgctaaccaaatgcaaattttatgaatcactagttataaatgcctgtgagtttgctatgttgtgtcatgcaaatgcactgttgcatgattcataagcgctcaagttagtaaggttgaaagacaagaactaatagccttgcatacttgggaatgttgacaaacagattcaattattcgcaaagatgtgttgtttgtatgaaacataacactatgatagtacgtcagttagacacatttcaggcatcaccaattaagattaggaaagcaacaagcacaataatgtcaacaacaaaatcaaatcaaatcaaccaaatacaaaacttaccaggccacagagaaatcgcagcaatatcctgattctgtcacgattttcattatgcaaggcatcctgcaattaagacatcatttataacctaagataatctttaagaaggagaaccataatgtgatttcgacttagtattcagcaccgaaagaaaaacatctacatagacctaatactgctggggcataagaaaaacatctacatgtacctgtaaattggcatgtgttgtatcgacaatacccttggaaaaatcttcattttccaagtttatcaaacctatctgaaattagaaacaaaaaaagagccatcttacggacttagtttaatgcctaggtcaaataataaaaactaaattgccatgtcttgttcttacaccaatattgtgtaaaaataaacttaaaacaagatataggtaatgtttggaacgaaattgacaatccaagttccatagaggatacatagtgaacagtcaaacacgcataggcggcagaataatgaacaataacagcttcaggaaaaaaaactatatttaaaagaacagagcatagtcatatgcaacagctcaagaaataacaggaccaagcaaaacaaaatatgaagcaaagcgtatgtcaacttcggattcctctcacacaatagtttcatcaatcatgttaatcagcactcacaattatgcagtgtgtttgtggcttgcaaccacctttaagagctaatctaacttctcaaggcttgttctcgaaaaataaaaacttcaaaggcttcataaattcaaaaggcatatgagtactagattttttttagtactacactaatagtggttgaatttgttgtgcattcaccttctggggataacaaaggattaagagggcacagtagcatatcattatattgtgacaaaaaaaataaaatgctcacaaatagcaataaccaagttataaggccataaaatagcatgtagttttataaggttcaagtaggtgcacaccaatactccaaagaaaggaatcttgtgaggcaattgatctgcacattggaggagaaactgctcaaaaaaaaagtatgttcagttagtatcatatcaattcattcacaagatgcagaatataagatatactatctctccattgatatctttattttctgccttcactgcagaaaagttgacaagataaatagacatcttggctttagaattctttacaaatactacctccattccaaatataagtatttgtaggttgtttagtagagattaaggaataaggtttgaaaataaatgaggggtggttgggaatgggagggtggttgcggataaagatggggaacttttgaatgagaggttgatgggacaagtagtactacaggaatgcttatattgtgtacaaaattcgaatcctagaaatgcttatatttgagaaagtagggaatactaagattggcttagccaatggactatagttttttttttctagaaggggaaactgactgcagttggaaatatgccaattttaggcatcgatatttcttcataggactaagacaatatatagcttgctataaaaacaaaagaccgaattaattgtgaatttagacaatactatgtgaaaaggcacatgatagaatattgggtgctgacctcaaacattgcatctttggagtgttcgtattctcgacaaagcacaccataacaagtttcctacaaagaaaacgcttggtcaaaacaagtgtagaaggatcataaaataaaaatattaatttatactacttaaaagagttgatggtggtgatgctgtgctctgagctaatcttcagaggattcatgaatgtaagcaaggtcaaattagttgactagaatatttgtccattggttgcactggttctcaaataaacatgccatcaacacatatagcatataaaagagtaaaaagttcagaattgcatcaacacattacagcaccaccttccatgctaccatgcatagcgccacaatttcactaaaaaaagagccttttcaactagaagctggaacatagtgtaataacaacacttaaagcacatcaagattgctgtgcatttacagactacagtcttccaaatgtgcattgccttgtgactacatctgtgaagtactttagcagggttcaattttgatctctctaccttgaactgttttcatcattaaaacacacacacacacacacattttccaatattcaaatggtagaaattatgcagaacaaattatcaaaacacgtcgttctgtccttcctgttgttactactctcctcatctccatcatccggacaagaccgtcacggttccgctccacacacccaaaccccaagcgcccagcaattgttaacaggtggctagggttttgagctccccagctccaccactaccggctcactccccctaccgcaggcaaccaggaacgacgcccactcaagcacgaaccaacgcaagcacgccccccaaatccggacgccgaaaacctagggttcgggcgcgggagccccccccgggggggagagaacaaaacgagcggggaggggagggaaacggggggggggggcgctcacgatgtgctccttgtggtcggcggagcccccgtactccgggcacctgtcgccgatccgcagcagcagcgtcctccagcccgcgctcatggcgtcgtcgccggcgcggcgcggcgaggagggagagtacagagagagagagagtggtggtcgggatactcgtcgggttcgagggttttggttcgggagcgggcgcggcgggggttttgatatcgggttcgtcacgtgacgcggtgcgacgcgaacgcgaactcgaccggcttgggttgggacgttgggtcgagtcgagttgggagatgcgtgtgggcggccggtcgccgagggggtttgtgttaagtttgcgtattaaagtgtcgttgatgaagcacggtaatttgtgtgactagtccaactcaaaacaaaataattgtgtatgtgacatatatatagcactagcgtaggtttccgtgatacacataaaggatgatcacaaatcaaatacactctgctaagctgattaacttttgtaaaaagatgtcatcgattaaatacgcggactcaaacgtaatagatatgtgtgaattatatggtacttaaatttgttatagatatgtcactaaacattgagttaggcaaggcatagaaaatgaatggaggttgtgatactcttggacctccatcgtattatacctaaagattggacaccgccttgtataagagtcgcgggatacaaagctacatggtaagctacttagcttttagaagtataaattatatgaaattgggtatttatggacggtatgtgcccatttattaattgctaaattttactcacttttgatagccatttgagatagatccaaccgtcaagctgataactttgatctctatataaactccctcctagagctaatttcattttaggacaccagtattctcccttgggagcaaaggaggcgcacccaccagggcctctcatcgtaatatagacccgttcaccacaacacctcctaacatctccgtaacatctgcaaccaatcatggactcgaagaccagtcaccactctacgcgacaatgaagcccatagcaaccaacatcttcctccaaaccctagtgatcgaaagtttcattgcctttttcatgttgcagatgttcaaatctttcaacgacggccaaacatcgctaatggattttgtttttatttgaaatctgttgttggaatagaagcttttgttgaggcggttgcaatcggtaaagggaaggatgatttgactggttttgttttggacacatccaaaccaaaccaagtcctttctattcagcctggcatacctgcaggcaaagattgttcctctcttgcttcaagagatataatcgaattcttaacgggtgatttcaaaagaagcaagacaagatcaaataatctttttggggaagctgtctggcctcgtttgcttgcaagagggtggcactcagagaagccaaatgatgtcagcaccactaagaattgccttgtctattcattgcgcctggtattcaaaggttttcaagaagtgaacttacaaaaggcactcattattttgattttgccagtgatgacctcaagaaagtagtagcagatcttgtttgtcttaagctagaggttgatgaaatgggcaatggtgttaatgctaagaaaaaaggctttgatacagacataaaactgaaccaagatgttcctttggatggataccacgagcttccaaagttcacagtaattgatactaacatggtccaagggaaagaagccttgcaagtgaggaagctaacgagtcttttaatacttccatttgcaaatgttttacccttatgttttccattttttacggttaccattccctaaggtccaataggtgaaaaaaagggggagcaatagctactcaatgaagacttaccggcgcttttcaatcttaacatgtgcgtaagggacagagttgggttgaggttttgaggtgggaggcctcgtgtagagggtggtggatgctcacgtgcatggaggctatgatgttcttgcacctccaccacatcgttgacccatcatggactcaaagaccagtcatcaccccgtacaaaagtagggcttgcaaagctatgggatagattgcttggattttggaaataaaatgaatgttgttggacatttttggatggcatatgtttatttatttgatactaaatttaatatctttcaatagtcatttgatatagatccaaccgtcaagccgatccccttcatctctgtataaactcacttctagacctaatctccaccatcctcatctaggacaaccttattctcattttagagaaagggaggcccacatgaaagggactctcatagccatgtgcattcgttaaccataacacctagccaatcccgttcatctctatataaacttacttctacctagtctccaccatccctacctaagatgccattattcttacttgggaggaaagaaggcccacctacaagagcctcccatcgtcgtgtggatccatcgaccatggcacctactagtgtctccatcatgctgcaggtttactaaaatggggcccataccaaccaatgcctccctccaagccccgacgagcactgggcgtaacatgtaagctggtggtctagcggtggttatcagtcttgaccagcaagttggtggtatggcggtagcagccaccagtagtaatcgtcgtctgtgcgatgaagaaggaagcccacaatcaagaggttagaaaattctattgagattttaccatttgtgtccaaaatatttttttatgtaacacacataacctgcggaagtgtggagcacacacccggttctcccacttttccaacggaaatggagcccacacattgtttgtccgatggtctgatggcggctatcagtcttgattggtaaggtggtggtctggtggaggcggccaccaacatcaaccatcttgcaagcaatgaagaagaaagacccacaatcaagaggttagaaaatcatgtcgatactctattgtttgtgtcaaatacatttttttaatgcatcacacataacccgcgaaagtgggaagcacacacctagttgtcccactttttcccttactagtaacataccatatgttgtagcgggccaggcccatataattagggatgggctaagagtgtgattgaggataaggcattcgatccgagagttacacacgcgtacgtgggtgttgtgcattctgggagggaattgcaacacgacaacttcgcttttacattagtagagaaacccacccccagctcgaagctataatcctcggttgcactaggatagaatacacatctacatgcggatgacatgcagttgttgacgtgaaattcgtcgcacatatgaaggcttgagagatttattttactatagtgcatgtcctatcaaattgggttcagagcgtgctaattagtttgattctgcaattaataagaaaaacaaaaaagattagatcgtggggccgatcagccatagggctgatatagtattgagtgcccaaccaatgcccatggaatttcggatcgatcggctataaccaatggatgaaaaaaaaatgaaggattaaaatgacatcggccggagtctaggtatatgtgtgtgtgtgtgtgtgtgtatatatatatatatgtatgtatgtatgtatgtatgtatgcatgtatgtatgtatgtatgtatatgcttgtaaatattctaactttattacaattaatcttgatagatcggactcaaccgaggcagtataatattgaaagtgataaaataagcactttgacaattatatttgtccctaaatataggctgatgtaccataatatcaattaaaacctatcattactcattaagtagacaaactaatataggctatcccagcttataattgttagcaatctaaatttattaatcacaatcttgatagatcgggcctaaccgagacagtataagattgaaactaataaaaataacaacttaaccgattatggcaaaatttatgcattattcgatacagtagattaatttataataaatagataactcatcggctaatatttcgattaaactatatcaagtatttattgacttgaacaaatctaactaacagattataacctagaagattggacttaaccaagatagttctagatcaataacaagtttggtagatctaacctaattgattgatacttttgatagtgattgatataaaaaccctaataataatggcatgaacaatcaaagaaagacatgatatatccaataggcaatgcaagcaaagcttaactagtatatcggacttaactgagaaagtattaattcctccgatacaagcgaagttgatggaacttactttctcgcgggagatcaaaattgatgcagcctaaacttgaaaacaagaactcgtcgaaagtaaaactagggttgacgatgtgccaaaagttatatattgaactgtcgttaatttataaagaccttgtgtgtacatatttatacccataggttatactaagtccgactctattacgatcggatcaactaaggactctatctctaattaaggaaactactaatacaactccaattcagacacgactctaatcagctaaactaaaagaaaaacttatctgagcccgatcttaatatgactccgttggcccagaattctatctatagaaatagaaacttaaaaatattccttatcatggaagtacattacaaaaatgtggataatcttgctaaccaaatcaactaaaattatggcgtgaataccatctttgactcaaccttgactaacaaaaattgccaaattttgccgttaacaccaataaaggccaatgtccattcattgtccacacaaccctgttacctcccacatgcatcacctccaccaccttttccggcccaacccacgatgttatcggcccaatggtagcccaacaacctacaagaccgtctgtcctaaccacaagcctctttctcttgcttgttgtcaccattctctctctccatcttatctctcgtccgcctcattctctctttgctccacgtgttgtctttaaaggtgtaactccacccaccgcttctgctccgaaccaacaatgcaaccatgctaagaaccaccatgggataagccacttggcttttagaagcaaaatgcatgtttttaaggcacttttggatggcacatatgcatggcttttagaagtaaaaaataaatgttgttgggcacttttggatggtgtgtgtccatttatttgctaacaaattgattctctttcaattgtcatttgctgtagatccaaccgtctagccgttcctcttcatctctatacaaactcacttttagacctaatctccgccattaccacccaaggaatcgttattctcacttgagggcaagtaggcccacctgcaagtgcctctcaggcagatccattaatcacgacacctagttgattcccttcatcactgtgtaaacttattctacacttaatctttgccatccccacctaaggcgttgtcattctcacttgagagcaaaggaggcccaccttcaagggcctctcatcactgcacaatcctatcacctccacctcattgtgggttcattatagacccaaagaccgctagcggacaccaccactacccttccacctcaccgtgggttcatcatggaccaagatcgtcagcaaccaccatcactacccctcttccacgtgtaggcctgaaaatggttgaaaaacaacctctatcatttttttctcagaaagcggtagagccgaaaatggaaaaaatgccagaaacaaatttgttagggtagaacatgttgtatcgatcaaagaatggaaattcaagttgaaaacattgaatgtaaaatcacatgtggaacttaacatgaatgagagttgatggcctgttggcctacgagccaaatggagacatgggccatggttattgggagtatttagaagcataataatctatgtaaaaaatatgataaaccaagaaaacatttggtagtacaacacaaacatttttgttttttttaccatttatgttttcaatggtttatccttttgttttctatttctgatggtttaccattcccaaatggttcaatcggttaaaaaaaggccacaagggagggagttaggtaggggcttcgatctatggggccttgaatagagggtgaaggttgctcacgtacatggaggctatggtgttcttgcacctttccgtatcgtcgagttaccatggactcgaccaaccaccaccatgtgaaagctaaggggtttttataagtaaaatgagtgatgttgggcatttttagatagatatgtccatttaattgattctagatttaatctctttcgatagtcatttgatgtagatccaatcgtcttgccggtcaccttcatttctatataaattcacttctagacctaatctataccatctccacctaagacgtcattattcttacttgagagcaaaggaggcccacttgcaacagcctctcattatcgtgtagatccattgaccacaccggctagccaatccccttcatctctatataaactcacttctacccaatatctaccatccctacctaagacaccattcttcgtactttgggaggaaagaaggaccactcgcaaaagctcgccaccttgcagatccgttgaacacgacacctactagtgcctactatattgtgggtttattatggaaccaaagactttcagcggcaacaactcaatagggaaatggagcccacaacaactagtgcctccctacaagtctcaacaaacattagccgtaacccgtaagctggtggttcggcagctgttatcggtcttgaccggtaagccgctgtctggcgacaatggctaccggcatcaaccatcatccaagagatggagaagaaagccccaagacacaggtcaaaatttttttgtcaagatctcaccatttgtgtcaaatacatttttatcaagtaaacccaaatagctgataacccatggaagtgttgaacccacatttgccctcgaatccgtcgcctattcgaagccataaccatcaggtggctgcaacaactagcgtggtgtccacgaccgcatccgcatgtagacggcacatgggaaggcagccgcagccaacgcccatttgcaggttcgaggtcgtgcacgcgcggcacgatgtcgtcatgctctgcacgcggacggcctatcccaggagcgagaggcccacgagggcatatgtgcgtggcatgaccaccaccaatctctctcgtagtcactgtcactgttctctctctttctctcgcctcgcctcgcctcagcccccatctcatctcctcttctttgctcctcgcgtctttaaagcctctcttgactccgcctcagcccccgtctccacctcaactctgattcttcgaaccaccaccaccaccaccacatcgagggtggtgtcgttgccatcgaggacgctgctccatccggacgagggaggggggatcacgtgtggagtggctgtgggcctgcctgcaaggtactctcgttgccgtgtagatccctaaccatgacgcctaaccaattcccttcatttatatatgaacacacttctaccaaatctccaccatccctacctaagacgtcattattcttacttaggaggaaataaggtccaccagtaagagcctcttaccaccacacatatatgtcgaccacaacacctactagaacctccaccatgcaacgggttcattgtggaccaaaatatcgtcaatggccaccacctcatatggaaacggagaccgcaacaaccaacgcttctctctaagctcaacaaacaccggccgtaacctgtaagttgttggtccgaaggtggttattagtcttaaccagtaagacggtggtcatagcacctccgcctcacccgtgggttcatcatggacccaaagactgttggtggccaacaccactacccctcgcccacatgtaggtgtgatattggttggaaaccaacatcaatcatttccacaaccatactttttctcgagaaacggtagagctggaaaataaaatgaatgttgacggccattcttggatgtcatatgcccatttatttgatgctaaatttaatctctttggatagccatttgatgtagatccaatcaaccagctgatccttttcatctctatataaactcatttgtagataccttatctccatctccatcgaaggcgccatcattctcactcaagaacaaaggatcgaggcgtattcgcaagggcttcttgtcactttgtagatctgctaaacaccacgcctagccgatccccttcatctctatataaactaagttctacctaacctccaccatccccatctaagacaacattcttcttacttgtgaggaaaaaagacccacctgcaagggcctcttacctccgcatagatccgtcaaccaaggctcgtactagtgccgccaccacgccgcggattcactatggaccagaagaccactggcggccaccaccccacatggagacggagcccgcagcaaccgatgcctccctccaagccccgacgagcacctgtcgtaactcgtaagccggtggttcggcggtagcgtccaccagcatcaaccatcgtccaagcaatgaagaagaaagctccaaaacacaatgttagaaaattctatcaagttttcaccgtttgattgtaatgccttttattttcacgtaatacataacctatggaagaaacacaaggtaaagaaaattctatcgagatttcatcgtttatgtcgaatacatttcttttttcacgtaaactcacataacctgtggtgaaagtgtccaacaccccccccccccaccaccccccacacacacacaccacacacattttccccgggatccgccccttgttcaaccgctgggcggctgcagctatagcgtggcgtacacgcccgcatccgcacgcggacggcacacgggaagggcggcccagcgtccgtccgtccgcgggttcccggtcgtccacgcgcggcaccccacccaccacgttcgtcacgctctccgcgcggaggacggcccagcctcccaagcccagcccaccagcagcgagcggcccactagggggcggggggtgtgtgcgcggcgtgaccaccaccaatctctctcgcagcagtcgctcgctgtcaccgtttctctcttcctctctcgcctcggcccccgtctcgtctcctcttctctctttgctcctcctcctctttaaagcctccccgtctcggcttccgcttccgccccgaaccaccaccaccaccaccaccaccaccgcgtttcgaggtcgtcgtcgtcaacgtcgcgtggggcggcgctgcctcgtccctgcgcgtccggaatcacgccgcgcgggggtggtggctgtgggggctctctcctgtccgtgcgcgtggtccagattctgccgtctgctccgcggggagggggggaggcgtggggttcttggcggttggcgcgaggggagattgggggggggagctcgggaggagggcggcgtcggcggcggtggcggcttcgcgtgcgtgcatggacatggacatggaggcggctaaggtgattctctcctctcctctcctcgcctcgctcttgttccctccctccaatctttagctcgcctcgcctgctgctgctgctttgcttgtccgcccgtgttcttgctttgaccgtgggtgggtggtttccttccgtgatcacgtcatcccttccccccgagattttcttttaggtccgtgctagtcgttcgtgcgggttcttggagcgccatggattaggcccccgttgctgctccgtgtcgtggtcgcgcgtgggcgtggctcgcctgggtatctcgtgctcgacgggatgcggccgccgcgggaggtgggattgggtgggttggtcgcgggtggtggtgtgttgccaccgtgcccgggccttagatttcgcggaatgcaattgttgaccctgtatctaccaacatggctcgaattttactcgtgttttgggttgtagctgtgtgccacgagaccctcgccgatgccgcgagcaatcttgataggttctagccatggtgcactctttgatgcaatgttgccagtgagcaatttgtgttgatgtcgagtaattcaatctgttgggtggctggtaaaatttcttttcttttcgtcaatcattctgcctgtgggttatgtccaacgatgaaccctactcagccagtggttatacatgacagacattgtgttggtttgcttcctgcaagccatattgctgccggcaatacgatgcgaatatgcgcacgagtctccgaaagctttggggctcggaaagtaagtttggtggtcgtctgctatgcggcattttgaatgcattatggatgtttgcattacaggggaactttgctgcaattgtgagagtagcaaggtttttccaaatgagttgtggttgctgggaaaatttaacccctttttataaagcattgttttctattatcaatctttcatgagaatgggtaacttcagggactttgtagaactgtagatacagttaggtatagtacattattgatgccatgtagactatgtttctgcttcagtttctaactgccaagttcataaattagtacttggtcattttctgttgcatacagtatattttagatgccaaaagatggtgcatcatagggaaaaatgtaagtatataagagttctaggagattagacttgggcttaaaaaggaagaagattttacatgcgttgatttttttgtttttagctgcttttgtttggccatgtgttaacaaagaagagctgtgttgatgatgcatccttctgattcataattcgaagtacattgacaatttaattatttgtgctgatggtgaagtgataatgcacttttttttgtatcaatgtgaaatgttttacaaatgttctttttttttgtaattttaatagatggagtcacttgagccagaagacggtgatggacaccaatcagatgctacagatgacgacttaccaccacgtatatgcactggaaaagcgtaccaagcagagatccctaatcttgccacagaggatgaattttgttaaacgtcgtcagtacatgagcaacacaactgatagttgcatggcacttggttatgattgccctataccaattatgtggacattaccaagtgaattcaataagaaggaagaggaaatacaaaagcagcattcttcagaaaccaaggctataaaaaatagcagagatggggatagccaaacgacctcaatttgcccaaccagtaataacacaagtggacagtgttcaacatctcaggatccgcatccagagctacctgatcagatagtatctgacagtcatcaagcacacgatgataaattggctccatgttccactcaagaaggtctaaacttcactgataaggccatggcagatcaaggagaaattgaacagtttattccagtgcctaattcatccacttccatttggagtgatcaggaagcagaattattgctccttggcctctatatttttggcaaaaatctgcatgtgttgagcagatttgtaggtagtaagactgttggggatgtgctttcctactattatggaaagttctacaaaggagaagcatataaaagatggtcagcctgcagaaaagcaaaaataaggagatgcattcttggggaacgcatttttataggttggcgaaggcaggagcttatatctcgccttaaatctaaaatccctaaagaagctcatgatctgttggatgaggtacgtcacaattatcactcatactttgatcacctattcggctcttctatttctatctatgcaccgagtaattaaacattgagatgcctcatcatgatactattctcatgattaaatgaggttctgttagtctgaacgccagttccatcactgtttttttttttctcatagcatttcttgttataatggaaaacacttccattctttgaagttttagtttcaagccagattctctttttagattcttgccaagttatgtcaaccagattaatctcttacctattttcgtaggtataagtctcacctcatcatatgccatataaatagaatgaacaaagttatcttgacttaatcatatggagagctatccaagtgtcatggcatgtgttttggctgatcttgcatcagagtgtaataactactctattgcaactattactataggatttcagttataaatatagatgttacacctgaaaattgaagcaagtgcacagtacacttcatttggctattatgttgggattttctgtgtcttgatctaccttttttgtgaattgtattctctttgcactttttaaggtagagctgttccaaaaagacaaaaaaccctagtgctctccaagtatgagtacacacaaggagttcaatttgcaatggtccaaggaactttacgtagtttaatttcacagaactaagttatttcaaatttatggatattaatagataatgtttttctatcaatcagtgctatatgagttgcattgtttttttcatgttgcagatgttcaaatctttcaacgacagccaaacatcattaatggattttgttttcatctgaaatctgttgttggaatagaagcttttgttgaggcggttgcgatcggtaaagggaaggatgatttgactggttttgttttggacccatccaaaccaaaccaagtcctttctgttcagcccggcatgcctgcaggcaaagattgttcctctcttgcttcagaagatataatcaaattcttaacgggtgatttcagaagaagcaagacaagatcaaatgatcttttttgggaagctgtctggcctcgtttgcttgcaagagggtggcactcagagaagccaaatgatgtcagcacaacgaagaattgccttgtattcattgtgcctggtattcaaaggttttcaagaagtgaacttacaaaaggcactcattattttgattctgttagtgatgtcctcaagaaagtggtagcagaccctgttcttcttgagatagaggttgatggaatgggcaatggtgttaatgctgagaaaaatggctttgacacagccatgaaactgaaccaagatgttcctttcgatggctatcacgagcttccaaagtttacaataatcgatactagcttggtccaaggggaagagccctcgcaagtgagggagctgaggaacttgcctgctgatgcaaatattagttttggccctttgcgtcatacacataatatggtgagtgatagttcctcagacgaacatgacacagatgacagatcatcagattacaaggaaggctacgcaggagttacagctgatgagaatggcactgaaatggtttcatccaagaatgcagacaatgaaagccaagtggactcttttcgaaatatggctgctacatcatgctcagtttttccagttaatggccattcttctaatggcaatggtgacacaattggtgcgacaagcttctttccccagaaaactaaaattgaaaagcgcaagtacttatccccagtgacgaagcgcagaagactaactagctgtagcaatgaccagaccagtcgacgcagcttttctttctcaaaaggccccggtttagaaaaagagaaagtcaagctgccatcaacttcatcaaaaccaactgctattgatgttggtggtagttttcaatccaaatcacttgcgagctgttctggcaaggagaagccatgtcagcagataaaggatgcatcaaactctcatgccaatgacagatcaaatgagaagatgaatgtggcaaggccaaaggagaagccatctgggcataaggtagatacactggcttctgttcattcgaagaccgccgttgaggatacaaaacctgccaaaggagtagctcagtctagtgatttggtggctaatcaggttaaactagaaacaccgcaggatgataagactgtcacaattgcgcacgccccttcatcagacaaccatggtagcatcctcaagaataaggagactacttccagttcaa

SEQ ID NO: 4355 - DNA, 11399 bp, Oryza sativa
agagtgatcgatcgacaccagccttgccgaaggaagaagaacatcaggtgacattgttggaagcgacggtttatgcagatagggagatatgcaaaggtgagctgctgtagtttagagggagttgcgtgttgctgccatgtgaaggctttgcgtaggtgcggctcttgtaccgggagaggaaaagaacgagagaggcagtacaccgtacttttagagaaattcattctgtgattaacaacagggttttctttttttaatgttctcgttgatgatgcactgatcatccatggtggatatgttagcttagcttgatgatgatagtaggagcagcaagtggctgtatccattttaccgtcctttaacttaccatgcaatgcaatgttgttatgcgacagtttgtgagttgtgtcacctgcatgcaatggtggtctcggtgcgataccttcttttattcatttctcctctcctgtcccggtgctatcgttttgtggggtgggatgaaaacggggaaggaaattcccgactgacttaagtatggttttcgtacaagtggtattgattttgattctgactatttgtgtgactttctatttctagtcaaataggagtaccaaatttatttatttttctaattatcgttactatagttaaatcaatgaatataaaaagtttctgaccggtttagaattgacaggtgtgacccaaatctctcgtacgttagaggaacctcctacacttgtactaggcagttggagcagcttcctacacgtgcgtactactagctactagcacgcgtaatccaccacacagtctctgcacgtcgccgatcatcccgagccgagctccatagtcgagaaagcaacaactcggcaacgctaagcaagcaagcaacagcaaagctcagaagtcgaacgataacaaactcgtctagggcatccttgccattgctggaccgacccattaacggaaaattggaacaatcattttttgacgtcggaggagctccgtccggctgatgaagtgatgagggacgagatggatattggaggcagcctgtgtccgtctgtgtgggtggttgccgacgccaccagaccaccaccccgtccgtgcgtacgagtagaccctacatgatggttagactatcataccccacatgatcgggatgccaatgacgaggtcgatgtgtctgaagctggttttacaatgattattattgttccataataacacaaaacgaatgaattagaaagtcgataattaagttgatttcaagctctctaagatatgctgatgaagagagttttagaagcttataaaaagcatgtcacagtaatccataatcctgaacaggaccgaggtgcaacctagcgcatctggccagttgcatgcatggttttgtcagtctgggtgcaaaaaaacatgccaacttgtgtgcaatatagatcaaaatatgaatgcagcctcgtatggtagtatagttggtagattactcaaattttcatcgaaataacaagtgttcccgcgatacaaaggagaagcagcagcagcctctcctggtatcgggcaatttatacattggaagttcacagccggtcgttaaggtcgtagtctcttccagtagccatctctaagcatgtctgctctctacattattattatagtaaaacctttatggatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtggcctatatatatatatatatatatatatatatatatatatatatatatatatatatatatatatatatatatatatatatatatatatatatatatactgctccatagtagtatctctgaagcctgaacaggctaagatcactctgtacgaagctagaactagtctactgcctcagcactcagcagcaagcgaagtcgatcgaataatgtttgaaaaaaaaaagaaaaaaaaaacagcctaatcaaccgtgacagtgtagctgacgctactgcatttgtgcctgttgattcttcgctctatttttgcctcctggcagcttaagttgcttaatttgctggcccaatcttagctgtacgcttacttggcttatgctggaatcagccttcagtatctcctcttccgcttgctttgcaatgtccattgcatccctttgggtcgagcaattggagaaaaaaaaaacacagggttagaaacttgtaaggtgaagatttgggatagaaatggaagagctaatttaccggatcataatttctggagacattgaaacttcgacctgaagtaacactcgtccttgcaagtaatgcagcattaggtgttcaagtgacattttctgcaccaaatcatggtttcagtagatgcaggagggaggtgttcgcattgtcatggactgtgaaaagatttacctttgagaaatgggaggaaattatacaagacacaatggcttctgccgtttgttgtcgtgggatagcatctgagtttcttctctctatattctcccaaatccctttttggtccatgttggattccactgaatatgaaggatctacaatgcatgtacttcataaatattcctgctgtgggttttggcatggttgtgcaattaaccatgagaaagattgcacaaccatgtctcgtggttaattgcacaaccatgtacttcagaactgtacgtttgcaatacaaactgcatgtgtctaacagcttttcagaaagccacaagagttagaactctaaaatttcaagcctgcaacactaaattctctgtgtctaacagttttacataatcgtagtactatgagtaaaagatgtatttatacacttttttttttgaacaagtatgcatactagtagcagtcccgcaaaccatagattggactaaaataagataatgcacaatcaaggtagctgcccaaaacatataataatagcttgtttcacataatgaaatgcattccagtaggcagtatgtatatacgggtttgcgatattaaaaaaaaagctagagataccaattagtacatgcaaagaactcaatgcgtacagtagccaaatggttagagagcattctggtttaaaggttgcaggctacctatgtgtatgaaaacctcagcaacttgattgtgtgacttttgtatttgatgacggacagtctccccaatatcatgtgctgcactgacacttaagaaaggatatacctacaatacaacagatatcataatcaatttctcttatttagcacctaagcacccacattacaaaactgtcagggctctcatcttgaaatccaaaaaaaataaataccaaagcaataaactaaatcacaatgccatgtacctcaatgtgtacatcaagatataaggaggtcccagcttttcttcccctcaaccgatggcatccctagaattatttcaatactttcattgttttcgacttatcggtttaacattttaaaaatcatgatggcacaaaggaaatttatccaggctgtattacctttacaccatcaacctgcaaaattgtttccttgattggttgtagaagcgatggatccacagctgcatcaactagttccagcacactgcatcagtgaaatcatcacttcaagtagcatcatgaaagctagccttgaatacagtggcggagcagaaacactggattttattagttggaggggcccaacaatactaacggtttaaaattttataaaagctacagtaaatatagtgtgcttgggggaggcgagaccccttcctgcccctccctgtctccactactgcttgaatataaacttctaaaggtgaagactgtaaagcactaaacaaggaacagtaaatgtaaacagaccaaatttctttcattcttgaaaatgattttcagcaaaaaaaaaaaatccaaacattcctaattaattagacaagaagaaacactaatgcgtaacaaaatattccttgagtagaaaacaattcttgatttgagattgacaaaatatcattgaactcatcatgaccaagttaaattgaaaaccctgactgacaaaacaagttcaattgacaatcctgcttgacaataaaaagagagttacctctcatatccagtatgaacaccagctttaagaatcatgcccgagacaacaagtccagctagtggatcaagataaggaactccaagaatggagccacctgaaaaacaaaacaatgtcttaacataaacactgtaatttctgtaagaccttcaaggtgaaatttataaaccaggtgatttttcttaatactgctaactacaagataaaatagtgctctcatatcaattgcataaaaactccaggtcaaatacatatacaactatttccaaagccaacagtcccccactgtacacagggagtaatggatgctatttctagctcggggttcataatgcatcattctaccattcaggatctaaaacatgaagaaaacttgcctactagaaaatgggagttcaggccttcatttaaggtcttacctacccctaatagggcaacaacagaagaaatagcatctgagcgatggtcccatgcattagctttcatcagcccgctcccttccttttctccagctctttttgtgatccaatagagcctgtaattccagaccgtaacttaattttacactttcagatcttcttatgtgatttgtcgcatgataattaactgtgcattaataaacaaaataaattcagattaaaacagaagagttttaaggagatgctgctacctgctatggatataaacggatagaaaaataatcattagccaaaacatagaaacataatgtcaggtgttcagagctacatatattctactatcaacaaagttaacaaagaaacacttctgccattgaattacaagcattatattacaggagaccataaaatttaaaatcatggtaggcaaaaataatatcaagaagggtagcgaataacacttagtagctgaaaacagcaagaagtacaccacataagataagattgtaaaatctggtagaacaacaaaagaaaaacttacacagttttcgcagcatgagtacagtagaaaacactcacttacccttctttgacagatattgcaaaagctgtcacactcaatgcaaggattggatgttccaaatctattccatggtgatgcccactgctaccatggctatgatgagcatgcgatacattgccaataatatctggagcagaagacataactccctgaaataaacaaacttcaacatgtgaagtccatgtgtaattatgtatgatgggagtatatgtcatcagggaccaaacactaatttacaaaaacagaaattatataagaaaaaaggacaacatcactgaaaaacataaatttagtgttcttgacattgtgacattgagtagtaatagacctgaagaacgtcaaaagcatgccaggcaatcccacctgcagtaactaataacatacttgaaattccaagagctcctaaactctcaaactttccatgacctggaagggaagcaaaataagacatggaatcttcaacacttttagcgcaatcaaacaagacaataaatcaaataggcatggaggctgttctatgtagactttaataattattataacgcaagcaattcaggtagcttagaaaaaacatgagaatcagtaagaaaatgcccttactaacttttctagcatttatatcttgttgcacacatgaacatgcatgtggctgcaataacgcacaagcacatgtagtaatagcttccatactgtaaacaactgacggatttcagctcccttcatattcttttttttttctttcaaaaagtaggctaatcatcatatatgagccttgactattcttaacagttttaacacataaaacatgaccctagtaacagcctatgttctagtggagctaagtttctgcaattccattatgaatgcaagtaaactgcctatgtcaacaaaggaagtgggaacaggagattgtcgtcttgtcagtcagtatatcagttaactaattgcaaaactcccataaattggtagacagatgcctcttagaagtggcgttactacatagtaattcctggggtcagaggtccccaggtagattattcaattctagttaatttacatcatattaattagtatatcagtcaataattagataattagtatctattggaccctcggtttgccacgagcttagaacaatgcatgacatttacctaagtatcagtcctgcccccatagccaagaatcacatccgtatacaaacgaggatcacagagtagaagagaattgggagactgaccatacggatgctccttgtctctgggagccttggccgccttgtacgacagcagagccaccccgctcagcacctgcacatctcaaaaaaaccctgcacaatcagcaccaaaaaaaaaaatcaagccgaaaggagcaccgattttgtcatcagggctcaggcaacgcacaatgtcgaagagggagtgagcggcgtcggcggcgatcgcggtgctgccggagaggtagccggtgacggccttcccgacggtgaggacgacgtcggccgcgagccccagccggaagatcctctccgacgcctcgccccccacctcctcgccgtggtggtggtggtgggagtggcccacgtggccgcgggaggggacgagccagtgcggctggccgccgccgctcggctcccacggcgaggcgaggagaggggcgacgagcgcggagccggcggggcgtggcccccggaggcggaaggaggagcccccggcgcgggccacgcagccggcgaggtgggcgaggcggaagcccatcggcgttcggggggaagcgaaggctgatctctccagattcttcgggggtggcgtgcgagcgacatgctcggaattaagtttcgattgaaattttgagggttaaacagtagatttgattgaaattcaatcaaaatttatcgaaatctgatcgaaatttattggaaaccgcgatactaatagtgctcgaaatttagtggtcaaccagtaatgtaaaccctgctcctgtcccaagcttcgtcaattgcctaaattgctagtactattacatttttcacaaaatttcaaaattttgaaccgctaggttaactggtcaaacttttttttagaaaaaaatatagcagaatttcaaaatattgacgaaatttttctcagtttcaacgatttcttttcacttgtggacactacttgtacctttttcataaaattttacaagatttcacgccatgtccatcgtaataataaaaaatgtagtagtagaacaagaagaagttcatcgctgaaaaacatgattttacaaatcaaactggaattaactaatgatttttggacaaatttatagttttgaatcttgcaaaattttcaaccaagggatatagcctgttttaaatgaatttttttaaaaaaagagacaatcgtgtcaaaaaaatcataaatttagagaaaaacattaattccaacatctattttttgtgcactgtaattgagtgcaagtgcactacaactcaatataagtacaatataactctgtaaccatgtgtaattaaaaagatatacaagatgcaagatcctatgaactaaaaagtgaaagacaagagcctaaaaatatgtcacaagtaaaatagcaaaaccgttcaaacttgtgtctgaaattaccacgagacttaacaatcatcgattggccatgaggtgattacaagctacacaaattattaggacaaaaacaatttaatttatattccctccgtctcataatataaggggttttagagggatatgacataacttagtactatgaatctagacgatgagcctatccagattcgttgtattaggttatagtatcacattactccaaaatctgacggagggagtatttactagaaaaatatgcccatgcaatgcaacggtaatcttattattgttattatggtttagttaaggtaaaattcactgtgggaattcacttggatatatatatttttagaaaaacatgacttatagttaggagtttgatcgtctcaagttagcatgcaagtttatttaaagagatttcttatatgtgttcttctatatttccaaaagcgaacgacattaaaaaccgactcatacataataacacaaaataacatacttatacacgaatgacgtaccaaagtaccggtaaaaaccttcaatttttataacagtagagatgagtcctaagcaacttaaaagccaatacaataaaatatatttcattgaaaacatcataaaattatctccaaagttaagttttaaatgttaaattttgccaatggttagagcctttgcccatattaactaataagccagaatgtcttattagagaataaaattaaaatatagataacttttttacgtatttattcgtagcgacttaaaaactaacgctaaaaagaaattacgttgaaaattactcaacaaacatagtatctcttaaaacaacacttctttcaaaacttattatcactagcaacaagatggttggagtcacacaaatgcactactccctccgtcccataatataagggattttgagtttttatctgtactctttgatcactcgtcttattcaaaaaattttagagttatttattttttttgtgacttgctttattatccaaagtactttaagcacaacttttcgttttttatatttgcacaaatttttttaataaggtgagtggtcaaacaggacaagcaaaaactcaaaatcccttatattatgggacggagggagtacttcgtaagctagttcatctgcaatggaaggagactagttctctttcgagaaaatgcacattcaccatgataaaacagtgccaatctccagaatacagattgctcactgtaacaagttcaacatgttaagcaaagttacttaataacagtcaacagatgtaaaatttctcccagaagcggcagaagaattagttgtatcaaagtgacagtctctaagcaacccagtaaatctcattctgacaatctaatgctaaataattgctccacgtttattctgtttacatgagctcagccgttagtcctagtccaattccaatatacaggtgagggcttatgctatctgataacaattagaatgtgtcattgtgttcctttcatatgacaccatgtaatacatgtacaattgctatatctaatttaaatggagtatctcagctgcatggtacattccgttgtttggtgactctagccaagttctcagaaaccgcctgagttagattgtgatcctcgaatttaaggtctagattaaacctgagaaaatgcgaaggaaactgattataatttgtacgggtaaatagcaaagttgttcgagatgttatagttcaaagttttttttaaaaaataatttgatgacggtgctcaagatataattccaagctggcaggcaatgcataaagaaatgaacacatcaggtgaaactttctctaatactccaagaaataatccacttacttgggatcgagggttattctctgaatttctctgacagcagaactagctgcatataaagagatttttccaatctgtacagggacaaaacttttttcaggttctccaaaacctaagaaagttaggcatgaagtcaacttataaccagattagtactagtcaggtacctcgagcatcttcagttttgcatcatgatcatttggtaggcagcgaatctcctgggccattcgggccgactcccccaaactttccggtgacaggaaatcaagagccaattgaaccgtagactgaaacattttgaagaaaaaagagaagatttaactctccagtgagagagaatcaacaccatgtgcaattatcatgtgctccctaagcatcgatgcctcccagcatctattttctatctgtatttattcttttggtatgtctacatccaaatcactagataattaaacatatgattatatgaaaaccctgcattttttgttttttatagttcatttgcccaatttttaaccgccatagagattgtttacccaaatcgacattcacatcagcacattctttattcatagaagaaagcttttgaccatacagagaagggaagtatgagcacataattagtgtttggagtaccatggtaagaatttgatggagcaaaaattatgctttatccaaaatcttcacatatttaggttgcatattctaaatgatcacttacaaagcaaacaaaaatatttaaggacaataaaagggcaaatacgaggaacggaagaatcacacctggagatttttcacttggaatgggcagccagcaggaacaaatacagcctcaccgatatgttgttggaatgtccagggttcaattcctgtaacaagatccaaattaaggctctcacaaaaagtaacttagaaccacattaataagatagaactaaatttcaatagcctgagattatcctcataaatattattagcattctgcatggttcactaagcgcatgtactgtagcacggaaatcagagatcaggcagcaagcagatcctagcaaagcagactgcagcacttggttgcccttcaagcaaagaaccaatggagtcttattggttactggaaatttagacagctattgtctatttgctttggtattgcaatgaaatgttttctttggaatatggacacaaagtctgaggagtgagtgaagtaactacatgaaatgagatgctatggcatatcagtaatgataagttcacagctaaatcatctgccaatttagaagcgacaatcatccatgccgtactttgtgcttaccatattgatcctccagtatccttttatgatacttgttgagatatatagattgttcataaataggattcttaacctgcaacaaaaacagataatcatgaaatagctttctcaaggatatgtcgacaatatccgtcataaagaattgtgatgtcatt

SEQ ID NO: 4356 - DNA, 3853 bp, Oryza sativa
ggtgcatgagcatttacatgcattgtcattccattggcaatcttttcagatcgctcaggttgtagcctctttggacatacgtcatgccctttggctgtatgcattagcatatgcacctacaagaggaataaatagcacatgtatcagatgacttttatttcatgcacttatctgtttagaattcaaatgttttttttctccctcaagcattctcctttctgaccattggataaatatccaacagatcagacaactccctaatccacttcctgcccatccgggcatcccctgatgccctttaactgccccaatctattcacgcttgtgttcttcgtttcccccaacctcgacccaacccactgctctcacccaaccggcacacagggcagtgccacacgccagcctggcttcctaccataacctcggagcaccctctctttcccctccccaaccttctctttcccctccccaccctttacctttactctggtgcttgacagcacgaatcttcgaacaggatctaaaagaaaatcgcatgttcttgcctcctccctttgcaacaaaatcacaagaaactcgaagtgaatctagaaagccctacttaccacatcagccatgttaatcattagatttgtcactgaatcacctttaccagcttcttgatgtcttccatatgcaattaacagcttcaagccaacttcaggttgtagggtgtctgggggcaatttagcagaaagatttaggagcccccacctggaatgtataaaatcaactaatggaaaattgacaataaattctggtctttggcatagcagaaactcctccaatacactgggtgggggccactctttcaatttcagcatcatcaattccccatcttcccccttgtgaccatctgaataacctttgataaactgtttcagctcaatatccacctgaaaagaaatagaacacaggatatattgttcagatgatcatagtactaagacttggtagctagaaaaagttatcaatccatcacttctatgttacatatttgccagatgagtaatacgtgctatgatcatgaattcatattcaaatagactagcagtagcactaaaagttaatagcatggcaacatcccagaatagaagtcatagcacttgggaatctatatagtgcaaacaggaggcacagtgaattcaaataggaagcaacttttttgttcgcgtgccttatgcagaaggcgagataaatctattcctctatctaaaaagagtaacttttgttcagaaagacaaattagcaactaaaatttcctgctaacctctgcttggtttgagcaatccacagctttgacaatgacatcgtcatccacttcttcatccatgatttcctggattcctcgccaaatatttagtgggtcccagcttgatgacagagaaggctcaaacgcattcctgataactacaggttctccttttatccagtgtttacgaaaatgaataataccttcagatttcaagtcctctaatacaggagagaacacacagaaccgatcaataccaccattatttgaacatgttgagacaccaaagttacgatgaccagttaactctaatgttctgccatcattgcaggatgagcatccattctcaagaacatgtactttacaaccattgaccatttcctcagaattttttacaagcttactaatccagtttattttgaatattcgccttaacactaacttcgaggagccacaaccaccagcctcatgaggcccacaagtaatgcttccatcattattgactctccatgtagggaataaagatctaatgtcaatattttttatgtcccttcgttgtgggactgacttatcatttgcactttctgcagatggttccattcttgctcttttattcgaagtatctttacttctatctaccacacgaccttcagcatattctcctcttgcaacactggtcctagatcgccttatgtctcgacaacagtcaagacataagtcatacaaacaccttgggcagtgtcggtgataatcaaatactggcactttgcagaagtcactgcgaggataatttgaggtatcactacaagccaaagcatagaaataagaatcttcttgtgaaaaataagcaacagacagtaccagcacatttgctcatcaggattgaccttcgccctgattatatctgtcctaagtcctacacaaagaatatggtgcgctagtgttagaaatatgagattattcggatgaaaataacagaaaagaatgttaagaggggaactggaataccataagcttttgtatcaacaccaatttcgaaacattgatcagaataaatctgctttaatactggaaggacagatgccagaatgctatgaagatattccaacttatctacagcagatatctcctgaacccttgccttgtgatttaagagtgaaaataataaatttaagaaaaatcagtcagcataaaaataataaataaatatggcaacggagaagggaaaaactcttggtaaaggttaaatacctttattacattatctcctagtaagcaaactctgcagttacaaatgccacgacatgctggacaaacctttcgaacatcatcaattgggatatcagagtacctacagttcatggtaacattaaaaaagtgtaggacaacataatgcatgtaatgatccaaaagtatccagatggctagatatatgaaatctggccaaataatcacaaggatgtcctggtcaattttcaatagtttggcttcacacttccaacgaggacagtttttctgtgactggagggagtacttcatatgataggtctgtggtgtccggatagccattgcctttgcatttggtgattttgagtgagccgatggggaaaaattagcctttaaaagacaaggcgaagattgtacttctgaaattaataaggtaactagtaaaatatccatgtgctttggctgcatattggaatagaatgccctaaaacagttttttttttaaaaaaaaaaaacattgtatacacaagggttttctatgtgaacaataagatgatagtttgggaattaccattactaaccgcagtgtgatcacaaacattaattgtctagcaacaacttctgaggaataattctttcagtgtgatcatatactaatcataagctgcacacatagttgaagaagatgctagattctaataggtcggcaagggctctgcctagggcaaactcgaccagagaattccaagcaattagcaagcatattacataaaaatacacgatataacactaaagtagcagcagaatagcccccaaggcaggttagctgcataatccaccatctaatgcttaatcgcggtggctaccctgcacctagcagggacttttagaacacaaaaactgagtgctgaaaataaaattctctaataatagttacaaatggtcagtcctcaagcctgttctgaatctactcggaaatcatccttatggggaactaaaatttactctataacagcacaacatataccggagcataccatctcgagatgcagttggtgcagtacccccttctgtcgcagcttgtacaacaaatggtattagcgaccctccggcactgatggcaggttgcggccgctgccgcccccgccgccgagctgcaggcaaccagccccgccgagcccctcccgaccagctcctaccatcacaaggcacgacgaatcaatcagcaccaagcacaccgtggatttacccaaaactagaacgcgtcccggaacccaactcaccgccgcggtgcgcgcgccggcagcattgcccatgggcagcccgtggaccggc

SEQ ID NO: 4357 - DNA, 4865 bp, Oryza sativa
  unsure (1)..(4865): unsure at all n locations
gctgcgcactgtgggggagagagagacacacaggcgaggcgaggcgaggcgcggttcggttcatcagcacgcgcgttgcgttaaggcggagaagaggaggaggaggcagggaggagttttaccggattgcccctgcgagatcacgcgggtggagtgagggatttgggcttttttggggtacggtacgagacgagtttgcagaggggccagcgcggtttgcgacaaggaaagggacgacgagatcgcctggtgcgatgcgacgacttggcacggccgtgggggttgggctcgccaggcagtactgcaggacagtcaatgcatctacaagcggcgtcagattgaaaatcgacgctcgtgggttctgttcgaagctgatgattcgtacaacaagaaaagcattaacgccctatgaattactaaaatttaattattacaaatggatttatttgatagtttagagcagtttctatatagaaagttttcatacaaaacacaccgttttagcggttttgaaataagtaccgatgaaaaccgagatagaaactacatcttaaccaaaaagaacagtatcactatcatttcgctcattgtcttatattttcttcatatcacaatgaaataaggaaaggggtagggaatagtgccaagagcaacggcaactattgatgtggcctctccctacaggttaagagggtccgtctcatcttgttgattgtagcactcatgtaccttcaggttgaacgatggcccctgcaattcaactatctaagacgacatgtggtcgagagggtgagggacgggcgatgcctctaatttggagaaaatttgatacgtaagaagaaaacaatccggcaaaaaaaaagaaccttttgttttcgaccagaagcacagaccaccagtttttatttgactcatagcacttccatgacaaccataaatatggtggagtgtttagccgtgagtcagcacttatttttagatatactaattttcccctggtcatgtatgtctagcatagcaatcatggttaggctgatgttcgttccatcatacttaggttgtgttctttctcatgggttcccaacccatttccctcattttccacatacacacttttcaaactgctaaacggtacacgttttgcaaaaagtttatacaagaaagttgctttaaaaaatcatattaatcaatttttaaagttttctatggctaatacttaattaatcgtgtgttaatctatcgctccgttttttatgaagagaggaggggttaccaacccctccaaaagaacagagccgtaatgtcgcacaccacggaagagaaagggcaatggcggcggttgcttgtaaggcattccacgttgggcaaagggcgacggtggtcacgccgctgatgatggcagctagcagcttgtttgacgacgacaactggcagcttgcttaacgatagcggcagttggtggcttgctcacgacggtggattaaagggagctacctgctaggtaaaggcatgagtagaacttatctagaacatggaataagatagaacttgtcttgtgtccagaataggatttaacatatatttctttttttcaagcgataatgcttagtagaacgaggagatggggaacgagaaagaggagatgaggaacaggaaagagatgagtgtatgtggtgtggaaaacgaatggcaaatgagactgaggataattttctctaccccgatctaacgtcgccacctcaaaatacaacagaagtgctataggttaaagaaaaactggtagtctatgcttttggtcgaagaaaaattcttatagtaccaagttatttttggtgctatacatcgaatgttcttttaaatctttttctcctgtcatcaaactcataaatctttttctcggtaacaaaccaccactggatttggctaatttggctaatttcaaccgggtgacaagttctgtcttcaccggattcacccgggaacaagaaggatgatatgaaattaagtcaatgtgtgacaacaacatgaacatggtgagaccagcgagaaaagaaatgaaacgaacgtcaaaatggctaatgcagttgttagaatgatactaatgctttcatgcaaacgtttggatttatgtgtgaatttagatcgatcgaatatgaacaatcctatgggatttacgtttagatttatgttaccatgaacggtaggtactctgatatcctatgggatcgtgtgaattttctatatgattgtttcaaaaggtcttgtatgattttaattttaatggacatttttttcctaaacggacctttgaaataaaggactgcacgctattggatcatatgaaatccatataagatgcctcaatccatacatcatgttttcatgaaaagttttctttgagtctttttctctcctcaccatcctatatttttcctgcagtctaaccaagccatcattcctatatttttatgcattttgcaattctctattttaaacctatttgatttgtaggaaaacataggaaattaaagaattttaatcctatgggaatttctagggagaccttcaaacaaagaattgaacaatcctatagaaaatttctaggaagacgtttgagttctatttgtatcattataatactctgttctgcacatatatttttgtcaaaatcatgtattttatacaataccatagcatggaagataccactcgataatcctttcactattcaaattgtatttcaatcataaattttgaacctgatcgcacaatgcttgctttcgaattcaatggaaaaaagtacaccgaaggtccctcaacttgtcatcgagttacaaaatcgtcacccaaccgtaaaaccggatacaacgtatcccccaacttacaaaaccagtgcaaactaggtccctcggcggttttgactccggttttatccgacatggcagtggactcagcgtgggatccacgtgggccccacgcatcagcctcttcttcacctcccctccctacctctattcctctctcctctcttcttcacgggctccagcgggggaacagctgcgcgggggagcagctgcatggcggcaggctggcgcaggcggacgacgtcgtcaccttgatgtgtcccaaaccagccgccgcgagcgcggcgtggacgtctccatggccgggacgaggagctgcatgtcggcgctggagacctcgttgcccacgacgacgaaccggaataacaccgtcgggtaggcctggatgttctcgcggatccaggcggccgtggcggctgtcctgccgtgcgccagggcggggaggtcgtagttgggcgcaccgacgacgacgcagatgcctgtgctgccgagcgccacgagagcggcgctgtccggcgtgtagaggcggacgacggtgaagcccttctctcggagcatctcggtgactttgctcgccggcggcaggttgtcgccgttcatgccccagcacactccaaccgctgtcgttcctgtctcagattccatctcttcttcggcattcatctgcgccgtggggaaggggaaggtgggcatggctttctcctcactgtccgaacgggctcaccggcccctcccttgaccaagcccagcgagcggtggcggcggcaaagctcggccggggcgagctcgacggctacctctccgcccctacgtccctggatccccatccctcctcaccgctgcctccgtatcctcggattctcatccgtccttgccgctgcccccgcgtcgccggccgccgcgccgcgctgccacggcacatggctgctgccgggcagcccacgccgaaaccgccgcccaggattcgcacgattgcgctgacgcggccatccttcgccagacagcgccgttgcacggccgctctgcccccgcgccagggtcgtcgcaccgctgaacgagctgccgtcctacaccatgccgtcgtgccgcagagaagtgagtgagatatgaggaagggagagaagagggaaagagagaggatgctgacgtggccacactgacatgtggggcccatgtgggtcccacgctaactcagccgatatgtaggataaaatcgaggtcaaagccaccgaaggatctgctgtgaccggttttgattagttaagggacaccggatatctggttttgcggttaggggacgattttgtaacttgatgacaagttgagggaccttcggtgtactttttctaattcaatgtactgtgtaaagctgggaaaaggccagatccattcagagtttcagacagagcccaacaaaaaggaatcaagaggtaagcccagaaactgaaggtttacacgatcaaagaggcccacccgatgatcatcgggcgtcatcgccattgacttatgggccttcatataaaattcgcatctcgatcgatgggcctcatactgtgcaacttaaatgagtgaggaattcgattcatcctcgacatatgtcatattgtcatggatgtgtgtttaatttggtggtgaggcattggcaacgagaaacgcaagttcttttgtatagatgtacacactttctttttgacagaatatgttatatgtatatctaactatcgtgtatctaacaattaccccctgctaatttagttgggataaaaatatgattttttttgacaaaaatattatcactttgtaaataaattaaaagaaaagttatttgccaacccgatcgagtacgtgaataattacactgagtgaggttatcatgaactcataagagtaaagtccatcaccggtccctaaacttataccgctgtgtcatcccggtccctaaacttgcaaatcgaccgttcaggtcctnnnnnnnnnnnnnnnnnnnnnnnnnnnnnnnnn

SEQ ID NO: 4358 - DNA, 6935 bp, Oryza sativa
aagattaagtctaggtgtgtccggaccatgtcgaatataaaaaacctcgcggtttttcagtcgagcgtgcatagaataaatgacaaatattattttaggacacaaatggttaagcccggaatccgtccgatctactcggaccaggtcgaatataaaaaaatcatggtttttgtgtcgagcgcgcatacattatagcaaaacggtttttttgggacaaaaaagattaagtccgagtgtgtccagacctgatcgaatataaaaagcatcatggtttttttgtcgagcgcacatagaataaaggacaaatattattttaggacgcaattggttaagcccggaatccgtccggtctacctggaccaggtcgaatataaaaattcgtggtttttctgtcaagcgtgcatatattatagcagaacggttttttagtgttcgaatgtaatttgttggaactttttaaaaaacatggtttttcggtcgactgcgcatagaataaagtggaacggattattttggacaactagttattatgaagccatgatcaggtcgattttaaaaaataaagcagaacagattattttcgggaactagttattatcaagccccgaccgagtcgattttaaaaaataaagcggaacggattattttggacaaataactatatgtacagaccaggtcaatttttaaaaaacatagatttccggtccaccgtgcgtagaattaagcggaacatattattttcgacaaataactattaagaccgggattgtccgagccaggtcgattttttaaaaaaacatagttttccggtcgaccgcggatggaataaaagacaaatactatttatactattttaggatataatgtcgaatattaaaaacctcacgatttttttagtgtccgaacctaatttaatagtgaatctctgaaaatatccacgtatattctcagcaagtacagcccataaagaaatttggaggccatctacgaacgagtgggcctgtatcgagaggcccatcagccgaagcgctatttggcagcacaatctggaatccatgcgcaattacataatacacccccctaaaaactgaacttacaagaataccatatgattttttttccacaattactcttttactacactactactccatccgtcaaaaaaaaaacctttgagggatgtgattcagtttatctcttttttgacagagggagtacacatttatattaggtgtagtagcaacgaattttcacccttatatctcatctcttcaatggtctatattcatttagaggtacactaaaaaaaatccatttaacaatggactcagttgttgtttccaagtgtgaattaagttacgtctaaccaacaaagacacacacgtgttgaatgtggtgttcaatgtaaagtaatttcttctacaggatgtactatgagttaacattttaagtagaagtagaacattaattcttacaaaataaattggatgttgatcttcttattataactggagtgcaaccttatctgtgtgctactcccgcgccgcctcttcccccaccgcatctgctgccgccgctgccttccccggtcgttccaagccatggcatcgacggcctccctcaacgccaagtcgcatcaatgccagtgctcgtttcttgaggtgagcgcattccttctcgttcttaattgaaccgaaaataggcatcaagatatataagttgctgcactaatctgcaagtttctgtcagaaaacatagcaatgcatttagagcttgattttagttagcaacttagcattatatgtgaaaatgcatttagagcttgagtttaattagcaacttagcattatatgtgaaaaaaattagcagttatataagatatatgattgtaaaaactacagcggctgccggtagggatttttggtggtaagtattgatttgacaattttggatttttggggctgatttttagtaattagattcaggttttaccaaattattcaggtctcctacatcactgctcactcctatgcatcctatgcggctgttgctactgtctgccaagatgagttgaatcatctcgctgcacttggtggtgatgatgctatcagatgctatctccatattttaatgtatgatactgttgactttttatccaacgtttgactattcgtcttattcaaaaaatttatgtaattatcatttattttattgtaacttgatttatcattaaacatttttttaagcatgacataaatattttcatatttgcacaaaatttttgaataaaacgaatagtcaaacgttcgtcaaaaaagtcaataacgtcatacattaaaatacggagggagtacatgccatggaccaccgttgtttcttgaaatcttcgttaattatatcagggtatccagagcaaagcacggttgaggtaaatacaatttcttggatcacagtttatctgaacaattaaccactcttgatgtacatgtcacatgttgaaaaggtttccagtgcgtattctgaacttatgttagcaaaaaagctactattttgccaccaccattttgatttatgtttagatagttaaactctgatatcatcatcctagagatgtacttgaggtgagcacttgccatctcgttcttaattgaacttaaaatatgcatcaagatgtgtacttgcagataacgatgccttagctgcacaaatatgcaagtttccttcagaaaacatacaagggcatttggagcttgaatttagtttgatatacgaaaaaatgttagcagttatctaagcttgaatttggtttttcttagttacgacagaagatgaacatagaaagatttgcatcgtcctaatatttgtttactactttactgcttccacctggtctattgcgttgtactagtaattaattttttcgaactctgacatagtgcagtgagaatgactctaaagaagcaaatgaagtaatagtaataggggaacttcttttgcgcatcaggaattagaagcaaatgaagtaatagatagacaacctcctgaggtagtgcgtaaaaatataaggtgtatataggtccttgctgtgccgttgaattcaacaactttttgttgtacgtgtaactaccacgtgaaaactacaatgatatgaagattataaagatgtgatgcaattatcgtttgtgcttcaaggttttcgttatagcagatttatattgaattattattttatatcacattatccagtgattcaaattgatgtacaatttttcccgttgcaacgcacggacgtccagctagtagtgactaactgtcgttcagataagaattgcatcatcatgaaagaaatagtatacagagctttcgaatgcagagcttttaatcgaaagctaaccgataagtctgcatcctgcaaaaacaggatgattaacagaagagaggtttattgaacaaatcctaagcagtggagtactccctccatcctataaaaaaccaacctaatactgaatgtgacatatactagtactacgaatctgaacatatctttgtccaaatttattataatagaatgttacatacagtcgtagattcaattttttcagtgggacagagggagtactctgctagtcagagtaggaggtttattgaacaaatcctaagcagtggagtactccctccgtctaaaaaaaaagacaaaccctgggtttccatgtccaatgtttgactgtccgtcttaaatgaaaattttttataattagtattttcattgttgttagatgataaaacatgattaatactttatgcatgacttgtctttttaatttttttcataactagcaatagtgcccgtgcgttgcaacgggaaaaacaccgtttgataatgtgacactttgaaaacctcaaatctgtaaaaatcaagtctaatttgatatattaacaaataggtagaaccgagtctaatttgatcaattagcataggatttaggatttagttttagatttatttttcgagcctacttaggagtttatccgacggactttaatttgaaaaatgtaagccacattgtttgatcaaatttgcttttggcctaggtcttcccaagccggtccaaacttgggctggcccatctttagcgagttgagtcaattcaacggcccgcaagctgagcagctaagtgcggcccacatatgcgggggcggtccgatgcacttccgcggcccattgggcgcagcgtaatcaacggcagcgacggcccgtcgctgggcgaatctgagccgtccgatctaatggacggctccaatcgtccccgcgccggatgaagcgccgactggggagaggggcaaaaccctagctcccaaatccctctctcctgatcccatttccctccggcgacgagcgagcggaacgacggctgtccggcaagttggtgcgcgcgtgcagtgacgaccgccgagcggctcctgcttcgctggctgggggagcgcacccgagggcggcgcaaaaccgtgccacgatgtcggcggtccggctaggtgggcgtgcaaacggcgacgagcgccaagtggcttggacctcgtcggcggtaggagcgacgccaagccgacgcttcccgtcttcggcaaaggatggtggacgggtgctctaggacagtgcgcgtgcagggaacccggcacgactgcgaggaggtgaaggtgcggtggtgccgcttcctgaaaagctccggtgagctcaggggcttcaaatccggtaagtaacccgaacccttagcttaattgatttggatttgactcctatggttcttacccaaaattagagttcttcgaatttagagaattttatcgggaaatttcaatctattttattctctcttttcgagttagggaagtttcaatatcgtttatcctcttttaattttggaaacttcaatctagtttatccctttgctcaatttcattttttttttttgctttggctggcgtttcattgtgcgggcagggacggagggcgccgctcgtcccctcggaaagattaagattaagataagataggattttcacggacgacggaagtaaattgaatcgaactttcttttatttgttttaatgtttttttcgccctttttttgttattacgaacaacggaaacgtttttaattttttaagtagtagagatagagaagatagatatatatagtaccgtgtcaaatataataggattcgacttttttttaccgcgtcacatgtaattctttttttttttggatcggacagatttgttttttatttttttcgctctttttttaccgcgtccacgcggataagtttttttgccggtctttttttcacctggttttttttatgcctgtttttttaggaatcggacatattccttttttatttcttttcgcccttttttttaccgcggaatcggattcgtttttcttttcccttttttccctttttttatcggacagatttggtttttctttttttttcgcctggtttttttcgctcgttttgttttggatcggacaggtttttttcacctggtttttttaacggacgatggaagcacctcttattgtagtatagatagagaagagatagggattttttcaaataagacggacggtccacgttagacacgaaatttttaagtagtagagatagagaagagatagagattttttcaaataagacggacggtcaaacgttggacacggaaaactagagtttgtctttttttattattattttggatggagggagtactctgctagtcagagtacagatgtgggtatgtagcgttcaccaaaactataacgttgcgacttatgcctgatgatgcgaagctcgtcgtcgtggccgcgcaccacctcgacgccggtgagcacggcgaaattcctttcatccgactcgaaatcgcagcagtattcggtgcaggtcccccggcgagagaccgtgtacagcttggcgacgcacagcttgctgtcgcctaggtggatgacgtgcgacgaatacacctcggtgaattcgccgaggtcgatggcgtgcgacgggcgcgccctgcgacgcgacggccctggcacggcgaattccctgcacccggggtgcgccggcggcggcggctccggctgctggacggtggaggaggacaggtcccacgcgccgaggacgccgtcgtccgcggcggagaggccgaaccagagaccgtgctcggggacgaactcggcgtggtcgctgaagggcagcgtccagtcgccggccttgctccaggtggctctcgccgtgtcgaaggagtaggtgccatgcctcatcgacgacagcaagatgtgcgagttgccgaccgccgcgtacgcgcaggtgtcgccgacgacgtgtttgtagtccgcggcgtgcacgtacggtggcggcggcatggggcgccagaggcaatcgtccaactcgggcttcttacaacggacgagcgcctcgaaagaacgctcggtgacgccgtcggggtgaggtgacaccgccatgacgtacagatccttgccgacggcgagcgacagtgtccagagcttgggcgtgaccatggtgggcaacgcgccgacgctgtgcttggcggggtcgtagatgattgtgcggccagcctggtcgacggcgattatcttgtcgtcattcgtgcgcataatctccatccacgtgatgttgtccgtccccgaattgctgctgccggggggaaagaagttgatgtcggttggaggcaggcgcacgtcctccacggccgccggcgacgccgccgccgcccccggtctgcatagaagagaccttgatgggtcgattcggcgtagcctctggaaggaagagtctacagcccgggaatcaaccatgtagaggaatcgccggtttttcgtcttcttcactttcttctcttccaagatgccggagcgatt

SEQ ID NO: 4359 - DNA, 3409 bp, Oryza sativa
  unsure (1)..(3409): unsure at all n locations
acccaaatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggagaattatgtaacatgaagaaatagtagtacaatttgaatatgatacaactatttgcattgcggttacatagatgatattagattcgaactaggagggaggtagtgcaatagttgaacacaacaacgatgtagtaatgggacaaggaagcatgacagtagaaatttcaatatgccaagttgtccgataatagctaacccctacgtgaggatccctctcctctctcaaaccgcgctttagtaaccctgtattgctctggtagtttaagctgcacaacacggctaggtggagttagaatccttctggtgtctatccattctctgtattaacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagtcgcttttctctgtaagtattgctcagtactttcggatgcgaaataccagcgaccttcttataaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgctagtttggatcctcaacacctcggcgtctagccattgacgaaagccggtcggatttgtaatgaagcaagtggggaagagagtactgaatgtgactgagttttgaaagattgtgaggcctcacacgttaaggcgacttatataggcgcaaaaaatcgagtgatacccctgacatgtgaacgtggtggggtatggtgggtatgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcaccacgaccacgcctggtcctccgggcctgtgctcgcacgtggtcctgggagtaggtgaaacgatccggtggcacagcacgggtagcacgagtgtcccgcggaggagtggcctgcgcatggtcctgcgtctgcaccggcggtgcgcctcccagctgtgaggggccgatgacgtcctttgtcgaacctgaagcgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggttgacacagctgcctgagacgctgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcgacaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagaactcggagaatcgagcgcatcgactccaccatccgcgtatacgtcgtcaggtgctcctctacgggtaccgaaatccccgcgcctaaacgttggatcgtcgttgaaccgtcaacgacgatcccggttgatgtcgtcgacctgcatggttaatttgttcgtaaatattcgtaaaatttgacgaagagaaagacatgaaaacataaaggaatggtgcgatgcagggtactcacaacatgagcgaagtcctggtcgcggtgcctggcatagaggtctctagtgctcgcaacgtggggctgctgctccaagggagcgaaggtgaccctagtacaggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgttgacccttgcgcgagtacctgcgaattaatgtttaatattagtgtgaaacgacagatgttacaaattattgtgaacaggcagattttaatgcaacaacggaaagcgtagtgcaagaagcaaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccatggcactgtagggctcccacacgacgtcagtcggcagaaggcggtcgaactccataacaaactcaggatacgaccgcctaacctggacgtgggcccatnnnnnnnnnnnnnnnnnnnnnnnnnnnnnnnnnnnnnnnnnnnnnnnnnnnnnnnnnnnnnnnnn

SEQ ID NO: 4360 - DNA, 2292 bp, Oryza sativa
  unsure (1)..(2292): unsure at all n locations
caccacagagtacccaacgtagggtagtcgacctctggtcgctcctcgtacagtgacttctcgtacgtgtgctggtccacctcaggcggccgatcgcaatcctctcagctgcccagatagaaagaaagagagggcacccaccaaaggtcgcgttgggatccgtcttcgtgcaagactcacaaagtgcacggtacagagccgccaacaacgtggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctcggcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtacggtgcgcgctgtactagtgcgaaacatgccgtcagatcgtcctgccagtccacagccgtggtcactggcccaacagcgtctcccgcgagcggtagccccaacaagtacgatacgtcctgtagggtatgggctacctcaccgcacgacaagtgaaaagtgtgcgtctttggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtggtgaaccgtgagtagctcactgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaagatagtaatgtaaaacaaaagataacttgcanaattatgaaatagtaataaaatcatgagattaattatgtacaacaagagtacaggctatttaaatatagcaaacgttactaatggtacataacgatgacgtgcaatttaacatatatgtagagttcaataatataatataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgctgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatggcatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagttaacggacaccgcgcatcacccagttgtaaacttctgc

SEQ ID NO: 4361 - DNA, 1845 bp, Oryza sativa
aacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgttgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaagatgttcaattgaggggaatttcttcacttcgtaagagctcccagggtttctttcctcgataacaccaagcaggcgtggcaaattgtcatacgaggcttcgcaagttccaaatctcatctctattattttgtttggccctccaggccttggcatagctaatagtatatttgtatgtctcttcaatgtgtcggattattgaccttggttcatatgtgagattatcgatgacatgcacatacatctcagatgcaacaaatgcacatgtaatgttcctgtggtatttctgaacaccaggtagaaaacatgtatgcttcgtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttgtgctctactataaatcgctccctgaataacctcattttatttgtactcccatctcacactatcctcttcagagacgatcagcccagaaaaatcctcactagcccat

SEQ ID NO: 4362 - DNA, 9658 bp, Oryza sativa
ttctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgactgttatgtcacttgtctgtggatcaactctcaagcccctcattaaccatccttttatagaaggtacactcctctcagccggtctctcaattcccctttctaatacaataaaatttgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgagggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaatctaaaaccgaaaaaaattctctttcttacagccgctatagttgggccacagcccacggcccatggctcagcgaaccggatgcgggttggaactttggaagccaccgccgtcggaagggcacgggcacgagacgaatttttttcatttttcattttttattttttaatatttacagaaatattgtactggtaaaaatatttacagaagttgagagacgtgagggacggacaagttgaaaaaaaaaagaaaaatgcatttttggcagggtaaaaattacatttacccccatgcagctcttgtagagggtggtaagggatatcagtgcaaaatacgcacaccttgccgctctccacttgggcagcaggggtcatctgtgtaaactagcaaaatgtccgtgcgttgcacaagataatggctaggtttataaagtttgacctcgatgattcatcgaagcacctaaagtatgttctgcttgcgtcggcgcctctccgactcccttgcgcagtgggccggtgccaatccctcccccctcgtggcggctggcacagatcgatctcctttcctgtccttcgtttcctctctttgctccctactccctctcagccatagcgacggtggccgcggcaataatggccaaggcagccacagcgacagcggccgtggcggcgatggccaaggcggccatagcggtgacggctccgcagcagctaagacggccaaggcgcgcgggcggcgacgacgctggtgggcgatggatccggtgttgggaggcgcgtgggtgacggcgaggctagggggcggtgggggaggttcgagggtagtggcgagcatggtgggtggtggatccggcgttgggaagcatgccagcggcggtgaggcagtgggcagccgatccggctgctaagttcaaggcttctagtggccgacttccgagcataatccctctgcctcctgaagctgtcaccgccgcctgcttcctcgacatccctgccaaatcggagcccggttgcctcctcactaaagcgctgagcttccaccgtccgccgaagccgtgcactcccgcttggagctcacaactgcaagtcaaagtcacctccgcaaaatcaggttagatccgattgatttttgtagcaatcccgtggaagtatttatggggttggttttatctgttcgagtccaaatcgaatatgcattggattagagttctcctgtggatctcttttctgattctatttgggtggattagagtctgatttgaattcacaagttctccttttagttagaatttcaatttcgaattgggaatttgaaattttggaacaacctagctgtgggaattttgttttttccttgtggtgtgtgcatccgattttgttgcgctgattttgggaagtgtttccatgtatccgattctgatgatttagtgatttttctaaggtgcactgagggatgaaagcggcctttcccgcaaatcggaaatcgaatgcactcgtacggatagatgaaaaattagtgcgatgacggacgaaaacacggacaaaaacacaccaattaaaatatttttatataattattttttattttagttaaactttattttataatttaatgaggaggatttctttgtattttagccatgctcttattatattgggttaattggatccatgccactacaactttgccaaattaagaaaaaaaaatgcaactactattcgtcatatctgctgtatgccactggaaattttaatttgccaaagttgcagtggtatgatccaattaaccctataatattttagtccttatattttctcaattattatttttctcaaaatagtaattattatattttagtaaccttagataaaaataatataattgcaaatgcaactttgttggcccatttctcagcctctctacattgtctgcattattttccacttaattgttccctctctctcctcattagtttttcccctttctttcccacttccaccgacgagcgaacgagttctccagggacctcatcatctgcttgcggggagaattttcagaatataacactcaatacacactgctttcaatatttgtcactcaattcacactactttcagaatacaccactagagtgtgaattttcttcgttccgtgacactccgtcatcccaaaaccgcgcgtcgtcagttcattcctctcgccccgtttgccctcaccgccggcgagctcgtcctcccccacgccggcgagcttgtcctccccacaccagcgcctgcgctgctgggcgggaccatccacacggtcgccggtgacatcgcctgcttgccgccgtgccggatattgagatcgagccgccactgttggcttggaggagggggtcggcgacgatgggggtagcgcggggggaggagccgtggccagcgcctccaccgggccgccgacagccgcgcgcgtcggctgtagcttgcggcgccgcttcgcggtgggctcgtcgccgcgggcagccgccgcgacggcggagggcgactcgatggggatgcggaggacgccgtcgacggtggcttggaggaggtcagccgccggagctcgaccaccggagcgacggcggctcggttcgctcgtgtcatccccgagctcagccgccgtcgccagtccaacctccgccaccgcggcctcgagctggtatagagctcagtcgccggagctcgacgccgacgggcggcggtggggctgacgcgggcgacggaggggctgacgcgggcggcggcgcggctaacacgggcgcgagcggtggctgactgatgacggcgacgtcgggaggatggagaacgacggcgcgactgacggtaggggatggaatagcacggaacaaagaaaatttgcactctagtgttgtattttgaaagtagtgcgaattaggtgacaaatcctgaaagcagtgcgtattgggtgttatattctgaaaattctcgcttgcgggggttggaccctggagcctggagtcgaagagcttgccgccggtagaatccatggtgcggattcgcgccagcgtggaccggccaggtccgtggccgcgcagatcgagcttgcatgggctggctagctccctggtaggtccctgtcctcctctcctcgctctgctctctcttcctccatcccggcatggattgggcgcaggtgacgcggatcaacgcagccgctcccggccagcatcaacctcacttgaaagaagcagagcgattttccaccttggctggatcagatactatttgtcttcgattctgtgagtttatatttgattttctgtcttttcttcaactcgattttgttaaagtatatctctgtgtaatccgtgtgctttggattaggatggccggtggattaagctatagattagcttaggttgttgtgatcacatgtaataaggatccggccgttctatccatagcgcatgcctatttgtatcttctccatcgccgttttgtgcgataggttaacacgcatcgtcgacccgagtgcaaaggacgacgttcccatccatcctgttttcccacatggtatcagagcgctgaagttagatcccatctaccatggctagctcctcctcttccacctccacaaattccttgttctgcttcaatgtttctgagaagttgagcaagcaaaattatcagctgtggtgcgcacaagtgctgactgcgattcgtggggcacgcctcaaggggcatctgaaaggcaagaccgtcactcccgccgcccacatcgaagcagaaaagaaagaagatgacaagacgaagatcaagatcatgatcgacaacccagcgtacgaaagagtggtttgccgcggatcaacaggttctcggcttcctcttttcatcgctgtcacggaatatattatcccaggttgccacggcgaccacagcgacagatgcctggaagatgatccaggagatgttcaactccagggcgactcgcgcgcgctccctcaacgtgctgctatctctcaccagcactaggaagggaacccagaccatctcagagtacttcgccaagatgaaggccttagcagatgaactagcgatgtcagggaagcaagtcgatgccgaagaactcactgcttttatcttaaatggtttagatgatgattatgattctgttgtatcggctttagcggccaaaactaaacctattactctatcagaaacatatgcccagctattgaactttgagaacaggcttaatctacgacgagaaggcaacatgacggccaatgtagccgggcgcggccgtggcaacgctccgagcaaccggggtggtgccggccgtggacgtggtggtcgcggcggcttcaatggtgctggcacaaacgccggctgtggaggacgtggcgctggacagcagcagcgctccggcaacgacacacgacccgtgtgtctggtgtgctacaagcggggacatgttgcagcagattgctggcataggtatgatgattcttatgtgccagatgagcgacaccttgctgcagcagcctcctacgcctattttttttagataagtcaccggaggggagaggttccccacctgaattgcattaaataaatagagtaagggttacaactgagtttacatgacatgaagagattgcaagggggaggagaagatccctttccaaattgaaactacaactctatcaggaggcttaagacgttcagaccagagagaacattcgtccacacatttcctaattgctgccggaactgaagcatccaggttgcggaaaacaacgtcgtgtctgtggttccatagtgcccataagcagagaagatagaagacatggtggtgcagctcgggcaggtttccattggggcgcagacgtccgagttgacgaacatcctgaataagcgggtcaatgccgatcgtcgtccagaattgctgggcaaaggggcaaaggaagcagatgtgacttgcaatttcagatgcagctccacaaatggagtcgactccaatcggtacatggtctcaggcgccacggaccacatcaccggtgaactggacaagctcacggttagcgacaagtacaaggcgaacgatcaagtgcacactgccaatggagcaggtatgaaaatcgagcacattggtcgctctatattgcaaacccctatgcgcaatcttatcctcaaaaatgttttacatgttccacatgccaccaaaaatttagtttatgcatcaaaacttgcctccgataatgctatatttgttgaacttcatggaaaacattttttggtcaaggatcaggctacgagggcaacaatgcttgagggacggcgatacaagggactctacccgcttcctccttcatctcctgcatcctctccaaaggctgtttacggtgtggcgccatcttttgcaagatggcatagtcggctaggtcatccttcaagtcctatagcgtctaaagttattagcacaaataatctaccttgtcatgacaaggctagtaaagagtctgtgtgtgatgtgtgtcagatggccaagagtcatcaacttccttacaatagatctactagtgtttctcaatttcctttggaactcatttcctcagatgtctacggacctgctcctatttctgttggtagacataaatattatgtgagttttgtggatgattatagtaagtttacctgggtttaccttcttaaagcaaaatcagattttttcaggtcttccatgaattccaagctcttgttcagagaatgtttggccggaaaattatcactatgcaaaccgattggggtggagaatgtgagaaactccattctttctttcggcaaataggcatctctcatcatgtatcctgtctgcatactcaccagcagaacagggcagtagaacgtaaacaccgtcatatagtagaagtaggtctatctcttctagctcatgcatctatgccactaaaatattgggatgaatccgttttagcagccgcatatattattaaccgagttcctagcaaggttatttcctttgaaacaccccttgaacgcctgttccatcaaaaacctgattattctgctcttagaatctttgggtgtgcctgctggctgcatttgcgcccctacaacaatcacaaactccaattgcggtccaagcaatgtgtgttccttggttacagccagcttcataaatggtttaagtgccttgatgttgctttctgggagagtttatgtttcgcaggacgtgatctttgttgaaatggtcttcccattttctcaattaaaatcaaatgcaggcgcccgcctaagagcagaaatagctttgcttccatctgaccttgtagcgcatgatcaagggggcgagcaacagagtgatcatgttcttgattttcctaatactgctaatgaattttctggtagcaattcagatgattcgggtacagatgaaggtgtggacctagcatcaccaacaccggcgtttgaagcgcatggcgcaggagaaatcgcttctggatcggagcctaacgcgacacggcagacagcacagacactggcccagcagacgcacggcgcggctgctccactccactcaggcggcgacacgtcgctgtttactttaccaagtccggcgccgcaccagaccacttctgtgccgagccatgatgagaccggtacgagagctgacactaagcatgtgtttggttgggaggatatcccgggatgggatgggatcgtcccatttttaggtctgtttagttgaaggacaaggagggataggatggttccaaaagggaatattccttcaatattcgggacaaccccatctgggataaactggcggacaaaacgatcccaccccatgcccgtgactcgcgactcacgcgcggtaagaccgaaagtttcgcttcacctcttttttccccttcgttcttatctcttcccgttcttatcgcttccttcctagggttagcaacacacgggtggcggcggcgcgagcgtgggctggggccagccggtgcgcatgcaggggcgaggcggcgcggcacgcccggggtctctcgtcagcgcgtaggggcaaggcggcgacggcgcgcgcgggggcgaggcggcagcggcgctagcgggagctcgaggcggtgcgcgagcaaagggtcggcgagcaggggcaaggcggcagcggcacacgcagaggcgaggcggcggcggcgctagcaggagttcgagctggcgacgctcgagccggcgcgcgagcagtggcgcggcggctctcgaggaagggcgacgcggcgcacgagtagggccgttcgtagcctccaactgcacatcggggttcccattcaccacggtaaaaagaccctaaaccttggatgaggatttcgttttcagatatgtgcatatatgtttttgttcaagaatgtgtgaaatcaattgctgctgttcaagatctgtgcatatatcaatcgctgttgtaaatttcttgacagtagatgatggccatgtgtttttttggttgttgtattgtagatggacaagaggaccaaggttttagtttgtattgctgctacaaatttattgttgtcgatgatggccatgattattaggtctagaaaaagaaagagatgttcaaggagataaggtattagatatggcccattggttgaaagggataggaaaagaattgactacctagaaacaaaaatttggtggaacgatacaacttgtatcaacatgtttagacttagaagggcaagtttctttcgtttctgtaagctttttagggatcgtggtttacttgaagatgccatccacatgtgtattgaggaacaagtggctatgtttttgcatacagtgggacataaccttagaaatagattagttcgcactagttttcataggtctggagaaacagttagccgttatttcaacaaagtccttcatgcaatcggtgaggtacgagatgaactaatcaggcccccctcattggacactccaactaaaatagcaggaaaccctagaagagatccttactttaaggtctgagattcatccctatctaaatttatctttatgtgaacattgatatatggtccctaatttttaatgttgttgaacacaaaataggattgtattggagctatttgatggcacacatattagagtctcggttcgtaagaacgtggagtcttcttttcgtggtaggaagtcccatgccactcaaaatgtaatggcagccgtagattttgatcttcggtttacttatgtcttggctggttgggaggggacagcacatcatgctgtagttttaagagatgctttggaacgtgaaaatggcctccgtgtcccacaaggtaatagattactatagtttatcaaattatccatgacaaatgttgatatttaggaatgtgaccaacttgtccatcata

SEQ ID NO: 4363 - DNA, 2302 bp, Oryza sativa
  unsure (1)..(2302): unsure at all n locations
gcagtgcatctcaacacatgtgctagggctatgaatgaaaggttcaacagtactctcacgggtgagcaaattaagaatcatttgaagacatggcaaagaaagtttacaaagataaataggcttaggaaagtgagtgctgctggttgggatgagaaaattttcatcattactcttgatgatgagcactacaatggctatattgaggtaaatgtcttgactcttgacctagtggtttattccattcatatttttattgcaattacttaaacaaaaattttgtttcactgaatgatcacaaggctgatgctgattattttaacaaacctcttgcgtactatggtgagatgcttacaatatttcgtagcaccatggctacaggaaagtatgcaaaagactcaagttcagtcctaggaacagaagatgtccaaactgaaaatgatgaagaggaaaatgatggccctgccactactgatgatcgtgcggaggcatcatctgcaagcaagccaaagaaagctagaacacaagaaattgaagatgatgggctgattggtgcattcaccagtgttggtgacaagttagcttctgctaactaaaggtcgctgagccagacaataaactgccagatggtttatttgaaaccttgaaaagccttcctgggtttgaggagatccatgtatctgtttactatgctcatttggttgccaaccctcacattgctagagcttttgacggacttcctttcgaaaagaagatgcattgggtccacttgttcattaatgagaagtttcctagatcaatgtagagttgttggatgagttgggtagttcttttggtattatgtgttgccggtggggccatggtcatgtatgacttgtactgccaatatgtttaaggcagtgaactctctagtaggtgtaagacttaaatttgctattatgtgtaagaccttaatttgctattatgtgcacgacttggaacttcttattatgtttggcttggactctatgtatgggttgaaatgggatcagatgtgagctaattatgtgtgattgttttttgaggggttgattatggaactactagtattgttcatcatttggtagcttgtccaatatgctgaaatcctaaagcttccactgttcttggctgtagtaatgaagctgctggagcttattttcaattatagtgatatgaaaggtattttatttttgtgatatatagtgtggtcatcatgtagaaatattatttcgtagtttgtagactatgagaggtaacttcaccaactaatgtgtggaggtaattgtatccaagaaaacaaaagataggatcattccaacccatcatatccctcaaaccaaataaaaaacaggatccgttccatcccttcaaccaaacaaaaaaacataaccatcccattccaaaaagggtaaaaaaacagggatggaaccaacccatcctatcccatccccaaaccaaacacagcctaatgatgcagccatgcaggacactgagctgagttccgttgtccaatccagtgctgcaggcctagaacaagattacaaggaggcatcaggaaacccaaggtatatatagatggtactgtgcgatactcctgctttacttctgcaggtgagccgagcaatttggaggaagcactaggaaacaaacagtggaaagatgcaatggatgcagagtactcagcattaatgaagaatagaacctggcaccttgttccttatcaagaaggtaaatatcattgattgtaaatgggtatataaggttaaaagaaaggctgatggaagcctagacaggtataaaactagactagtagcaaaaggttttaaacaacggtatggcatagattatgaagatacttttagtcctgttgttaaagctgctactatcaaaactgtcatgtctatagctgtgtccaggggttggagtctacaacaactggatgttcagaatgccttcttgtatggagtgatagaggaggaggtgtacatgagacaacccccagggtatgaaaattcttctaaaccaaactttatttgcaagttggataaagccttgtatggtttaaaacaagcaccaagggcttggtatgcaaggttaagtggaaaattgcaacagttaggctttaagccatctaaagcagatacatctttattctcttcaacaaaggcagtataaccatgtttatcttgatatatgtggatgatattatagttgctagttctactaaggatgcagtgtcagctcttctttgtgannnnnnnnnnnnnnnnnnnnnnnnnnnnnn

SEQ ID NO: 4364 - DNA, 1768 bp, Oryza sativa
atattatagttgctagttctactaaggatgcagtgtcagctcttctttgtgatctgaatgaagatttcgcgctgaaagatcttggagagcttcattatttccttggcattgaggttaacaaggtaaacaatggtctaatattgtcacagggcaagtatatatctgatttgttgaagagaacaaatatggttgattgcaaaccggtaaatacacctctgtcaactacagaaaaattgtctttgcatgaaggtgatcaattaggacctaatgatgctactcagtatagaagtatagcaggagctttgcagtatttgactttgactagaccagatatatcctttgctgttaataaggtttgtcaatttcttcagacacctaaaattgttcactgggcagcagtcaaaagaattttgagatatttgaaatacacagcaagtctgggtataaattttgatagatcagtatctacacttgttagtgcctttacagatgcaaattgggctaggtgtcttgatgaccggcggtccactggagggtttgctgtttatcttggctccaatcttgtgtcatggagtgcaaggaaacaagctacagtctccaggtccagtacagaagcagaatataaggctttagcaaatgctacaactgaggtaatgtggattcagacattgttggatgaactcgatgtccatgcaccgagatcagcaaagatttggtgtgacaatattaaagccaagcatttgtctgctaatccagtttttcatgctcgcactaagcatattgaagtggactaccactttgtcagagaacgggttctgaacaagtttacttgaggttgaatatatttcttctggagatcaggtagctgatggatttaccaagcctcttggagtgaaacagttagagatgtttagaaacaatctaaacttgagaagttcagattgagggggagtgttagagtatatccctgtgtaatccgtgtgctttggattaggatggccagtagattaagctatagattagctgaggttgttgtgatcacatgtaattaggatccggccgttctatccatagcgcatgcctatatgtatcttctccatcgccgttttgtgcgataggttaacacacatcgtcgacccgagtgcaaagggcgacgttcccatccatcctattttcccacagatttctcttcattttattcttggatccaatttttgttgccataaacttgtttttttgcccaatttatttacaagataggtttagtttgaggaacttttgggttggatctaatgtgttcatgtttccgattcggttggcttctcgagttgaggcggagggcaacgggaaacggaggcttgcaatcgcaatggacaaaagcggattatgacgaacgaaggcataatgtgacgaaaggaaaaatactaatcttttaattaagttaagattaagatatgctaggattctcccctactctcgccccttcttaccgcagagaagccacgtatccgtatcggatacgcgaacggaacgtatcggatatggcccgatacgtatcccgtacgtacctggccgcaatgaagcagagcgtgcaagctacagggtcgtcgctaatgggtgcagcagctagcgctcagcacctccgccgccaggaccagggggtccaggaccaccgccgcccccacatagtgcctccgtctccaggcacaacaattttctttcgttccatgtgtcacatcaagtgctaccatggattttggaactggaa

SEQ ID NO: 4365 - DNA, 3216 bp, Oryza sativa
agagtgcagtaacgacctataaatttggcagtaacggcccatatttttcgcagtaacatgtcgtgttactatatcgtgtaactgcagttctgcgataatgttactaccgaatcatagtaacaatgtatgattttctacagtaacataacgggtttgtgttcacaaaatttgaacagatatataagaaagaaaacaataatctcaaatcacaaagtgtcataacgtgaattggttaggaaaatttgttatgaactatgagatcatgggttctagtcttgaattcaccaatttatttttagtttttctaaaaaaaagaaaagaatagaaggaaaaaataagagaaggagggagaagaaaaaaaagaagggacggagagatcgggagagagttatagtcttgaattcaccaatttatttttagtttttctaaaaaaaagaaaagaatagaaggaaaaaataagaggagggagaagaaaaaaaagaagggacggagagatcgggagagagatcgagaggaaggaggcccgccgggagtgggtggggccatgggggatcatgggttctagtcttgaattcaacaatttttttttattttttctaaaaaaaagaaaagaatatgagaaaaaaaataagaggagggagaagaaaaaaaaaaggaaggagagatcaggagagagatcgagaggaaggaggcctaccgggagtgggtggggccgtggagaataggaggaaaaaataagaggagggagaagaaaaaaaaaggagggagggagagagagagagattgagaggaaggaggcccgccgggcgtgggtggggccgtggggtcgccgggaacgggagggagccgggagggggaacgcgcaccaggaagcgaagggagggggcgcgcgtggggactggggagagggaagggagccgggagggggaggacgcgtgtggaggagggagtgggtgggctgggcaagaccgggagttgagggagagggatcgcttccctctcctcctagcgatcacccgtccctcccccctaatattcctttttcatatctcttttctacttttctattacatcataaattttaaaaaaatagtaaaagaaaattagaaaaaaaaatataatactctcattcatgtacatatactttgtaccatacactttgcacgcataaactttatgtataaaaatattttatatataaaatatttgaatccgaatttgaatttaaatcgggtatataaaattttgacttataaacattcgctctataaattttagatggataaattttagatgtgtaaactttagatgtataaacttactaaaaagatgaaaaagatgaaaagaaaaaaaacgaacgctagcagtcgcccgttagccatctcgccatcgagacctacattgctagctaatctggccccacccgtcatagaatcgtcggtctctgtcccctcctgtcatagactcgtcggtcctcgcttctccttgctcgtcagttgtcttcatcctcctcctgccgcctgaccgcctgtcggctgctcttccttcaccccatccccatggcggcagcggcttcggcttcccaccgcgtgttcgtctacgggacgctgatggtggaggaggtggtgcgcgtactcatcggccgcgcgccatcgtcctcccaagcaatcctccccaaccagttcgtccacgagaagggatcggaagggaagatcacctgcgacgcgcccgcgcgcggcggcggagggaggaggaggactgttgacgaaaaaatcaaacacaccggcctgggagatctgcttaactcctgtgcaggtccaaagattgatgagatgcgggcgtgccaatcagtttgattctgcaagtgacaagatatacaaataatagatcaaacagccgatcagctgacaagccgatggagtagttccagtcgatagccgataatagccgatgccggtaccagccgatagcgatagggtttaagcaatcggctatatgtccaatgtagataatgatataaagacaatcggctgatgataatataatatagcaatataacccagtaaaaaccaatcgattaacaatatgatatagtagaacaaatattgatccgaaggttaaagcatacatcggctggaggtccaatgtcataaaatccataagattagattaaacagtgaaacctttgttgccatcggctaaatccaacttatatgtatatgcaatccttacaagccgatgcaacgtccagataacttatcggctagcatcccgataaaacattagcatgaacctatcggcttaacaagacttatattatcaacaacaatctagtaggtcgaatctaaccgatgcagcccgagattgtatatgataatctaatactcgatgagccgatagatctatctaatgtgatggatataacaaatctatttataacgacattgtgattgtagagatatatcggctaagacaggagatcagacctaaccgagacagtcccaactaaactgatgcgtctctaaacacaatgcaattagaggtagaattgagatatcaagtaggcaaatatatcaaccaaaccagagcgatccaagagatcgaatcgatgcagccttgaacaacaccaacgtagccgacagattcaccagggcccgacagagcgtaggacttacccctttgctggagattgaaagccgatgcagcctacgtcaggtgcccaaattcctctggaagataagtaaaaacgttagggaaaagggtggcgatgcaccgagggtagttttattgatcgatagattgatagattacaatgaccccaggtgtaaatatttatacccatatagagatactagtccttgttggacaagaaagaaactaaaaaggaaaagataaagtccttatcggacactaaacacactttcctaaagataaaaggaaacttacaaactatgcctaattaatagataaactgtcatgtcgcatctttttttgaactcggactcttgtagataagctttgtttgattgatccgactccaccaagaatatgacatcgtggcgacttaactcttatcggctgattctagaactttgaagccaatattaactctaagccgatgataactttgggcttaccaaatttcattgttaacaaggacgcacgggatgggacagaaaggcaacggcgaggacacggggcgcgggggggtggtgg

SEQ ID NO: 4366 - DNA, 809 bp, Oryza sativa
ggtctatagatggcctcgccggcgcgaggtagctgcgcgtccaccatcgctgccgccaccggcgccaggcgcgggcgatctgcggcggctgatccgtcgcccccgccggttggctttctcggcgggaagaagcgcgacatgtcgatgcggcggagcccgaactcctcgctgccccacggtgtgggtttcttcaccagcagatgcagaaaccggcggctcatcctacaactaccgatgaatttctcgacggcggcagcggcagcggcggcggggggcggcggtttcttcctttggccgtaccggttaaacccctagcttttcgcgcgtccgattttgtactgataacctaaaagatatccccttgtttggacaaaggtatcctaacagattggctgtgtttagttcacgctaaaattgaaagtttggttaaaattgaaacgatgtgacggaaaagttggaagtttatgtgaggaagaaagttttgatgtgacgaaaaagtttgaagtttagaaaaaaactttgaaactaaacaaggccgtagttcgagtaaaatttctcaaatttctgtttgaaatctacaggatacaaatatgtgcaatacaacataacacacggaacatatcaagaagatcacagatgcggaacaggcgaagagcattgaggtggtaaatccaaaatgctagataaataattggatgccaacatacaggcttgtgtttttgtacaacaacagtgtacactctctacttaaacactagatatgtgcaagatcaggactattttaggtgtacactgaaacactggatggg

SEQ ID NO: 4367 - DNA, 5720 bp, Oryza sativa
  unsure (1)..(5720): unsure at all n locations
gaatttttccaagattgctaagcccatgacacgactgcttcagaaagatgtgaagtacaagtggtcggaagaatgtgagcagagttttcaagagttgaaaagtcgcttgatatcagctcctattttgattttacctgatccaaagaagggtttccaagtgtattgcgatgcatccaaacttgggttaggttgtcttctaatgcaagatggaaaggtggttgcctatgcatctcgtcagttacgtccgcatgagaagaactaccctactcatgatcttgagttagctgtagtagttcatgcgttgaaaatttggcgtcattatcttttcggtactcgtacagaggtatataccgatcacaagagtttaaagtatatctttactcagccggatctgaacatgagacaacggagatggttggaactaattaaggattatgacataggaattcattatcacccgggaaaggctaatgttgtagcagacgctcttagtagaaaaggctattgcaatgctacggaaggacgacagctgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaaaaatatgagaagaggaaaagctatcggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggtcatgactctatttgggtgatagtcgacagacttaccaaagtagctcatttcattccggtaaagacaacctattccggaagtcgcttagcggaattgtacatggcaaggattgtgtgtttgcatggcgtccctaagaaaatagtgtctgatcgaggcagtcagtttacctcaaatttttggaagaaacttcaggaagagatgggttctaagctgaactttagtactgcttatcatccgcagacagacggacaaaccgaaagggtgaatcagattttagaagacatgttgagagcttgtgctttagatttcgatggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatctaagttttgaaggagattatgtgtatcttcgtgtcacgcctcttagaggagttcatcgtttccacaccaaaggaaaattggcaccgcgttttgtgggaccttataagattgtcagtaaaagaggagaggttgcttatcagttggagttacctcaatctttggcaggagtccataatgtgttccatgtgtcgcaattgaaaaagtgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccggcccagtccgcagccgcccgcgcccgcgcgttcgcccgctgacaggtggggcccgcctgtcaggtcgtcgtcttcctccggccgaaaccctagcaccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccggccgccgtgggccttcgtcgtcgtctcctagcccctttaaaaggttccccggtgtctcctctacccgctgccaccttcgccttcgcctctcgtcgtcggaaacgccctagcgccgtgtgccctagcgccgccgtcgtcgccgtcgctccagccgtgcgccgccgccgttccagacgtcgccgtcgctcgggaagaccgccgtcgtggtcgccaagtcgtcgccgtcctcgtccgccccttcgctgtcgctgtagaccgccggagcaccgtcgccgtcgtcaagccgaagagcgtcgccgcttcttcttcgtcgccgtcgccgtccgttcctcttccgccgtcgctttggtcgccggtgagttcgccgtgccgtccgctacccgttggtgccttccgttcgcgccgccgtgccgtcgttcgccggcgagcatgcaagcccgagccgccgagccgccgccgccggtggtgacgtcatcgctgacgtcatcgtggctgtccgccgtgagccggtcgtggaccgatcgatctcgaccgtccgttttggatcgagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcatagtaaaactattcgaatagccgtgcccgcggttatgggcgggtctaacaatgtctttcgtgattagtttcacacttctcaccatagttaatgatgctataactggtaataatttgattagctcctggtttggaatggtatattcctggtttggagatagaactgtgcagccggggtggttgttcagaatggttgggcctatgcaacagggtatgttgtatagcgttgatttaatattgtttaattattacttaactgttttattaaattctcaaaagtttgttaaatgctgcttttgcaaatgaaaccctactatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatctttctttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagccccttgaccctaggttatgccaaacggttacccatagaagccctctaaaaatattggaaaagtagaactgttctcctccctttctcttttaaaccaaactaatggcacatgcacttcataatctcttttaatggttctcattaaaaatttattccagtgttattagtactgtacatctattactgtactaatggctcatttaccagcaaaagttttacaatattgctttatttaatcttgctgcaataaaataaatttagcatgttgattttataactttctttcatttcttttgaaacctgttattcaaaagtacaaaacttgtgacctcgtttccaactgtttcaacttatcttgcaagcttggtttactttgtttacttacctttttactttgattttctaactttattcaaattaatccaaaaacttttgctattaattggataaatgtcttaactccctcctttcacttgtctttagatgccgcgctacaagcctgagtacttgtttggtgttgagggttttgtccaggagttgcgtacaatgtcctttgtcattggatttgggactgcccctttttatgcccagannnnnnnnnnnnnnnnnnnnnnnnnnnnnnnnnnnnnnnnnnnnnnnnnnnnnnn

SEQ ID NO: 4368 - DNA, 9857 bp, Oryza sativa
ttatctttctttccgctgcttagatctttattgattgagaggaagtatctacctctgtaatgacattttattcgcttattaattagagtaatatttgtactctattatcaatttgttattgtgtgcctcggctgattcctggacgagggttcacacacatgtaagcgtttggaattttggatagaaatttcgggcgtgacacgcggcgcgaggccacctccgccctgccgcgcgagggccccgccgctgccgcccggctggccgccatggcgcgagaccgcctgcgcctctatccggccgccgccgccgcttggccgctgacgaaagagaagagaggggaggaatagaatggggagaggaggaggaggaagaggaagagatgggaggagcaagagataaggttagggaagagataaggaatagaatttattaactcctccatctcgcgcatgcctcgtcctctccgccacgcatgcgcgcatggtgatattttgttccagtttaggctaccaatcgggactacaaatagatccaccaaccgggactaaagataataggtatctctagtctcggttggtattatcaaccgggactaaaaattgatctttagtcccggttgagaacaccaaccggaacaaaagataaaaaagtagctataacccggtttttattgcaaccgggactattgtggtttttggctgaccgaccaaagatggtttcttcaccagtgaatcctaaactccccaactaaattggtggactactagcagcaaatcacccaaagcatctacatcctcacaccaatattaactaaatttccaaaccgaataacaaagccttgtattcggtctaaagtgtaagggtattccaaataaaccgatgtctcataagcaaatactatttggcaaaactaaaacagtaccaacatcttgccgacttgcacaaaatatgaccgaaataaattataaaaaaaataaaaaaatcacagttatttctagctcccaaatatttcggtctctaaaaattgataacaacatctacaattattagtaaatatacaaaactatatggtaacatccctccataatatagactcatatgatatccaagaatcataataagaccatgaaggataaccttacatacctgagaattgattccaagacatatgcatcggttgcataggtgaagaatatatataatatggtggcaaaagaacctgatgatctgatgcaaaccgttgatttggcacacacctcctaactaccttctcattctttgcctccactttaactttaacatctgttttattctgcacctgaacacttcctttaggaagccatgacatacctttctccctcagcttttctacacttagcttgtggagctgcttcttctgccaattcgacaagctgtgtgaatgtctcagttggctgccattgccccccgagctcttcggcggatcctgatttgttactaactctgccgaagatgtctctcacttcatactcacatgatgtacattttctagctgttgtacacgtgcatgccccccaggttcaataaccttttttctaaactaaagccttttgtacactcacacatgcaccagcagctaagctcttttcttgaactctagacttcggcacctagatttgcttccttgttgaactacctcccacctgtaccgaagacttctttctactagaccacctagaccgatttctcttatcaaatcggttatccatggcatgtgacttttctggagttgcaacatgcaatcgaccttcattaatagctgattgtattttctgacgaaaaatattacaatcactagtgcaatgatcaaatgaattatgccacttacaataaatttgttcttctaaatcttgaagcgatggcatgacatgatgatccggcaatttaatataatcattctttagcaaatcatcaaaaatatgatcacacatactccaatcaaaagtatacttcttttcctttaaccgacacttttgtggagacggttttaaagctaagcaaacaaatggttcagatttactatctacccattcggctacattgtcgcttatatttcccttgtccaatgatttagaactatctgctatatcagcaccaattttaattttgtgcttctagctctagattgatcataagcaaaccatgtagacataaactttgtcaatgatgaaatagaaaatttaaacactttattattgccaacaagaatattaatctccccaatcgatctgttagaattattcatggtgacattattaatgtatggattattttcagaagcatgatcaaattgagaaataagcaaattacctgtaaacgttaccttatctaatgtgttggagaagcattctgattttttcacttgaatgatgtctaagttcgttcattgatggctctccaatatttgcgccttgtcgtcgcgatttcgtgatccatcgtctagatgttcatccacttccttggcacgaaattcagctggcaaaacaaaaggtcctatgtttccagataaatcaagcatagctacctccttttcattagccgataattctaaatttatcggcttttgctgtttcgcaataacactattctttgttttctgcaagcgtatgagtttatgttcccttagctctgcaatttctacctcgacttcctgctctaactcacaccgttggccctcagataaatcgtctagtgtgacagtgttattgtcgagatcgaaattgtgctcttgatcaatgttggcaatttttgacataggtatttcagtttgcccccaaccgaatttacacaatttgaactctgcgtgtttgaccatatacatagtactatttgattgacattttgaagatggcaaactatgtgggggtacaaaatcactagtggaactactattaattcggctataatcgctactagcatatgaagccgaattatttccactagatactatataaggtgacccataagactgagatgtgactgaccgatacttggcatgccatgcaatgaattaaaagaatcaactggataattaatattgtcatggccatacatatctttcatcggcaaaatttgttgtgtaacagtaggttgtgaaataatcgccgatgaattaaaaggtgtgtgtatatattgtatattactagcattactgaattttaaagtatgtgaattactttgcataggcagtgacatattattttcgtaattcaaagatctcgaataattatttgaataatcactagcaaatgcaatatgtccattaaaaataggtctagcaatatttgtatgagaatatgtggcacttgtaaaattgtttaaagaaattggtgtagattgtacctcacaattaacatagtaaggttgcggcgtagtagtccagtatgtctccatgaattttgtagcagggcttgttcttttcctggtgcaattcgtgtacctagcaaaaatcagagaaattaatttgcacttacagaccgtgaattggttgatcgctagccaactgatctccttgttgaccagtgtatgtagttcactgttcccaatgcaaaagtttctatacaaaagttgcttaaaaaaatcatattaatcatattgatctatttttgaaaaaaaattaaccaatacttaattagtcgcgcgctaatggactattccgttttccgtgcactaatggctggttgggaacatcccctacgaacacagcctaagtacatgaattattttcatcagcctgatttgaaaaaaaaaaaaactacttagaataccatattaaagactactgatgtgagaatctgcacaaccattgtctaattgaacttctgactgaacttttgttcaattagacaattaggcaaggatcatctgactgaacttgacacagcaagtcggcaggtggaggtatcctgatagataaacagatcacataaacaactcaaacatcgcaaacctgccaatctcataataagagaacattaatttgcagctttacttacttcgatttcattttttctcaggtcaagaacaaaatttacatcaatgcgcggttgcaatctgagtagtgatcttttactccgtacagtgatgacgcaaaacttacaggagatgagctactacaactaattacacttcgcatgtccatggaaataaggtttgcatatactaactctgattctctaaaacaagtctccgtatttcaggctccttgcagcatatggctttactctcagcttgctattcttgcccaactgcttgtggagttgtggggtgaaacaggtatcaccacctgcagaagaagttctagttctgaaagacaacataccttccatgatacattgatgccttgttgcctccagataggctcagaagtctatcatacctgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaccccctgtcaaactctaggtggatcaacagccttgagtttggaaagaagaaaatcatgctggtctcgtgtttgcggtttggtgaagaagtcagcaacttgaagttcagagggcaagtaatgaagacagattgtcctgtgttgataatgaaatcgggtaaaagaagcatcagtccctatgtgtttgctgagttcatgtttgacaggatttgaggctatttggatagcacttgtgttatcacaaaacaatgaagttggttgtgagaggacaacaccaagatctgcaagtagccaacggagccatataacttcagctgttgtagttgcaagagctcgtaattcagcctcagcgcttgaacgagagatagctgtctgtttctttgacttccaagcaagaagagaagatcccaggaagatacaatagccagtaatagagcatcgatcaatagggtcacttgcccaagtggaatctgaataagcttgaagctctaatgagctatcacgggagaaaaatataccacgagatggcgtcccacgtagatagcggagcactcgtaataggtgagcataatggacagatgtaggggcactagtaaattgactcagaacatgaacagcatgtgagatatccggtcgagtaacagcaagatatacaagacttccaacaatatgtcggtatcgagaaggatctgaaagtggattcccatcagtaggacgaatcttgagatgaagctccataggagtggcagcagttttatcatcacttagaccagagcgagatagtaagtcgagagtatatcgatgctgagacaaatgaaaaccattcggtgttgaagcaacctcaatgcccagaaaatactttagtggtccaagatcagtcatcatgaattgctcacttagacgttgcttcacgaaggcaacatgagaagcgtcatcacccgttatgatcatatcatcaacatagagcaagagaatcgtacgacctcgagaagaagtgtggataaatagggcagaatcatgctcactagcaacaaatccagcttttagaacaactgagctaaagcgctcaaaccaagctcgtggagcttgcttaagaccatataaagcacggcgtaggcgcaacacatgaccagatggacatgtcaaacctggtggaggctgcatgtagacttcctcttgcaaatcaccatgaagaaatgcattcttcacatccatctgtgagatctcccattgacgagttgcagctacagctataagggtacggacagtagtcatgtgagcaactggggcaaaagtctcatcataatctcgaccatattcctgctgaaaaccacgagcaaccaagcgggccttataccgttcaatagatccattagagcgagttttcaccttaaacacccacttgcaagtaattggaacagcatgatggggaagaggaacaacatcccatgtacccgtgcgctctaaggcagaaagttcctcattcatagccaatttccattcattaattgtaacagcctcttgatatgtgcgaggctcctgaacaccatcagctattgcacaactgtaacgaggatgtggcataattttactgcgatctcgaagaccatatcgtgctgcaggagatggtgatgatggtataggcatatcatcaacaggtagctcattagaatcatcaagtgggtgagagacaagggaaacctattgcttcctagcagattcggtaggcagcagcaaagaagattgaggacaggggaaacttgccggcggaggagaagagattattagcagcagagcagatcgctgatgcgacgtccaggacgcagctccggcgaatcccaggcaagctctgataccatgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaataccaaagatgctctctaccgaaggattcactaaacaacctttcatattttcatctttatttcctaaacctaaactcaactttttagtaatggacacaatttctcggtccaggaaaacagagaatgcgaccaataagaggatttaagaaaaaaatcaaagggctatacctatactgtactgcactagtcactagatattagtaatggtaagaatagggcctcaaggtagtttgatatacaaatggttgctcctatagacataggaggctatagaagacaaggggtatgaaagcattgtcgagttgggctgtataagcttccaataaaccgctcaacgtcacagctaccaaaagtgatatccaatgctgtgttaatataaaaagagatggtcaggatttatgcttgctttatattgtagaataaaagcttcaaacggttcaatgccaggggggaaagtaaaacctgtgaaagtatgtagccacttgaagctaggagtgacagcaggattgagcaggctgctaatgcagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacatatcattgatgcctaggtaaaacaagagaattcatcatactgaatgcagctaacataagaaaatattaactgatcacacactggacatagaacttaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggtctatccaagcactaaacatgtaaatgagttaaaatctggaaaacaacgaccattaatccagacctacctaacaattagaatctccgaatcgcggtgatcagtgaaggcactcatgaactgatgcacaatatgcccaagagggtatatttcccaaacctgaggtcagggtgaaacatttcgtcggagaaattagcacatgttggcatacaaactgccaaaaaacagagaaaggggagaaagaaacaggacacaaataaagaaaatgcttactcgaaccatctccaatattaagaaaacggcaaatgtgtggcatgatgtgtggcatggcgcatgccctttgaaaatttgcttcccaagaatttttgagatttgcaatcaacaaaacatcttagttgctgaggtctctgcaaatgctaatgctctcactttcagaaggtcttttggggagagagagtctgaggaatggctagctattggggatatcattaactctattgagttgtctgatgacccagatgtgttcctttgggggcttgataagaataaaacttacacctctaaatccatgtatagagcaattctctttaggggagtgactgacactagaatgcagggtgtgtggaattgtccctgtcctgaaaaaattaaacactttctatggcttgctttgaaaaacaggatacaatctgctgaacagctgaagaaaaaaggatggaagggctctgagttttgtgtactttgtgggatgcttgaaaccactgatcacattcttttccagtgtccaatggcctctttagtctggtgcttatgcagagatgcttttggcttggagtattatacctaggtcttttgaggatttcttcctgatcaatggctctttgggtggggctgatctgagagttttcttgaccctacttgctgcagtttgctgggtgttgtggtccactagaaacaacatgatttttagagaaaaattagtctactcacccctatcattaatgttccaaatcaattcatttttgcagctctggagaatccttagcagcaaggacactgagaaaattgacaagattttttttttttttgccgggtcggccgaaggaactggcgaccaaatttcattaagattgggaggaataaaatcaaagtacaagtagttttcgcttgcaacgacaggaggctgtcgaattagactgtggcaggaaccacagcccggcaaactaaaaaactggaacgccaacacaacagaaagaaaactaagaactgcaattctcgaaatagcctgcttctttccacactaagatctcttctttgatagcctctgctaactggttagggcttctcgatctttggtcgaaaattgacaagattactgggaagctcatggatgctacttcaactttgagacaaccaagatctggagttggctgatcgtctgaagtttttagttcttagtcgtttgcttagcttgagagtttgttaagcctgtcttagagttgttttgtttccttttagtgctggtcagcttttatcccccctaatggtgttaattctggacctttcctgtgtgtgatgtaaaatgggtatcccccataacgatgccgtgtttggctttctataaaaagccgggcctaatggcctcagtttcaaaagaaaacggcaaatgctgcaccaaatgctaagcccaagaaatcaggcgcaaagagaaacaatttattgagagtgtgtttcaaacaatctgatggggatcgaataaggaaaacatacaatacctgaaatattattgcaggagagaaaattaggacagcaacgggatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtcaaacaataaaccattaagtgaaccaaaattcaatatgtacaaaaatgcacaaggtttagaagcaacaacagaaagaaatttttcaatatttgactaacagatttcgtgcttttatgcccttccaatgaaatgcaaacttatatgctcaccaaacaaatggatgcacttcaaaatcttgaataagacgcgtccatgatggcactaacaacaatagtgctaccaacaatgaaacataaaatacatcacagtcaattctcttctgtgtgcattcctcaactgtttgtgttctttgcctccccagttttctacagtaagccaaaacttgaacggaacttttgtataacaaggggagaagaaaaggaccaagcaaaaccccctgcagaaaagaaaaaaaagggaagggt

SEQ ID NO: 4369 - DNA, 4405 bp, Oryza sativa
cgttcacgtgaatcggtgaaaatatagttaaaaaccctgtcaaacaataaaccattaagtgaaccaaaattcaatatgtacaaaaatgcacaaggtttagaagcaacaacagaaagaaatttttcaatatttgactaacagatttcgtgcttttatgcccttccaatgaaatgcaaacttatatgctcaccaaacaaatggatgcacttcaaaatcttgaataagacgcgtccatgatggcactaacaacaatagtgctaccaacaatgaaacataaaatacatcacagtcaattctcttctgtgtgcattcctcaactgtttgtgttctttgcctccccagttttctacagtaagccaaaacttgaacggaacttttgtataacaaggggagaagaaaaggaccaagcaaaaccccctgcagaaaagaaaaaaaagggaagggtattatgcactaagaaactgaagccatacaacgcaataacttctacctgaataactgtgcctatctagcttcgagttccaggtgcgcgaataaatgcttctgatgatacggagaacttcatctgccagcagcacggttgcaaacgtgaaggcaacaaaataagtatcagatttgctaccattttgctggtaaaacatatatagttcaaggaataaatcacacctttgaaagagtatgagccagcatatcaccacagtaaagaaaaagaccacttgagaccaaaatggcctcccctaagttcacacaaaatgtaaagataagttaaaaaaaaaaagcaattgcttcaagtcatgatgaaaaggagacatatacattgcatcggccaataggaacctcacaaattagctgaatttaaattttaaaaaatgaacagtgtagatataatgcactatgcctgcatggaaactggtaggataactagaaatcgtatggatagctctaaagtataaacatatgcagtcagatatacacaaaaaaactttatctaattacatcttagacttcaggtacaaaccaaaagatgaacatgaagggaacttctctagaatatgctggattaagatcacagcagccactccacgacagagcaaatacaccaaattactcatcaccagcagatctattaagacaaaacctagattagtttgtaattccttgcttctgatgaacttccaccagattttgaaaagaaagggtgagattatatctttgcatgcagataaaatatgcgtgtacctccatcagtcttcagtaaaaagtggaacaagtatgccaggggatataaaatgatgagcaacgagccgtatttcgaagctatagaatttccattgctgggagactgccgtacatgccaaacaaaaaatgctaacacgctgaggcagctaacagatactgcccagtactgcatttcaaggtatgcatattctgacaatgaacacatatagttagtaaacctgatgtgttaccgaaaatcttagtgtcaaacaagatttgaaatgttgatgaagacttaggaaaatatccatttagtagtggatctgataaatttgataaaatagaaaaaatggataccttctcgtccattaggatctgctagtaagaccctataaagttgaattaaccgtgaaagcatgacactaggcagagtagtggcgccaagaagtatgcctgatgaagcacctggcctggatcaagagcatcaagagcatcaagccaccacaagaaggtgaagttttatgctattcctcacaacacaagacatgacgaatcttacggtaagcaactaggattgcacatcacagaacccatataaatgacagtgggagcaacgtttttgctgaaaatgcaatggaacagtatttgtgaaatgggttaactaagaaatgctgaagcccaattattcaagagtgatatttgtcccttggattcttggaaccaccaaaacctgaccattttgcacactactgaaccaaaagaaaatccactaagcctcaagtaaaaataaaatcgcattcctgctgtatgctgaatccgactgatgttgtttccccaattgcatgatcctcacagggaggcaaccagcattgaagcaacaaatggatcaattcacctggtcctgaaccggcgggcggagcggggatgaggacgtggcgggggagccatccacggcgagctcgacggcgagggcggccgcggcgaggaccgcgggcgacgaagaggaacaacgacgagcctatctggatttttcacattttggtccttttaaaaaatttatttcgcaaatagacctaaaaaaatatcctataaatggtcatttttggatgccagagtggctggggccgtcgtccaacaggacagcgccaacctctctatcgccgtccccccgccgatgtggaatgaactcaaatggacggaatatgtaacttgtagaatttttcctttcttctcctctcttcgaagtgcagaggagagagttgtgtaacttttttattttaattttaattttttgatattttttgcacgcttaggaacacaaaagaaccaaccatataaaaaataaacttaaacggatgaaatatgtgacatatgtgaaattttacaaagctctactaaaaacatgtctcctcgaaaatccagacgagcctctcgcccgagaccaccgccggcgcacgaacgcgactacgctagcctcgggttcggttgggtcggccgccttggtggttctgactgacagctgggtcaaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccaggcatagtaataacattactaatacagactctaataataagacaagttcacaatctcgatagtagctttataacatttttttgctaataatacagttattgggacagcagtaatactatgttgatcattttctcttcagagcggagaggatcatgcaacggcaacaaagtgtgacatgcaggacagatatcatctccttgggatcttttaatctaagggaactcctcagcaaaccgggtcaaaataccctgaacacaaaaccagtaacaaaaacgtcagtgcatcagaacaggtagcaatttatcattacattacacaagtaaacaagggggaaatatatcctaaacattgcacccccttcagaagcaacaagcctgcaaatacagaaaaaagaaatgcaacttcaatgaaaatgcatccatcacaagtaaacaccataaattgaatatctgctaactcaaatatcactgagttcaagcttcacacgcatatattgggtgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatggttcatatgataacaataaccaaagcgttggcaccactgaaaaggagcaaacagaacaaaacagctgttggtgcaacctagtccattcaatataggcagctcgtgatagatgttcactgaaatcaagtaaccaagaagaccatacaattctagcatatcaatgtaaagtgaattataaaaagctgagctctatttccaacaggtcaaactgcctaaggcctaataacatacagcagcccaggctaaggatgcccatttgttgaggaacagtacaaactgataaaacacttgcaaggacagcagtaaacgaaaaggaatcatacatgcgagtaatgcaatggttgctctttagaaaaagagagcacctgaatgaacaaatgtgaacc

SEQ ID NO: 4370 - DNA, 892 bp, Oryza sativa
gaaagaaacatgaaagaaaaaccgacctagtgcctgcacactatggttcatatgataccaataaccaaagcgttggcaccactgaaaaggagcaaacagaacaaaacagctgttggtgcaacctagtccattcaatataggcagctcgtgatagatgttcactgaaatcaagtaaccaagaagaccatacaattctagcatatcaatgtaaagtgaattataaaaagctgagctctatttccaacaggtcaaactgcctaaggcctaataacatacagcagcccaggctaaggatgcccatttgttgaggaacagtacaaactgataaaacacttgcaaggacagcagtaaacgaaaaggaatcatacatgcgagtaatgcaatggttgctctttagaaaaagagagcacctgaatgaacaaatgtgaacccatgatacaatatcacaacttacttcgtaactaacagcagaagtttcaataatatttgccacaaaatttaagtaaaataataggaaagaaacaacacttacattgaacagacaaacatcgccagctctggacggctgtagatattatccccatcgtcatccagtgcaggataagcagcaacaagcgcatcttgtgcagcaatatatagttgagttgtagattttccaatatacttcacatactttccttgctggatggaaaaggccttgaaggcagtaattcaagatcacagctggaccaagagcaactctcatcccctcaatcgcctccatgacagcattgatgacatggggagatgtctcaaatatgtttggcaccaagagccatgtgcttcacagcagaggcagcagtttgccagtgaacaagatctctgtccattagagcatcgtcaaccaagggag

SEQ ID NO: 4371 - DNA, 767 bp, Oryza sativa
ggcctcacgtagcctgcaataacaaattaatatgtcattataaaaaatattacagtgcaactaacttatagtaaaacactgttcgtacctctcgacaaaggagtggtgaaccgtgagtagctcactgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataatataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgctgcacttggt

SEQ ID NO: 4372 - DNA, 5002 bp, Oryza sativa
tgagggtaaaactgcaaaccctaaaaaaatagggtgaaggaattctccctcttaaagctaagaagacaaagtgtttaatcttaagaggcactttactttgccacacatcctgcatttctgcatcaataacccctccaaaacttaacaatctactagtagtagcatgcctgtgacatttacatagaagcatacatgacagatgaatgatatcaagaaacatatatatgacttaccattgcctctaaattataaattatatattcaagaaaataaatgtaggcaaaatatataaatagtagatttattatttgattaataaaaaacatccttaaaatgtcttatcatttccgtggtacgaacacatctctatatgctacaacacgccacacactgagcctagcattgcttcggttctccttaaaggcactaagcaaacataatattagggcatccaagaagtgctcgcaaaaagtaggtcacaagatcgttaactcttatctcgcatggaggcttagaatatagagaaaatcccttgtatacccctggaaattaagctaatcccttctatacccctgaatttcacttacttccttgtatacacctaaaatttgattttgatcccttctatacccctcccgtcagttgaccgttagttgaccgtctaatttctataaaaatgaccattttacccttcggatgaatatataaatttatgaattacattattaaaaatataaaagtttcccgcatgagactattaatagttatgagtttgttgtgcgatgtattatttatccccaaaattatttttatataatgaaataaaaaatatgtatttatttttaaaaaaaatcataaaaaatgaggagcattcatacaaatataggaccaatgttcacaataatggttttatgaatgctcccgataaaaaaaatccattgtcctattaaaatttcaaataaaaacttcaatttattacttttgttttattttcaaaatttatgtcaaaattttctgcactaattatttagtctcattagtttcataaaatgcacatactgcgcactcaaacaaaatttttaattgtttttgaaggttatattcaaacctaaagcatcaagggaaaaaaggtcatttgtaactaaacgtaatagtgaaatgatggaaaatgtaacggtaggggcatggaagggatcaagttgaaatttcaagggtatagaagggattagctaaagaaagtattgagtgagttttcacacagggaatttactctagaatatacaattcgtttgaaatattcagtgaaaccttagatatttttttctcttcaataacaatttgtttggtcagtgtacctctacgactgcaagttcatatatagattatctctaattcctgcacacggccagaattgaatttctgaaccaatgcatcaccctcaacaaaattgtatcaaagtatttcggtgtattgcatgtgcatagatgtaaaaacacaaacaggtatgtgcatgtgctacacagataattgcataaagtgtccaaacttaactttacacttcacaaataattgccttttttttacagcaaataaacataccataatgtctttcacggctaagaactaaagatatcataaataaatccaaattaaaggtcaccatacatgacagctgcacgtaaacatatggtgtagtccaaatatatcttctagattaatctcaatgaagtcctaagcatatatcttctcccactgacaccacaagtggaatccagtagaaagttagtttcatgctgtcaatgtgaaataaaatgaaaatgttacaattccaacacatcatgaacagtggacgaggaaaacaagggcaaagttcatcagttcaattactcacacctttaaacagaagcaaaaccagatgaaggaaagcatagataaaagcaaatcgattagttaagatagtacagtacctaattacctgatcaagagggcaatttgaaagaggattggacaatgagcaagaagaaccatcgctgtagcagagcccctataggtggtacccatcacatctaacagagcttgtcacggtgaagcagaaggcaacacaacagtagagatttagggcccgtttggtttccagggacttattccaaatccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacacccccttaaacctttgagattcatagttcctccgcttcctgatatcacgtgccttcttgtttctatctttcttttgatctttggccaatgatgcgtaccactccctagcacgcttcctttttagttcagccgcacttagttttgtaacatcttcaagagtgcctgcacacaaaaactgtgcttaatacaaaaggcttaaaaagaaacgaaatatataatatggtgctacgcccaacctatagagtccaagttgttgtgttgacaattctcatgatcttttggcatattagttccatttttattaatagcgggatggttgttcgtcaaattagcatcaattacattagttatatcagcaaaaggacctgagagaggagtgattgtaaaattagcaagcaataatatatcaattgaccgatgaatataacattagctggatggatgaaactgtcagaacaaacaatcttaacttggaaattggaagaaaatctgaggattatgcacccagtgtattttggtcagattgtaagtttaacggtagaatgatcgtaagttttgctagagtagcaggctaagttagtgccagatggaatgcaaaaggcaaatttgagatttttttctaccaaaaatgtaaatccgcaacagttaatctacaaattcatgtgacttagactctcagtcttgtagtgtgcccgatttccttagtgatcaaagtaggaaatcgcattctttcatactacaaatatgtacatacaacacctgagcaatccaaattttgaatcctcaaacagaataagatactttaaaactgtccaggaatctttaaattcaacacaaaggtctgatcatccccaatttcgtactatattaaaagggctgtgagcatatgatacttacacgcaaggatcctgtattgcttaattagatcagttgtcaacctgcgtccgcctcaatagttggaatattctgaaatatacaggtattaaataatgtatgcgagcaaatcgaccattataaacaattatcaactgaatgtaataactgcatttgaaataagtagaatatttatcaaagttcattttaagattacttatgcaactgttctttacagtctacgaatagaatatcccacaaatggaacggtttcattaaattaaaattgcaaggaccatcagattcaattggtaaaaatatatagaccgttggatcacaggagaatcatgaatgacagcgaaatccattagatcaatcatgaagcttccagacaaaatgccctttggcagagaactcatatgttcctagacaaaatagcctactcaaataaaatacatattttttcataaacataatactactacacaatatataaatatagatggagagtaccagcagctcgtctcagtgacccgcaacgatagaactccatccctcgtagtgccaattttattactcccttcatctcaaaatataaataactttaatatataaaatttagcgtactttacatattccttcatctcaaccaactacaaccattttctatttaagaactccatccatcgtagtgccaattttattactcccttcatctcaaaatataaatacctttaatatataaaatttagcgtactttacatattccttcatctcaaccaactactaccattttctatttaatttcttcatatgcttctttatctcaatcaatcataaccttaacattttctatcaaaaacaaaaataaaacacaaccctgccatttaactttattgccctctccttaatccctttaaaataacataaaggtagctactctctatctacaaatataagcattgcaaatgtttagaatttattaaaaaaatataaggatttatagaataacttaccttcaatctcacctcccattcaaatttctttttatctgactctaaactattttctcaactcctatcattcctcggtaaagggatacaaagttttatatgatcgaacataatctttgttaaacaatatggaaatcattatatatgagaatagagagaataatctcacaaaaattatcccataattatcaagatcggtctatttgagaacatagaggtaattttgctttggtaaaaatttaatcagtatctacctaaatgaaatgaaaccaaattagcgagagagttttaaaaataaaataccgctggccttctacatgcaataataagggccacagcaaaacaaacttcgttcagtttggatgttttcattagtaaattcacaactcggacactactgcaaacttactatttctttaatttacttagtgaaaaaaagtggaaatggaaaaacataaatgatgcctatatgattttttgttgattctctcggatgaggacatacgttttgatcaatccactcatccagcaacaaaaacacaacaagaagaagaagaagcagggaaagtatagataaaagacctagctaccacaagctaccacataaaacataaaagagatcagagaagaggaaggtgggagcgacataaaagatc

SEQ ID NO: 4373 - DNA, 14513 bp, Oryza sativa
cacaaatgtcttctaaaaactatagatcccattcccccccccccccgtctcagacctgcctaacagtcttcccacactgtaaactgaccccatacaggcctgggtattgcactctaacaggagtttgcccataccacacatcctcccacaacaaagtatgattcgcatcccccacttttttctccataaacagttgcacccattttttacagcatgaacaatatgaaaagagagctatcaaaacaggtgcctcattgtcctagtagaacaggcaccctgcagacaagtgccaggataaaacggtttttacacggcaaagcaacagacgacatattcaccagttaaacacgtttcagcatttctcttcgtacgcataagaactcttcaagcttctgtgcttcatcaggtgtttctttgaccgccataatatttctttcaaactcctcgccctatctctctgcgaatttacaagttgcaggaaaatcaaatttgtttattgtagaatcttctgccatcaccataatatatgcatggatcacctcacaacatcaccaccaattcaccataacacatggaaaagtacaggatcaactttatcatatagagaagtatatgctactgtacacaatgtgcatactacatacactacattcactgctacaatttcttgaaactaaccaagcttaagttgtctgtacatttgagtttattttagaaattcattaccagtccaattcattgtctcttatttgtcccttaagctcatatttattcgttgaatgatcgtaatattttcaggtgcaaatgatttagaaaatgtaataccttgctctttgcagcaactcccagtgcaatggccctgtagtcatgttaaatgcaccggggtagcatatcaaatgatcacctgcaatgaacagaagagcttttgtatatttttacacttccatccattttcacatgaacaacaaacaacagcaagttatttcttttatgcattcacacatgccaatagtaacttggaatcggaaaatgtatgaaagcacaacagaaccaattacattttactagtagttttagaaacctggatatgtatccattgttggaaatttggtcataattcggcatattttaatccaaaataacaagataataaacatgatatttacaatagaatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtctacttcttctcgcgggagatcaaatccattctcattttataagaggaatggaagatgaagagtaagagtcatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttgaaatttatttgatttaattgatttaaatggattaattacccaattaaatctaacatccattacatgtacacgatagttcagtacttgactagttgccatgaatctaatacagtgaaattttatatccgtcagaagcaaaatacagcaccgaggtaaaattttcagaacgtgctacattcactgctacaatttcttgaaactaaccaagtttaaagttattaaacatgtagccaaatagtctctggtcaattatcagctagttcattcaagaactcactgtaaaacttgtcatattatcagcttcagaactagtactataacgtttttgagatttctgaacaaacaacattgcaacttcagattttatatcaaaacaagcaccaataaattttcagattgtcatacctaagatttcaaaaaatcgggattacctaagatttcataccaataaaaaatatcaggattactatacactataattgaaaagttaataaaaatcttaacattgggatcgctatagataataattaaaaaggttaataaaaatattttctgtgttttcggccgaaagccttccttccttttcagccctagactagtccgctattccgtgtccgctaccttcctccattcggtctgcttttctttgacccagccaaacataaaaagggaaaaaaaataccagtgaaaaaaaccaaacggactttttttttactgggagattttttttccttttctacaggagtcggacaattttttcaagcgacgagatgcttttttttttactaacgacggaagttttttttatcgctcgttaagttggactttatttctttctttttttaacataagaccagaatttattgtttttagtagagatatagattaaaaccgaaacataaaattaaagccgattcaaacacggatgacgtactaaaattctggtaaaaacatcttcaatttttataatagtagagatatggtttagttaagatgaaatttactgtagaaattcgcttggataaatatattttttttaagaaaatcatgagctacaattagaagtcttttctgtatttccaaaagcaaacgaacttaaaaaccgacacaaatacggatatgtattttcaaaaacgaacgaaattaaaaatcaactcatacacggatgatgtaccaaagtaccaacaaaaacatctttaatttttataatagtagagattgtagggtgtatagtgtaaattttggaacttcacataaattaaagaaactataagaactaaaaaaaatgttaggggctgaaatataaactcctagagacacttgcaccgtgaagaatccaaattttagacctctagccctatcctatgtgacaccccgaggctcctcaactcaactagtgtgacgtattgttaatgccctaagaccaatccaattggatgatttccattgacgaccccacccgtcttctggaaccatccatccggtgcgaggcaccacccacccacccacgcaaaattaccccacgcggacacgcgaaaccccaccccttccatctgccaagatcccgcgaaacccgccgctccccgcgccgccgcccgccggccggcaatcccaccacagcccagtcccagattcccagcatccccgcgcctcgattcgagctcgggactcgcgaggagcccgcgggattcgagcacgattgatttcccttgggggaagccggatgatggtggggttcatggggaagaggaaggagctggaccaggtggtggacggcctctccgacttctccctctccggccccgccgccaagagccgcagattggtgagctcccgccaccgccatttgctctcctcgtccctacggcttcgtttggtctgtgtagctgagcagccgagctgtcttcccccatgctctagtactgtttcgatacgagtgttagatttcatagctttgtgcttggctctaagtcggatatttctattgtagttcatgcttggagcctggaatcatatttttttttttttacttttatagctatgattaggcgtcccactggttactagtagcagtttgatgcatgttatgagcttgcttggtttaatgttagttggagtactattatgcgatatctaccaggtagtttggtgcatttttaggttgtatttcgggatgcttatggatgccctgattttgcgcgggtgccgtgtttgcaatgagattattaagagaggctgagaaaaaaatggtaaatgcactgagaaagtgtcatcttgggcttaccatgacaactgttcccatccaagaatctaccgtgttattgcagtatgtttgtttaccggatttcattttcttgcttgtcagtaccttggagttgcttggttacatctgtgtgtcgcatgatggagtttagaaaacaacggattcccaacgaaataaaatagctgagtgaaagcatagctaatactactatgtatttgagtaccagctgtttccctaaactatctttcatgtagttgttcaatggattataatttagatactccctccagtcaaaatatttgacgttcggagaactaaacttagttctataattttgattggagggagcattatataggctttatcagcaccataaatcctctccaaatttatcattgtagcattatccaatatgagtttgctcagcagtaacagttatcacagagggttcctaattaataatgaaatgactctatctttctgttcgtcaaaatctgtatggaaccactagcaaacctttcttgtggttcactgtacttcaatggatcatctcttcttttcttttttttttatcatcttgacattgttttctttcattgttaataagatgtccaccattggtgtgggcgtggcatgcatgattttgttatgacatcaccatccccactcagtgttctagtgggagatattctcagtactgagcaatgtattgccatatttcaccttggttctgatacctcattcaatgttaccactaaccagtaggagtgttatgcttgaagaaaactaggtttcatttgtagttggctagttgcttcaggatataaatgcgcattatatcgtttctagcatttgtttggttttcaatattttactttccctgtaagtacatattcaataaatttgctgcaccgtcacattttgctgaataaatgtcgactattgtttgtaggatattgggcttccacctattatggaagaagagacgccaggtccttccatgccatttggacatgagatgctaggagaggaaatccacagtgttgttagcatgcccattatagaagacatgctgggaggtgccatggaatctcatccatcaagtgaggacaaggcacttgttttatacaagtcagtagataacactgcatgcattggtcctgggacctcgaacccttcaatcataatcagtccagacttgatacgtagtctaaagagtaagttacttaacattttgtattattataacttactcttgtattcttctgaatatttgaatgtttgcaatactttattttgtacttttacagtatgtcgagcgtgtgtcaaatgggatagatatataggagaagatgctattgctactttaggtgttaggcgttttagtgttttacatactacatctgtgatgcatccaaggttgatattgaaataagtatacacagaacttatcttgcaaagatctcactgtttagttttgtggcaactggctagtagtagaacaaatattcaaggctatgttgctagcatgcaagtttgttagctgcacgcgttgctcctgattttatatttgcttttgtcttaaaatgcctctgtacttctagcacacttatacttggtgacattctttgtgtgagttctgttttaagtgatgagcattagatgattaactttaaggaagaaagcccgctgaactactttagcatgtttgtatggcgcaccggactttatgtgtatgtattttctagtgttatactcatgtcctgtatgtcaggataggattatcatccataccttgaaattgctcctcaccattttctttctcatctttcagatcaggcttttatgcaaaggaactttcacgggctggaggacaaatctcctgggtgcagcaacttcttggctttagttccttggacaccaccacaaattgccacggtatctaattggtctgcttcagattcagaaaagagagaattcttcgaagtgccaatggagtctgatgagacagaagtcgattctatggacgttgaggaatctccggaagcaaatgtcgcagcaatcgatggcgaaagccttcaccagtggcaacaacactgcatgaccccatcgtcgctaccaaacccttcagcacctgttatgtggtcaaggtgacggtcagatgtcattgttgtgaattgactgctgctgtttacttacaggaaggatgaagaaatcctccagttagttagcatccacgactagtacctcaaatggctgccatgtggtgcatagtgctgatcattagatcaattggtaaaatgattgttatgtgcatagtagctccctctagcatagtgctgatcttgcccattcagtgtttcagtgtacacctagaaatagtcctgatcttgcccattattagtgttttagtagagagtgtacactgttgttgttacaaaaaacacaagcctgtatgttggcatccaattaatttatctagcattttggatttaccacctcaatgctcttcgcctcttccgcatttgtgatcttcttgatatgttccttttcttatgttgtattgcacatatttgtatcctgtagatttcaaacagaaatttgagaaattttactcaaactacggccttgtttagtttcaaagtttttttctaaacttcaaactttttcgtcacatcaaaactttcttactcacataaacttccaacttttccgtcacatcgtttcaattttaaccaaactttcaattttagcgtgaactaaacacagccaatctgttaggatacctttgtccaaacaaggggatatcttttaggttatcagtacaaaatcggacgcgcgaaaagctaggggtttaaccggtacggccaaaggaagaaaccgccgccccccgccgccgctgccgctgccgccgtcgagaaattcatcggtagttgtaggatgagccgccggtttctgcatctgctggtgaagaaacccacaccgtggggcagcgaggagttcgggctccgccgcatcgacatgtcgcgcttcttcccgccgagaaagccaaccggcgggggcgacggatcagccgccgcagatcgcccgcgcctggcgccggtggcggcagcgatggtggacgcgcagctacctcgcgccggcgaggccatctatagaccccagggccacggctggggcaggtgcggtgcgatgatcctaggtggcggcaaggacaaggtggtcggtgtggacggcgagtaccgcagcttcctgctgatcctgttcaagtgcggcgcccacgccgtccgcctcctcccccacatgcgcgcgaccaagcggtgccccatcgccttcaccgtcggcgacggcgtctacgtcatggaggcggcggcgccggagccggcgcggatgcgcggggcggagcactgcttcgaggcgctcgtccacggcctcccgccggcgccgccgcggggtggcgccaccatcatcgaggactggcactggcgctccctcacggcgccgccctacgttctcgaccccgacggcgacgacgggcccgcccgcgtcgccgcccacgcggtggtccgcgactcccaaatctgggtgtccacggagcggcacgggacgttcaccttcgacacggcgagcggcgcgtggtccaaggccggcgactgggcgctcccgttccgcggccgcgccgagcacgtcccggagcacagcctctggttcggcttctcccctcaccacgacggccacctctgcgcctccgacctcaccgccacgcccccgtcgctgcgccacacatggaggtaccgcccgccgcacaaggattggccggccccggtggcgtcctacctcgtccagctcggtggcggcaggctgtgcgtcgccgagctgttcgagacgacgcgcgtcgaggtgggaggacgaccactcgataccaacaagaaggcttcattgaagacgacgacgcggcgctggggattcaatgccgccgccaccgccggcgaggaggaggaggaggagacggaggtgagggagaggttcgcggtggtgaccggagtggaggtggaggcgtcggcgagcggcaaggcgccgctgcgcatggcgaggcgcgccgtgaggcggtacgtgctctccaccgagacggtcgtcacgcgcgaggccagacgacgcagcagctggcggcgcggccggccgaggaaggacgacgacgagacgctgcactgggtgttctgagctgagcgacgttgcagacaggtttgcagcagccgacgttgttgttgttgtgcgtttggacttgctgctggctgcatttgtgatcttgcgattgtgagtttgtgaccaactgaaccattgctgataatatatccatgagtaaatttaaaaaactgtaactttagtgccataactatcagtttgctgcaacatgaacgacatgtttcaatttgctgcaacaataacatggaaaattatcacaaaactgtaacttttatgttatatatgctgttacagtacatataggtaacaactgtagcagcatataacgtaaaaattacagttttgtgataatttctcacgctattgttgtagtaaactaaaacatgtcgctaatgttggttttgtcattaaaattgcagttttctaaaattgcatagttgataacggaattgattattgctcactccagtttaaagtatgacgacagatgctaaaatatgcgtccaaaagttaacgtcgtcgtttattaaaaaattagaggttaatagaattcatagagagaaaaaaaaatcccttgatcgaagtcaaaactcaaaagtgccaaattaagcagagggacaagcggtacacgatgccatgttctggtcatggacgtcaaggtcatggcgtagacgcaaccccttcgatgggttgagttgatgacttggactgatgttatatgttccgtcttggtctcaagatcctttctttttgagttttggtgtcaaattgaaggatgtcataacatgttcatggcttccttgagtttggtttgaaaaatgccaattttgttatagccttatgatcttcagtcatctacatgcatgctcatgccatgctaaatacctctacaacgttaattatccttatccacattttatattatgtttagttattaaccaaatactccctccatcccaaaatttttgacgccgttgacttttttaaacatgtttaaccatttgtcttattcaaaaacttttgtgaaatatgtaaaactatatgtatacataaaagtatatttaacaataaatcaaatgataggaaaaaataataattacttaaattttttgaataagacgaacggtcaaacatatttaaaatagttaacggcgtcaaacatttagtaaaagagggagtaactaagcatgatactttttggcaaaattttacagttcttgagatgtaactaaagatacaaaattattagtgtaaccggaggcatagaaaatgtgttacctccaggaaaccgttaagaagcactataaaattagcatttttttgttataatataatttattatcaaaagaatgttatcaaattaactaaagggttaatttattaacactattaacactttacttaattataaaaaaaccttccctaaatgatagaaagcctacaaaaggtagaaagcataagaatttttccaatcgtagaatttattctagcctctactttaaaatctagtagtattaaccaattaagtaaaaggttatcctatccaattaacctttacaggttaattttgtttgatcaattgcagaggaggttggactagttggacaacgaatcggatataaattcataatccaacaattggataggatatacgcgaatcgtcctggctgctactggaattggataggataaaaacctaactcccccagctactacttgctgttgcttcttccatctgctcttttgttgcgccctgattctgcaggcaccatgcgaatcgcggcaatgacaccaagagatagagagattcgcgggaatggcagccaccaccaccatccaccaccaacaaatcatcgcgccaacaacaaaaaaaacccaaaaaaaaaacaacaaaagaaattcaggcgtggcagttcgttaattcggataacaccaaccaacgagtccacgtcgtctcgtctcccaatcaatcaattgctgatcgtctgacttatataagagggagaggagaggaggagtgtggagtgtggagtctctgataataagtgtcgatttttgttgttccgggagaaattccgggagatttggggcggcggcggcgatgaggattcggggagacggcggaggtgatgaggaggaggcggcgatggcggtggtgtcggcgccgccgcagcatctggtcttcgcgtactacatcaccggccatggcttcggccacgccacccgcgcgctcgaggtctcgtcttctcttttttctcgttttggggaggattgattcgtgtttgtctccgtgcgatgaaattttggtttctgcgcggaattttggtttcgtggctggatggatggattcgctgctgtttgagtttttttttaatttttatttggggtgatggaattttggtttgtggttagtgcaggtggtgaggcacctgatcgcggcggggcacgacgtgcacgtggtcaccggcgcgccggagttcgtcttcaccaccgagatcagctcgcccaacctccacacatccgcaaggtgctcctcgactgcggcgccgtccaggccgacgccctcaccgtcgatcgcctcgcctccctcgagaaggttccagaaacatactccaatatctccactctactacctgctactgctacaacatccaccactcttgctcttgctgtgctgtgctttgcctgtggatttgtggctgattgagtgattgtgtggtgcggaatgcagtatcatcagacggccgtgatgccacgcgaatcgattctgaggactgaggtggaatggctcaacacgatcaaggccgacctagtggtaatgctcctgaggatgctaacaccaactacttgctcgatttttttaatctgtttttatccggggtctccatgaatctttacagcatctgaagcaaatgtggtgttgttggtctttggtcaggtttcagatgtcgtccccgtcgcgtgcagggcggctgcggatgctggcattcgatcggtgtgcgtcaccaatttcaggttagtgtttctgtggttgcttcatgctaggggtcaaaaggagcaatgaggatgtagagtgagctttagaattattagttacagcctttgtgggttcccatattattccaagtttatgttaacattttgcttggggttatatgtttcatcagtgcatagttgctacagttacctgacttttatatgttttgcctgctaacattcatttcctgatgtaatcagtactaacgctgaacacaaaagttatctactaacccacaagaaatctgcagctctgagtgatgctaacaataaattttagttatggctttacccgaaattgactagttgtaaacataattttttctctccatttatttttataattcgggctattgaagaaatttacatggatagttttatttgcagtttttcttgcttcttttttgagtagttatttttgaatcaaagcacggtctttaattttcaccttctatttgcagctgggacttcatttatgcagagtatgtcgtagtagctggacatcatcatcgctcaattgtgtggcaggtgcctgtcatttcatttcccaaaaatggtgcaaaattgtctaattggtttgctaatgctaactactaaattcctaaagccacctagacaccggattcaaatttcttgatttttttttgagaaaactgttctctgtaatatcgttctttagttgcaagttgagactaattcagcccgttcaataaccatgcatttatgttggcatcaactgcagatagcagaagattattcacattgtgaattcttactacgactccctggatactgccctagtacgtctatatgtctgaatgaataatatatccaaagatcctgcatgttggtttgaagtactcgtgattaattctatcttctgcagtgcctgctttccgtgatgtcattgatgttcctcttgtggtgagaagattgcataaatctagatctgaggtgcgtacaactctgctggacaatgtttgctctgaacactcaacccatgttctcagttcttgatgacttaaaaaatctccatatatcaggtgaggaaggaattaggaattaaagatgatgttaaggtggtcattttcaactttggaggacaggtaaaccattaaatagcctgaatgttctttctcgtttatagatgctcgattttgttcaattaatggatgttagttgcatatttctgttaaatcatttttttttgaaagggctatatttatgttaaatcaatatgtccttttagaccagctaaggtttctgtctttctgctgttattggtagtcagtacaatccatagttgaatttgctaccatcttatgcaagtattgctgatgcaatgccattgtgatggtttcctcttcagcctgcaggatggaaactgaagaaagaatggctgcctgatggttggctctgtttggtatattttctttgaaactacgtgttttcttctctcttctttctctctctcttaataatgtctggacaacatttgtgaccaaattctattttcataaaggtatgtggtgcatctgaaactcaagagcttccaccaaatttcattaaacttgcaaaggacgcctatacacctgatttgatggcagcatctgactgcatgcttggtaaatacagtgctatattatctgtgttagggctatttaccgccttatttcttttctagaaatgtaacaattctgttggttgttgcatagggaaaattggatatggcactgtgagtgaggctttggcttacaagctgccatttgtatttgttcgtagagattatttcaatgaagagccgtttttgaggaatatgcttgaggttgaaacatctcgaagtatagtttcattttaagaattcgtacttatagagcatcagtcatgaaccttgatgtcctgttctatatcctcttttcttcctaataaacagcattatcaatgtggcgttgagatggtacggagggatttacttactggacactggaaaccttatctgcaacgtgctatgacacttcatccatgctatgatggtccaataaatggtggtgaggtaatgtccttacagttctcagatatgggtctgtgagggttgtttgggaactcaagctagtaaccatcttgtaaattttattttttttttatgatggctgatttttaaaactgaaataccatactagccataggttgaagttcatcctgaatcaattcttccgtaagtcatgaagagtcaactggatacttgcatcatgttttcctcaaaccagatgtgattcacagactttcttgattgcatttataatacaagataagctaataattattcgttcaggtggctgcacatatcctccaggacactgctgttggcaagaagtatatttctggcaaggtgagttactaacataaattgttgatacattattgttcagttgtaccttgaaactttcagataaaagtgagactttgatatcttcagttatctgtatttggtgtcgtatggaacttttgttgctttcatactacacatataaagtgataagttgaacataagtaaacacttctgccttttcttgtcatgttactcattaaaatcatttcacccctggaggtttttattaattcttttgctcaagaatattttttttatggaactgtccacctagttgctaattcccaattcagaacagaggatttatctactgctctggaacttgaaaacctatgaagttttaaagttacaagagttttttttttcacaacttctggacttagtatttgcactactctacaattacagttgagcggagcaagacgtttgcgtgatgccatagtgctaggatatcaactacaaagggctccagggagagatgtcggaattcctgactggtattctgtgtctgagaaagaaatcggtgttcgtccagcaccaacatatcatgaggttaatggaagtgcagagtcgtaagtttccatatcctttcttttcccctcataataacatgtactttatccaataacacactttatcatatccccgtccattcaaataattttgttttggtgtcagatcttttgaggacttcgagatactccatggggacatacaaggattaactg

SEQ ID NO: 4374 - DNA, 881 bp, Oryza sativa
caatatttaaagattcttcaattctgcatttgactatcattttagtttgtttctgtaactttgcttgcatctcctcttgataccattgaaggtaggggttcctcctgcatgtattgtggaatgatatattgacatatacctggaaaactctgaatacatgcatgttctatagaccttcctacaattatttttagatagatgaataaatattatgtctccttgtaagttactaagttattgattgatttgatatatttaaaacataaagaaagtttcttttggcatatgcgattgacattgagatggtccaaattaccagatgcccattcgagaggcttgtcatgttgctattcagagaagtaatcctatgaagcagaagctatggaagcatacacaagctaggcaactagcaaatggcagagcagtgccgttgttacaaattgtatgttatttatcactaactctctaagcatcttcgcttaccttttcttatccttattatgcgttcttaaaacttaattcatttgacaaccaaagatgtagcatatatttagttggatgcttcacagctcatttggacgactgggatcttcttactaaatatgtctgtacaggtatcatttggttctgaattgagtaatcgtgcaccaacctttgatatggacctgtctgattttatggatggtgacaaaccaatatcctatgataaggccaaagaatatttctctcaggacccatcccaaaagtaagaaagatcgtttgttttactctataaaaatcataacttgtcatgcatattcattcttggttctggttcagatgggctgcatatgttgctggaaccaatccttgtgttgatgaccgagctaggtgtggtcttc

SEQ ID NO: 4375 - DNA, 1949 bp, Oryza sativa
  unsure (1)..(1949): unsure at all n locations
nnnnnnnnnnnnnnnnnnnnnnnnnnnnnnnnnnnnnnnnnnnnnnnnnnnnnncccataaatgagttatagatggctgtaccttcaaatttcttccaatgttttctgaatgttgcactgttttctgctgtaggtttcttgaatgagctccgagatgatgctgggatcggacgtttatggtctcttgtgtcaaggtacttattttttcctaacagttcacctgagaacatttgtatagcatagctccaccagaaactacatagcctaggagcattcaatgcaattttcatacattgtagattctctttacatgttaatttaggaaaaattaattacatgcccctgcagagtttgctaccctaggatttgccctccccatgttgctaacatgtggtctgaggaccacttgtcagtgatacatggagggagaaatcctagagtgctagcctatgcagggggcatataattgattcccagactgttgcaagtctgggctcagcatattttgttgtgtatggaagcccagtattgtctaaaacttgtctagtttttgtacatatgacaatacatgttgcttaccatttatgtaatatactcctccattgttttttttttgcagaacaaaggctgtgggccctgtacaagatatagtaacagctactgtaaatgaaagggaactgctgtttgttctccatctggatggaagtttgcgcatatgggatatttttaatcacactaaacttatcagttacaatgttcgctcgaatgatatcgaaggtaattcgtggtgactttatgcgcttcagaaaaggtcttatactgaatagctattagcttatttatgttaatgttccttgtaataagtgttgcgttgacattgtcagcacatgttatgtcattgtttatcatgttaagcaccaacttacaatcaaacagttactagcacactctgctgaagactcatatgatctgcaagcagcttgcttggtatgttcatagaataggaacaaggaatggatgcatcatgcagttgcactaaattatatcccagattcctaataattggtcgagtgtggtaatcgttggtgatggtagcctggtataaccagctaatcgagtctatttcggtgatttccatgaaatttcttgcagaacaaaataagtatggcaagtgaaaaaaactagaagattccaaaataacagaacaaaatactccctccattccaaaatataaccaacttctagtgttcaaaatttgtcccagaatgtaacaacttctctacctactctcttatctagaccaatcacaatcatatctcatttaatttctcacctacttcttcatctcaagttctcaacagatcacaaccatccctcatttaatttcacctctctccttaatccccatgaagaactccagaagtgcctgtattttggtactgagggaatagctaacatgtggggtctatttgtcagcaatagttccttttaaaggtttgatgaatcattctgaaaattgttagactgtaacagcatttgatgtacgaacactttgttagtgcatcactgaataacaactgcttctgcaactatccctttcttttggctaccctggaataaactggatatgttttacatacttaaaagaaaggatgtatttaagttgttgcttgcactaattgctgtatcttttcttgttcttgaatagtgcattttccattaaagtatttttctatctttaggtcaaccatctaggatatgggttggtgatgctgatgatgatcaagagttgatttttttggctgttctgcgtcaaggcactgtggtatgtcaagaaaaatgtctcaccactaaatttacttggtcatctggaatgcactgatttttcatgctatgccttttcacttgtcagttgactgacttataaaacacgataacagacctataaa

SEQ ID NO: 4376 - DNA, 10319 bp, Oryza sativa
tacatacttaaaagaaaggatgtatttaagttgttgcttgcactaattgctgtatcttttcttgttcttgaatagtgcattttccattaaagtatttttctatctttaggtcaaccatctaggatatgggttggtgatgctgatgatgatcaagagttgatttttttggctgttctgcgtcaaggcactgtggtatgtcaagaaaaatgtctcaccactaaatttacttggtcatctggaatgcactgatttttcatgctatgccttttcacttgtcagttgactgacttataaaacacgataacagaacctataaaattatgtctgttaaaaatggatacatgctttttgtgggataacatgggggtgaaccatttcacttgtcagctgactgacttataaaacacaatgacagagcctataaaactatgtctgttaaaaatggatacatgctttttgtggagtaacatgggggcgaagttggtacatattatatgcctaatatgggtcatctagagtccaaaataaggaaaacattgcttcatgagtgatgtgttacaccttgtgtggcaaaacattggatcttaagagcaaagggaagtttgatttattaatgtcactggtagagcaagtggagttggacaaataggcgatggtgattgtggcctgaattttgcagtttgtcctggctcatgggtgatttttggaacggaaacaagaaaatggggtggatggaatacagagttgtagagttaacgatctgctaacagattattatttgtgaactcagacattgtatcaatgatgaaacatggtttttctgttgataagacagggatttcctggtcactgattatgtcatcacaatatgctaggtgctaataataatttattgttgtctttgcaataaggtttatttcctgtttccttattaaaattttccttttggtaatcccaccaatccatcccaacagtttccatttgtagatagtagatagcccgttcatcttagtcttctgtttctagatgcagcctcatataggaaactggggcattgaccttaggcttaaaccttagatatcagattttttccgatgttcatgctcatgttaaccattgtgttaattctttttacctattgttgattactccctccgtcccaaaatagatgccgctgttggattcaaaatttgtcccaaaaagcttgtcattttggagtaccttttgtcacatcaatcacctccaattcaaaattttctccatcatacccccaactacctaccatacattacttaatagagggcacctatattaatttttcctaaaccataatctttgccaaataacctagaacgacaactatattgggacggaggtagtatttgttacatgacatggtatgattgaagctgttattctttcagcattgtttttctaagtagctgattaatttacctttttacactgtgcagactggagcttgtgattgcgtttctgtatatggttttagttttggtgctggtgaaaggttcttgttttctcctgaaccttcatttttttctatacctttggtggaggtaaacaaagtcattaccgtattgcattatgatcccttatatttatatatatatggcctttttgggtttctgttctcagaagagacaattttgagtgcctgtagcaacttggtccagtgactatgctacccgctcgtagaggagcaaatatattcaacctactgatgtagagtattttgttttttctcagggaaagcttatcgacttgaaaataagcatggacaagctttggatacttaaggaagttggatcaatgctatatgaaatagtgcagtatgattgtgatacgtaagtatgctgcactgcactgttcccttatgaattgtgaaatgccgctgaccaaatagttttctgctctgactttatgactttttcatcagtgaaccagcacacagtttgtaaaactcaagcctgtatttttttttgcacttataaagattcccattaagtcgtagaaactaaaagttaggtttataattctatattgccaaaaccttgatttcttttataggtcaaacctgcttttgtttcttagccaattttaagtgcccacccttctctctctctctctctctctcaatatgtataaatcctaaacccagaagctaaactgtattaggtcactttatgagtgttcaaatatttacctaaatgtaaataactgcagtgagataatgcattcatatgtgctacaagaagtttctgtcagtgaccagttgtttcaaagctctgagaatacattggatgatttggtctggacagctgattcaatattctcatccaagaaggtaactgtaatttccttgaggttccattgttctaaattgacatgtcatgtacaccttgatgttattattcatagttctagaatgatatgtcaaatattgttatgtacagataaggtcacctattgatctatatgacttctggttcaacttgaattataaggttattgcttcacattgctgttaggtttcttgtcctctgaatggattaaactcctgacgtgtgtttgattcttaaaaatgattactatttagactacaatattcgtaaaccctataattgtcattgatacgactttttagagttagtttatcatttttgctcaattgctgcgggatatatcctttagctatatagatctcatataattattttagttctttgttggctgtgtgaagcttctcaatgttcttcagctatgtagacttcttttgtatctgtaggagcagacattcggttttatttcatctatgtttttgcggaggctacttcaaccaggagtgaatcacagttctgctctacgtgaaaccttgttggagcacaagagatttctatccgattcttatttccaatcacttacaactagtggactacggaaagaaatattatccaccatagaacaagaggtggtttcccttttctttttactcatttctttgtttctatcaggcttcatgatttctagttctagcatgtggcttgactgaattttcatatatctcattcttttagggaagttcacagactgcaagttcgactgcttatcattggaaaaagttttctgcacggtatctccacaattggtgctggaacaataggccatatgggttacttcttgatactaacagagaagtttttggtttaataagaaagggttcattttctctcttccgttgtttggagggcatggagcagtttatttatggtttgttacctttttctagtatttaataattatattaaaattattttcaactatcattatgagctattcggtaacgcctatgagcattatacatcaggttcctctgatgacctgcgcaatcttgatatccttggggtgaacccatcggataatatatctcagtctgaaatcctcattgaagttctaaggtgcatggatcatataagccatctgctggggagatctgctgctgcaatatatcatgaatccctcatcagttctgttatatcacctgatgaaattgtttctcagatcttaaagattctgggcactggtttcagtcctcagtctccctcagccctcattacattatttggaacagatgcttatgcagaaagaaggcagaccgctcacaagagtcagaggaagttttctgttgaaatgttactatcttttcgtaaattgcaatcaaagtcgacatcctggtcagcagtatttgatgtgattgagaacttcatgaagtatttgaacacaaacgtgaccatccaagagtatgagctgaagagagtttgcaatgtgaatactgcgttattggttcaagctacttcacaggtagcaagaacaatgttcgagtccacttttgatctatatctgttcctcaattatctggtctccattggtgggcaggtatgccatatttttgtattttgatatttctgtctgatgtgcatgtgtttacttaactcggccactgtgctacctctgatacgtactgctatatagttcaatattatatttcttttagggaagttcacagactgctagttcgactgccatgctattactcaaacttgctccggttggtcagaactggctaggacatctgcaaatactgattaagatgttaaagtgttcttgacttgcatcaattggaagatagtagacatataaccataagatccttgtcagacctttgtgttgtttgtggtgttaaactgtaattcaatgcttcttcatagatacacactattcttgactggtaaacgtctttcttttatctgtttcattaataagaacaatgtccaaatcaggtctccttgtcacaaaatgatattgccagaataaaactgaagttgttcccagtgattcaagatatactgggacagtggattgtcctccactttgtaggaatttcacctactacaccaccaactattgaggatttcagctatcagctttcttctctccagctaggtcagaacttacagtacattttgttgctctcttacttttacttttgttctttgatatgtattctcttgaatggggacccttcctctacagtatgtttcccgctgtattatgacaaggcaacgagtccatacagataaaaactgatatgccaatgttgggaataattaactatttgccactcttacgagtggttctaaaggatttgccactggacccacatgttggtatgctgtattcaataatggcttaaatggaaagtgggtgcacatgatacttgtctcattagagactaaaatcactagatcaattcatcttcaattgcttaattgctaatgtatcatgttacccatttcatgggaatggcttgacttgacccctaagaaacaatctgtatctctaagttagtttgtttctaatatatggaatgtatctacatggaggaactcaactaaacaatgaaactaattattatttttatctcttattgccaagtaatagcatggcaggaggcccatgggaacagtgcactgcggccacagggtactgttcacacgaaaattttctgcacttgccatgggtctgggtgcaccacaaatgattctaaaatctaaatgcaatgcacacctagcctcttatgatatatgggatcttatattcacacttggcttaatatttataatgccactttcttgtgcttttcttgataaagaaagaacacgtcctcattacttcattctcacaggaaaagctgatgacctgtctttgcacagaaagtttggctgctcttattttacattggcttgtttacttgattttccaaaatctgctgacggggatgttctctcaccctggtttcctaatccaactgagttggtcaacttggtaaggaggtttagtggctcaattatgagtgaaaatattgctggaaatgctgactgtttcttgagttccacaattaatctggcagcagttcttgttcgccatggtcaatatgaagctgctcaggtatctttcttgttggtgccccttaaattcattaaacgtttattgtttgatgtggttctaccattctatttacaataaatatgacaaccattatccttatttcttctgaaagagtcttctgggcattctcgacacacacatgaactatgtgaaagcatctcaagctgaccaggatacagatcttgcacgctcatcatgccttcatctcaatggattttgccttctggtgcttgcacgtgatgaagcaaacattgtcctgaaagaatccaaggttcatgaagctatccgatgcttcttcaggtaccaccttccacactatgcggagttgtgcactgtgatttactgcttaccagaggatattgagtctcatgaagtggtcttagtgttatagattatgtaacattgatatgttacagcaatctgaattacttgtgatgtttctagctgtattattgtataatgtgcaattcagcacttagtgagccatttctcagttttctgttaactaattattgaaaatatttgttattcgataatgctcactgccttactggttctcatagaaaagcctaagtgaccaggcattgagctgatctccagtttattttgctgcttgaattcagaaaaaaaaatgtttgatttatcttgcatcaaagtcagaaaatgtatatctgcatccttaatcgcaaattataaaaaatggctgcttcacacttctactttatgtgttatccaaggttgaacagtggacatatgattatttgcagttatggaagtttctgaaaatcctatttccctaattaatattcagtgcgtaaaggaaaggtcagtttcatttggctgcataagttatcagtatacaaatgcaatatgttagtagtaaattcggcatcacagaactagttttaccagtaaatccaatacatggtttgcaacatatgtactgatgtgagaaagaaatgaatgcggaattaggctgcatatctggtcctttagcaaacaatcaactacttgtgctatcagcttatcagcacagcagtatctttccacataaaatttcaatgatttcacctgatatgtgatattggggttcactgttctccaagcatttcaatgggatgagttcacattctctgcattataaattattccgaacttaggcaacagcaaagttttaagcatcacatcaaagcatatccgatggtcaggaactcaggaccaccttagattaataaaaaacataatcttttcttttggttgtgtggggtgtggtgggagtacaaagttcaaatagaaaattatggggaaaaggctaaaagccttgacaatccactaaaacaaaatgcttggatttgtgtacttgcctaaatttattctcttttatcaatctctttttctatattggtgattggctggctcattaatggtgttaatatgctaattactttgtaaaacagagctgcatctgggcaagaagctccaaaggctcttcagaagttctctgtggaaacagggtttcaaatctccggtgacatcattttcctagttctgcttgtattataattcacctctaccatttcctaattcttttttatttttccaggggaatgcagatcttttacagcatggaggcttcgttactatgagtgggcaatgcaaatttttgagcagcactccatgagtgaaggggcatgcgagtttgctcttggtgctcttgaacaaatagatagcatcgtcgatttagataatggaagtgaagctgaggatatccctgaaactacaactatgattaaagggcgactatgggctaatgtattcaagtacaaattggatttgaaaaattttcaagaggcgtattgcgcaataatctcaaatccagataatgatagcaagtatgtctgtttaagacgtttcatcatagttctttgtgagcttggcgagacaaaggtttgctctgtttatttactgtcttcactaaatgcattgaataatttactaatttaccagttgttttaccagatgtccatagacactcttaggctgtgttcttaactcaaagttcccaacctccactccctcgtttcccgcgcacacgcttcccaaactactaatggtgtgttttttgtaaagttttctatatgaaagttgcgtaaaaaatcatagtaatccatttttcaaggttttttttctaactaatacttaattaatcatgtgctaataagcaaccttgttttccatgcacggggggagagattcccaacctctcctcccgaacacagccttagtggtcatgacacctgtttacctaattaatctgtgggtcgttgcttggtaattgtcatgttcaagttcaaccacaattgattccgtttgcctaatgtttttacgctcttcacaaaaatagcatactatgtgtgatgttggtcggcaggctttgcactaatcattgccagttaaaaatcatataagtatgctattttgtgtattttgagttactcagttcacttcttttactgtgtgcgaaccatgttcactggatgattagagtttaaaggaccttgctatctgttgaattaggtaatttgcaatggcgagataccattcactggcttggtggaaaaagtggagcaagagctcttctggaaggttctctctctccccatcttttgaattacaaaaacttttatttgtgcaacctgtaatgcaatatattttatttaacaggctgagcgctcggatcttttgtctagaccaaatctttacaaggtcctttattcatttgaggcttataggaacaattggaggaaggctgctgcacatatgtataggtatttcgttagattgagtagagagggtaatgctggtggaacccggcaactttctcatacattgcaagagaggctgcatgctttgtctgctgctatcaatgcattgcagcttgttgatccctcattcgcttggcttgattctgtttgtgaagcggatgatcaaatctcaccaagtaaaaagccctgtaatcttttgatgaagaactgtatgttctgttactcaagcactgtttagctggacctttgtacatctcatttcgttattgactacttgtttgctgtttacagctgcttttggcacagattcagagctgtctaggttgaagttttgtgttgacattgaaattctcgaaaaggaatatacactaacagaagcactctatatgctcagcactgtaaattctagattcaacttttcaggtatatgtccccaaagtatcgtgcaaataatttaatattacttgagacttgaatatatatccaagctttggcaatcaatatctcgtgggactgcagataaccaatctattgaagcactgacggatattcttataaatgagaatatgtacgacatggtgttcaccattgtgctgaaatttcggaaggagtcaggaatgaaaaggtgaccagtttccctgtattgatagattcttgcttcttcgtgtcggcgcttctttgcattatctaacttttaatgtttcattttctcatggtagggagttggaacgtgtatttgcagcaattgcgcagcaatgctgccctaatagagtgggcaactcagggtgtgttaaactgtgtttttttggtccattctggttctctggaattgattttagtctaattggcatccactattctattgtagcaactattatatattaataataatggtgccctgccaaaaaaaataacaatgttgtattttatgaccttcttacaggaagaatttactgctgccatcttccgatgatgatgcctgtgatggcaatggtaacagtattgccatggctcatcaatcccaggggagttgccattgggagactcttgaaatatatttggtctgtgctctttgctttttcctatatttaatgtttctctgaaatgagcttcttttttacttaactttgttagagaatcttaaagtattgcatgatactccgactgttctgaaggagcttctctgtcaatttcataaactacaatttttaactctgttctgcaggagaaatacaaagatttgcatcctaggttgcctgtcattgttgcggaaacacttctttacacagaccctgagattgagctaccactttggctagtccagatgtttaaggtgatctcctgatgtatatattctaatagttacaccaactattatctgattgaccactgaccttccatttgtacctttagaccaccaaggctggtaacaggatgatttcatggggtatgtctggcacagaggcagaccctgctacattatttagattgtacataaattatggacggcacacagaagcggccaatttgctggtcgagtacttggaatcattcacatcatcggtaatagatcaacaaactcaaatatccaattgcaagatgtttgcaagcacatgttgacagttacacccttcgaaaccatcctgcagagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttagtactacatctaatggcttcccctttcaattctggatttgttttctagatgtctcctgttgaccacaatctgtttgtttatgggcttccaggttgtggttgattcagatgatgtgctttcatcgcttggaggagggaaagg

SEQ ID NO: 4377 - DNA, 907 bp, Oryza sativa
ttgcaagatgtttgcaagcacatgttaaaagttacacctttcgaaaccatcctgcagagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttagtactacatctaatggcttcccctttcaattctggatttgttttctagatgtctcctgttgaccacaatctgtttgtttatgggcttccaggttgtggttgattcagatgatgtgctttcatcgcttggaggagggaaaggaatggggagccaaagcaattgagttttttttttcttttgttccttagtgagcgagcaactgagatcttgtgagccgtggattagtgtcagcttactgttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataaagtttcctcgtgcccttttgggtttgtttgatatcgccgttctcggagctcagcgtctggagttatgagggattattttgtacggtaaattatttgataggatgttttctgaaaatttccgtcacagcgttcttatccctcgtccaatccagacagccaaaggcggtcggagactcggtgtcgtcttctcctatcaccctgggaatgactcaattacactcaaaagaatggtcctttttgcaaatctgatgtatgaaaaaaattgtga

SEQ ID NO: 4378 - DNA, 861 bp, Oryza sativa
  unsure (1)..(861): unsure at all n locations
nnnnnnnnnnnnnnnnnnnnnnnnnnnnnnnnnnnnnnnnnnnnnnnnnnnnnnnntcttaggtatatcttcctctttgattcttaactggtgataccctgatcgaagatctatcttggagaaaacagtagcacctttaagctgatcaaacaaatcatcaattctgggtagtggatacttattcttgatagtcacatcatttagtgcacgatagtccacacacattctctgggtatggtctttcttttccacaaaaataaccggagctccccatggtgatgaactcggtctgatgtatcctttctgaagcaaatcatctacttgcctcttgacttctgccaactcattggctgccattctataaggtctcttatggatcggagttgttccaggtaccaaatctattctgaactctatatcccttttgggcggcataccaggtaaatcatatgggaacacatcgggatactcccggactatagaaatctcttccaaagttatctggttcagtcttgaccttaaagactcagaagacaatgcatgaacagttacaactcgaccatcattgctggtgagagttacttttctgttagcacagtctatcacacctttatgtctggctaaccagtccatccctaggatgacatcaaggtctttggattctaacaagataagattggccaggaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgt

SEQ ID NO: 4379 - DNA, 2160 bp, Oryza sativa
  unsure (1)..(2160): unsure at all n locations
nnnnnnnnnnnnnnnnnnnnnnnnnnnnnnnnnnnnnnnnnnnnnnnaatcatatgggaacacatcgggatactcccggactatagaaatctcttccaaagttatctggttcagtcttgaccttaaagactcagaagacaatgcatgaacagttacaactcgaccatcattgctggtgagagttacttttctgttagcacagtctatcacacctttatgtctggctaaccagtccatccctaggatgacatcaaggtctttggattctaacaagataagattggccaggaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaaggaacgtacccaaaatcacatctggagcatcttgagcttctgcagcagcaacatgattaacacgggcctttgatgctggtacagtagagttgctctggacagggacaactttcacgcgtcggggcttcggacacttgttagcataatgtcctgggtctccacagttgaaacacaccacgggcttgctgccttgctccctcttggcaggttgttgctgtgctggagctgcaacaggatgtggagcttgattacggatgttgttgccagcattgttgttgaagaactgacgctgcggacgaacaacagacgaagaacctccctgtggcatagactggggtcctaaagtaagacgcggcttctgattattcccctgttgtgtcttgaattgagcaatccggcgtttcttttgctccatacgattgtacttttcctcctggcgaatagctttatccactaacttctggaaatcatgataatccccagtcatgagtgggtaagaaagctcatcattaagtccttccaagaacttctcctggcgctcttcatcattgcgcacatcttccggagcataacgagcaagacgattgaactcgtgcaaatactccgtaacagagcgagatccctgagtgagcgacctgaattccttcttcttgagagacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtgctagagaaaacaggcggcctcacacgaagaaattctgctaacttgttctggggaggtgcatggttatttccttggttttgctggttctggagttgctgcatcatcatgttcattagctgtgtctgttgagcaagaacttgagcaagagtgggattctctccgttgttattgttactggggccattcccgttgctgcgagtgttcaccatctggcatggacagggcacaagaagagaaaccgggggaaactacttaggacagagaattactttaacttttattgatcttaactgagtttcattattacaaactgaagactctcacaccactaaactcaccaacttcctaacactcaaaagcaaacaaacgcatgcacttacatcccactactgatgtaaatcacatgcgagacacacaagcaaacttaaaacaagcaagctaacacaacgatctaagacaacggcttaacaagtcactctagttcttccgagcatcggaggtcgattaaaggctcgttcggctcgtcttcatcatcttgagttgctacccactcaatcttggaatggttgcgcttggattcttcttcttcatcatcacttatgatgatgaccggaggatctgatagggttggggcaacttctttctccaccacacgaacctttggcgccaattgatagcgagggacaaatagagctctctttcttgccgtgagacgaatcctggccttctgcggtggggccttctccttcaatacagctagttccctctccaaacgatccactttgtct

SEQ ID NO: 4380 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnntgacggccgcctcggagtcgtcctcggaggcggggatggaggtgtcgtagccggcgaagcggttggggtcggagccgccgccgccgtagagatcggtgtcgaaggtgacggaggagacggccatgggcgcgccggcggccagggcctcctccatcttcttgcgctcctcctgcgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatag

SEQ ID NO: 4381 - DNA, 758 bp, Oryza sativa
ccagatgaaaaaagtacggccgcaagctctttatgggcggccaaaatggcaattagcccgcaattttggccgacggcggcagacggcgcggtcgacccaccgtctgccacgtcagcttgccgcccatcattagggcggcagaggctatttctgcaatttttttggtcgatagattatttctgtaaatattaaaaaaaaatctaaaaacgaaaaaaattcgtaagaaagaaaaagagaaaaaccatagatccgttccttctccaccacaggtcgacgacggcgagacatccccttgcgcttctcttccaaatcccctgcgccgccgccacacccgctagctcatctttctcctccagatccatccacaacatgtatcgcctaggtgccagtagctgccgtcgcgccgccgcgctcgccgaccgcatctactcaaccccaacctcctcgttagcaaatgttaaccccattagcagattggggacaaatcccaataatcgctccggcatcttggaagagaagaaagtgaagaagacgaaaaaccggcgattcctctacatggttgatttccgggctgtagactcttccttccagaggctacgccgaatcgacccatcaagtctcttctatgcagaccgggcggcggcggcggcgtcgccggcggccgtggaggacgtgcgcctgcctccaaccgacatcaacttctttccccccggcagcagcaattcggggacggacaacatcacgtggatggagattat

SEQ ID NO: 4382 - DNA, 317 bp, Oryza sativa
gggtcttgggcgtgtttgtagttgcggtgtgtatttggacgatttggctcactaggcgtgtatttggacgatttggcttactaggaatgactgggtttttgaaaacattttggtcaaatctcctttgcaggtggtgtacaaggttgttgctatgatgcaaagatggaaagagttgctaaaggagggcgatcgagggcaagtcgataagtggaaggaagtgatcctggagaatttggcgcgacttaggcagctgtgtgatcctcctgaagacatctgatttcggttttttttttttttttttgggggggggggggggg

SEQ ID NO: 4383 - DNA, 2961 bp, Oryza sativa
tggcaccaagagccatgtgcttcacagcagaggcagcagtttgccagtgaacaagatctctgtccattagagcatcgtcaaccaagggagtaacagcatatatgtaatccttgcccatctcaccaatatactcaaagaggaaagagagagacttcaggacaccattctgaacattgagttctgggactcggtactcattcatcagggcaggcagaactgtaaaaggtgagcaggtttcagcaacaatggcaatcgcgacagtcgtgcagacacggttttgccgttcctgcaccttcaagtaattcaacagagtagccaacacatcctgcagcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttttcatgcctgttcttcaaaataggagtcagtcgaggaagaagattcttgatcagcggtgtcatcttagtcatgccaatgacattcacaatagctttcagtgctccaagaattgaacccaacacctcagggtactcctctcccaaatactcatacagcacaacacccaagtgacccataagctgctcctcctggcaatgtttcattacaatggctatccttgagatcagatcagcagcttgctgcctaacttttgcactcttgttgttcaaccgccacttaatggtaccacaaatctgaggaaggtaaggcttgaccccctgtcccagtgcattgacaacagccccaaaaccattaagcatgacatttgcatcgtcacttgcctgctcttggaaagcatacaagatgccatcaataagcagctcctccaaacgagcatcaatatctgaagcacccaaattagccactaccttctcaactgtttccattaccattctcctgtaaggttcgctttcatctttcagatcctcaacaatcctcccaacaatatcagcaactccaaccttatttgccatctctaccgttgtttccacaagctgcttatagttcctgcggtccagagccattctcctaacccagaagtgatggaaaaattcaggaaggatgtcattccagatataatcagcctctacaccctctgtactgacacactgtttaacaaccttcaggacaatctttttcatctcttcatctggtgactggaactccctaatcaggatttgcatgacctcctttgtgtagtaactggcatacagcgcatccataagagggatgataaaaccaattgctttcaagaaggcagcaagaacctttccacggttagatctgatacccttccacagaggcttcaaaacagtatcaaaactttctataccatatggtgcagcagcctcagcaagtgcagcaagagaaagggcagtgattgtcctcactttctggttctcgtcactaagaccatgctcaatgatctcgactacggactcgagatgtggcagaacagcgcagcccataagaatagcaatctgctgaacaatcttgataccagtgtgccgagcttgccaagacttcttactctgacagacagcctttaagaatggcaggagagcagggatacccaaagcagaagccaccacactaaatgctctagcagtggtatttctcacatactcatcaatgttatcaatatctggtctcatggcggcaatcatagtagcaagaccagcagctttgctaagatttgagatgatctcccggccctcaacacgagcgtagtagtcctcatcaatcagaagtggttcgatgaccacaagaatcttgtgcacaaatggacggactagctcatccagcttatacagtaccctgtcaatgaccttcactagaagatgacgctcctggtcctcaagtgttggctgcatgagcaagggtagaatcttgttgaacaatgggccagcaccaaattcccttgctttgtctgtcagctgtcgaagtgctgtcttccgctgtgggggtgtgccattcttcaccttgagcaggagcttcatgatcttcctctccttctgctcttctggagatagctgctccccctcctcctcattcagcaatgttccaaagtactggtaatcctctggcttcatgaagggcaacccaccaggcaactcctagggcacatcaaactgctgcccacgattctcctcaggaatagcatacaatggtgtgcccaatggtgtcggtgtaacgagcagctttcttgctggtgtgcgtatgggctggtatgaagcaggaggttcaagaatcttgtacccttcctgagggaacatagtatcaagctcctcatccgtaagaggcctgttccgctcctcaatgtcccgctcccaccgcaagagctggtactgctctggagtcattggaccacgagaagcaatctggccggggtgttggcgtcgcaaggttgtcaccaccaaatggcgtcggaccaggagtgtaacctgcaggcgtcgcagcaccagtgcctccaggtgtagcactacccatactagcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaccgattccttctcaccgacggcgtcgcatccccgacacgaccaggggtggcatcccagcgcccaatcccaggagttgcatcaggagcatcccaatcggaggaggtcttcgccttcttggatccagaagcagcagaagcatcaccatcttgcgactgatcccatctattgctgcgccgactg

SEQ ID NO: 4384 - DNA, 9448 bp, Oryza sativa
cgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcaacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaacgcaccaccggcgcggtcggcctcgccgatagaaaggccgcgcgcggaaggccaaatgtggaagaagatcgcggccggcgcggcggagggggagacatggaaggcgctcgcgaccggcgcggcgaaggggtggcacggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgcagtcccctccggagccccgcgacaggttaactcttcagaacttatataaatgatgcttcctctagcgatattttctctcatgtcctttttaatttgtactctccaaattgccccacatggttcatggcccatgtccaaatctgtggtgcaaagtcagacgggatagactaggcacccattatatgatctgatccgcaagcttccctccattgatgccctcccggagctgaacgaaggaggaaggaggaaggacgatgccgttggtgttggtgttcagagtatctctgactaaatcgcttatctctgaacaagggaaggaggaaggacgagtattgtggatttcctttgggttgggaatgggttgaatccatttttctgcacttggtttgggtttgctctgtgagtggattggattggtttggtttctgcaagctatgaattggattggaatggtttagaagtgtactgtagagacaagtggtctggggcggttctggtctggatctcagtccattagcaggcttattatcatgggtattcagttgaatgcaattatttttctgcttgatgaatcagtggtggacgcaggaaacaactgttgagtcaacagcccaggattttgttcaacattaaattccaatagagacagctagtgttaaaagagttttttctccaatatgtcctaacttaattattggtttgcagctgcagagacgacagatcattggacatatggtatactgctaaagaatttgtcaagaagtatccagttgtactctttgctcagcctacagatacacactctcagttccacagatgggtataccaggagtggttcaaacccacggtaagaagcttgcttaagtgtgtcagtgatcaccatgcttccaatttggagtttcaggagattactacggagaatgtcaagatattttgcaatgctgatgctcctcaatttattccccgaatcaaaatctactgtgagaccagaaaagcgacttatgaagggagaaagcagaattttgtgcagacaggggaactgataacagagttgataaaatcttctgtggacaatccaactgaggttttggacctgctctctgaggacataaaagataagctcagtatgttgaaaaatcctgacctgtctcatgatgctgatccacggcagtgtggagtttatatccttgtgaatcatccgtccatgctacgaagggagatgcaatctccgttttaccttgcctgttatgatttgctaatgagtgtggataaaagaattgcaaacagggcattcaggaaactgccttataagaactggcagtcaagagccctgcaacaccccctgctcaaagatcatctcatcaatagacggtctagctatggcagagacaagtatcaccaagcaagatatcatcggaatgtggcaagtcacaaaacatcatggaaatccaagtacaaagctgaagaggtcgacgagattatccaccaccactttccgatgattttaacacgtctgatgaaggtcctgtcaaagatgaagttgctgatacgccttaccctccacaacttctttggataaagaatgctgtagtgaatctactgcagtagcaaagctcaacttcttcatgtaggaaaggccatagtgatgcaactttttaacaaagctgaatctgcagataccccatgacttcttcggctaaggaaggccactgtcaagctattgctgtaacaaatctgaatctcttataccagaactggtgttgtctgccgcaccctcacaacttcttggagtggggccgaaacaaatgcaaaagcacttcatgcttattacgagtaggttttgtctcattaactttttgttctttaggccccagttatatccaattgtctgaatccctatgcaggttaatttcctgggttcatgtaacaatgcaaacccatgattttgcttcatatcaacatagctaaacatgatatttttctgtcgacatttcttctgatatgccagaaatatatatttttcttttgacttgatacaattaattttccctaggcatgtttgcaaagccttcctgtccgtgtccaagaaagactcgcattttatctaaccactgtacttacacaacggaggtctgcacctgaggtgcattaatcgctagaattactgaatgaactacggtatacagcataagacctttgttacattgtaagatctgatagcgtgacaaatgtttgtgtaaccttataatacagctaaatctttcatttaggctgatgactatgtggaacgcgtcgaatcttcaggtaccaaacttgactgcgcctggagatgagccctcaaaaacaattggtaggtacccagtagctgcgagaatggattctaatccctcgggtttaagttaatctggaaaacacaacatgatagtatctgtgttagagtgacatgccatgaacgtacaaacattacaaggaatcgcaactaacctggcaaaccgaatcacaactaacccggcaaatcattgcaagaagtttgttagcttctccacaagcaggtgtcatttggcccattacccagcaaggtgctccaacaatgcgattctcaacctgcatagttgtcaccaatggatgactcactttaatagtagaagattaagttatggacataagacataacacagtatgaagctacatccattcatttgttaatagtttacctattgacagagtaagggggtcacagagtatagcaatatatcttggagcagtatttaaaactacaggcaagaaaagaacatgaattgatgtcaactagcatgcccagttaagttaaatatgtaacagcgaggtagctgctgcagaacttgaaatctattatattattaaaggaatagaaaaaggagcctccacgttcgctctcaaggcctataaattctcacattaatcggagaaaaagaaaaaacagtgtccatatagaaatacaatttagaaatagctgaaattcagaattaaaaaataaggaatattagaaaaggagactagagtccatatagaaatacaatttagaaatagttgaaattcggaattaaaaaataaggaatattagaagaggagactagagtccatatagaaatacaattaggaaagaactaaaattcggaattaaaaataaggaatattagaagtagagcatagagtccatatagaaatacaattagaaaataatagaaattcagaattaaaaataagaaatattagaagtagagtatagagtcatatagaaatataattaagaaaaaaaatagaaattcagaattaaaaaataaggaatattagaagaggtgactagagtccatatagaaatacaattaggaaataactgaaatttggaattaaaaattaaaaataaggaatattagaagtagagtatagagttcgtataggaatttaaaactaactaaaattcggaataaaaaggagcctccacgttcgctctcatgacctaaaagttctcccattaatcggagaaaaagaaaaaatagagtccatatagaaatacaatttagaaatagctaaaattcggaattaaaaaataaggaatattagaagaggagactagagtccatatagaaatacaatttagaaatagttgaaaatcggaattaaaaaataaggaatattagaagaggagactagagtacatatagaaatacaattaggaaagaactgaaaatcggaattaaaaataaggaatattagaagtagagtatagagttcatatagaaatacaataatagaaattcggaattaaaaataaggaatattaaaagtatagtatatagtccacatagaaatacaattaataaaaaaaaagaaatttggaattaaaaaatattataagtagagtataaagtgcatataggaatttaaaactaactaaaatccgaaataaacataataaaatcaaaagtagagtttagagtccgtataaaaatacaatttacaaacaactaaaattcgaaattaagaaaaacatgggaagaagagtttaaagtcaatataggaattcaatttagaagtaactaaaatttgaaattaaaaattaaagaatattgaaagatgagtttagaatccacatagaaatacaattagaaataataaacattcagaattaaaaaaagaaatattaaaagacgagtctagagtccatataggaatatatataatttacaaataactaaattttgatattaaaaataattaataactaacacgtatataaaatacaatatgaatattacacattagtagtttcgtaaagttattgcaaaatttaaaattatgttatcattgtaatatattttaataatataatgagaaaacatatatgctattatatgagagaaaatataatgatgctagccgcgcaatttgcgcaggccaccatactagtttacctaaaagaaacaaaattagtgatataacatagatttttaagtcaatcattcgcagcagcaatagcagatacactggcaacctccactgatgcagtgccgaagaggctgatcaattaacacgtggaaggaaattgtgtgaaagactttgttcttgtttgtgattatcaaacaatcaattgcccaaatgtttgtgattaacatggtggcatgtctggctacaaagaaatgccaagattttcagacatcaacaaccgaacacacatcgagcagcccaacagattaatgaagacattcaagaatatgaattcgtgttccagcctccctgatgtagtctgcttttctgcttttttctctttctccacttctgtctaccatctatctccctcccccattttcgctttcttctcgcttgctgaaggcggctcttttacgtctgtactaatacgctgctaatcgatttgtagaccctttctccctctctaatatattgggcaatactcttgccgctttcaccttaaaaaaaagcccaaatgagccgtgaagcatccaactaaatataggttatattttttgttatcaatgagctatgaaagagtgataaatacagaagccgtaagaaatcataacattgcaataaaaggaaaatgaggtttggtcataaacaacatacagttttgtaactacgacgctgctccaacttcaacatatgctaattgcctcgcctatatatgctactccctccgtttcacaatataagtcgttctagcatcaatatgaatgtgggaaaacatcaatatgaatatggaaaatgctagaatgacttacattgtaaaacggaggaagtaccatagcttctgcttgatattaagagctaaattgcatatgccaaaataaactattactttatttcccgagaacgccgtcgccggggatggccagccgcttccatttgctcttaagatccaatgttttgacgcgccggtgcctgttaagggaggcattatagacattatatttttcttggtggctgactgggctgaaaatgagaggctatctttaatgggccgggtccacttcgttcacaaaggcgctgggcctaaaacgcgtgcagcccaagaaaacggcccactaccctcaccatctccccccaaccctcgaccgatgtggtgaagtcccaaatttctccgaacattccccacctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggtacgccggtgtcgcctccccctcactgactcgagctccgttggcgttgggttttctcaggaattaatgctgtgttagagctagtggtagggctgagatagctggagtactatggagttttgtgcagtggagttgattttggtcttattcatctggtactttgtgggaatacactgcacactctgtattgcggtggttaactggttgctgtgatgctccgaggaacactaagtctgtgatagcttcagctaagcagtcagttagttgatttgtgcaaattcaatcctgtattatcctgcattgtaccgtcgcactgtagttgagggtaagctctagtgcatttcatcgaaaatatacatgacaccacagggcagtgagccagtgacatactggcatggtgacaaattataactggtacaaccatgatattcaggaatgttatcatctgacagaaacttatgtgctgttatcatctgacagaaagttatgtgctaatagttcagtagagttccttaacgattcaatttttagggacattttgacaaaagaaagtcctatactgtcatggttgatgagacctagacactaaatttctagggacatctgttaaactccttgcaagtacatgagttcatacatttcctacactgttgtctccaccgatgaaaaatgttgaacaaaataccttgtcagatgaccttctat

SEQ ID NO: 4385 - DNA, 774 bp, Oryza sativa
gcggcgggagtgacggtcttgcctttcagatgccccttgaggcgtgccccacgaatcgcagtcagcacttgtgcgcaccacagctgataattttgcttgctcaacttctcagaaacattgaagcagaacaaggaatttgtggaggtggaagaggaggagctagccatggtagatgggatctaacttcagcgctctgataccatgtgggaaaacaggatggatgggaacgtcgtcctttgcactcgggtcgacgatgcgtgttaacctatcgcacaaaacggcgatggagaagatacaaataggcatgcgctatggatagaacggccggatccttattacatgtgatcacaacaacctaagctaatctatagcttaatccaccggccatcctaatccaaagcacacggattacacagagatatactttaacaaaatcgagttgaagaaaagacagaaaatcaaatataaactcacagaatcgaagacaaatagtatctgatccagccaaggtggaaaatcgctctgcttctttcaagtgaggttgatgctggccgggagcggctgcgttgatccgcgtcacctgcgcccaatccatgccgggatggaggaagagagagctcagcgaggagaggaggacagggacctaccagtgagctagcccagcccatgcaagctcgatctgcgcggacacggacctgggccgtccacgctggcgcgaattcgcaccatggatctaccggcggcaagctctttgacttcaggcttcagggtcca

SEQ ID NO: 4386 - DNA, 4595 bp, Oryza sativa
  unsure (1)..(4595): unsure at all n locations
nnnnnnnnnnnnnnnnnnnnnnnnnnnnnnnnnnnnnnnnnnnnnnnnnnnnnnnnnatccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgccttggtgattttgctcttttctgcttagattccgtcgtttccggagagtccgtttttgccggagaagagtttgaagagttccaaggccagcaaggcaagtcacacagatcccaaacaaccctttgagcatgttgatcatgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagtcgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaaatacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtaaatctcaattttagaagaatttagagacttgaaccaactaaatcggagctaagatgaattagttatgaatttttaaagattaaatcggattaaaacacttatatcggttaaaattgaattatgacgcaataatgaattatttttgaaaaggaaaagagaattattgcgtcagcgggctagggtttggtggaccgggcgcacgggcgacggttcacgcgaacggacggccgagatcgatccatccaaaacggacggccgagatcgatcgggtccacggcggctcacggcggacgaccccgatgacgtcagcggtgacgtcaccgacagcggcggcggctcggcggagcggacggctcgggcggcgcacactcaccggcaaacggcggcgctaggacgcaaacggagggcaccaagatgtagaggacaacacggcgaactcaccggtgacctaaacggcggcggaagaccaacagacggcgacggcgacgaggaggaagcggcgggaaccttcgggtcgacgacggcgaagctgctccggtgatctccggcgacggcgaaggggcggacgaggacggcgacgacttggcgagcacgacggtggttttcccgagcgacggcgacggctgaaacgacggcggcgcacggctggagcggcggcggcgacggcgaagctagggcacacggcgctagagcgattccgacgactagaagcgaaggcaagggtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaaacgatttagccaaagattccaaaggagaaaaggtagaggagatcccaaggatcatttcccctctttcaattcggccggagaaggaaaggaacggccggatttggaaaggaaacggcggcggcgcgaaactagggtttcggcggcggcggccgaaggtagacgacgactaacaggtgggccccacctgtcagcgagcgagggcgcgcgcgcgggcggcggactgggccggcttgggccgaggagagagaagagaggttttgggccgactttcggcccaaagccaaaagaagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaacaagatcttctcttcaagacttttaaaattatttctagaaattccatttaaacaacaatttataaattttaaaaaattttcagggtgtgacagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccg

SEQ ID NO: 4387 - DNA, 1597 bp, Oryza sativa
  unsure (1)..(1597): unsure at all n locations
nnnnnnnnnnnnnnnnnnnnnnnnnnnnnnnnnnnnnnnnnnnnnnnnnnnnnnnnnnnnaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagccccttgaccctaggttatgccaaacggttacccatagaagccctctaaaaatattggaaaagtagaactgttctcctccctttctcttttaaaccaaactaatggcacatgcacttcataatctcttttaatggttctcattaaaaatttattccagtgttattagtactgtacatctattactgtactaatggctcatttaccagcaaaagttttacaatattgctttatttaatcttgctgcaataaaataaatttagcatgttgattttataactttctttcatttcttttgaaacctgttattcaaaagtacaaaacttgtgacctcgtttccaactgtttcaacttatcttgcaagcttggtttactttgtttacttacctttttactttgattttctaactttattcaaattaatccaaaaacttttgctattaattggataaatgtcttaactccctcctttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcaaagctggaggaagaaactacatccatgcatgtcaggaagtggcaaggatcgccataggagagcttcgcgatcgctacagtgatcaattggccgacactgagtatcgctaccatcctcgtcaaccacagggaagtgaccgtggcagttaccttgagactgaaggaattgagaatgatgctaccacaaggcatttggtggagatgctgtgggctatggatgaaagtcgtgcggagattgtgttagcagctcaagatcgtgaagaccggaatcgtggtaagatttgcaagctagaagacaaagtggatcgtttggagaaggaactagctgtattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaaccattccaagattgagtgggtagcaactcaagatgatgaagacgagccgaacgagcctttaatcgacctccgatgctcggaagaactagagtgacttgttaagccgttgtcttagatcgttgtgttagcttgcttgttttaagtttgcttgtgtgtctcgcatgtgattta

SEQ ID NO: 4388 - DNA, 969 bp, Oryza sativa
cccggtccaccaaaccctagcccgctgacgcaataattctcttttccttttcaaaaataattcattattgcgtcataattcaattttaaccgatataagtgttttaatccgatttaatctttaaaaattcataactaattcatcttagctccgatttagttggttcaagtctctaaattcttctaaaattgagatttacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtatttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacgactttatcttttgtatagcatggttcattgcggggcaccagactgagaagtggcggagataagcccacgggggtcgctggggagtccatgccttgtttataagggggtgattatgatccaggaaggtgcgctgcagtggattgtgtta

SEQ ID NO: 4389 - DNA, 569 bp, Oryza sativa
tgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaagggttttaaaaagtcttttttggctttgggccgaaagtcggccaaaaccct

SEQ ID NO: 4390 - DNA, 430 bp, Oryza sativa
cgagctcggtaccctttattgtttttttttgctgtttccatcgaatgaacatcacaaattcacatatcaagatttcttttcattgttttttcttaaattcacatatcaaattcacaaactcacaaatcgaacatcacatactcaaattcacagatcgaacatcatagttcaaataaaaaaaaattactgatcaaatagacactacaacagattcacagaacatatgaaaaaatgttcatctaaaaacatctaaagtcacaaattcacaggccacctgccgccgcccacccccctcgtgtgccgccgccgccgcggcccgcgagaggggaaggggaggagggtagggggcactgtcgctgccgacgcccgccgtcaccaccgcggccctcgaggggggaaggggggagggggggagatggcaaggggggtc

SEQ ID NO: 4391 - DNA, 259 bp, Oryza sativa
cagttcaagcgatcggaaagggcttgacttgctgaggatgaaggtggaggaaggggacgtcatcttggtgaagaaacttgaccgccttgggcgcgatactgctgacatgatccagttaataaaagagtttgacgcccaaggtgtatccattcggtttattgatgacggaatcagtaccgatggggagatgggtaaaatggttgtcactattctatctgcagtggcacagacagaacgacagagaatactagagcgtacc

SEQ ID NO: 4392 - DNA, 652 bp, Oryza sativa
ataggaaataccaagatggaaactggctaaaacaaacaaggcaaaaatgttaagcattggtgaaaatttgtggttttggcaaaaatactaaggcggaaggggggattagaaataagctcaagtagatgatagatagaacatgcagccatagaagcaagagctgggtatggatcaggggcttcatagagcttctggtagatgttgagaaatgcattttctccaaattttgctctctttgtgagattatcaacttcctcttgataactcttcagcaaagaattgaataaactaagcttatcatctgaagacgccttcttgaaatccctagtgctctcagcaagccggcgtctgtttttctggctggtctcttgattctctgcaatctttaaaccctgctcatccaaaccacctctttccttctccagatcaaagtctaaagtgcaaagtaagcaagagtcagataatccgcaatagatagcataacgtttacattgtatcaaccttcatcgacatgcaagagaacttaacaaactcgccgtgattttctcctatagtgcacggccattcatactcggtagttatttcacattataagtccctaacagaaactacagttagcaggaaagcagcatgctaccctcacaaatcatac

SEQ ID NO: 4393 - DNA, 1174 bp, Oryza sativa
tacttttttagtctctttaattaggctttctctacatgcaaagccattctgagcccttgacagtataatatcttcagatctcttccttggctgcccatcatcacttccataaagatgatcaggatcatctccatcatagaagcttctgtcagggtcatcgccattgtagaagcttctatcgagatcatccctgtcgtagaagcttctatcaggatcatccccggtgtagaagcttccatcaggatcctccgcagatttatggttcaacaagtcttcagataggatgccatcagcgtcgcgaggtcgacttacagacaccctaggcttccttaaaaagccaaaacaactacagcagcccatgtcggtcaggtcagccattcagaccaagtaggcaccaggaaccctagtagaacaaaaacaggtgaagtagcaagaaacaccatcagagtaggaattgagaagtatgtcggttaatagggttcggcgtgaaaccaaacaaaaatgggaagtgcctactcctcttctacttagcatcatttggctatcgcaacaccaacctactgtaccagatcacacatcacagtaaaacaataggcttattcccttacaaataagtcaagactacaacacaaattcctcgcgggaaaactcacttgatcacagactttagtatattcaaagttaagaggtgataaacacatccctgggatttcacatcagatgaacacggagatgaaatcacctaagcaacacgactacgcaggtatctgctggtaccacccgcacgcgggctaaaaacaccagctccacgcccccgaggcacccaggtgaccagatccccgcccaaaaccgtcccgactcccggttgatcctagggcagaacagaataatcaccggaatagtgaatcgcccagcctacccccaccttgctccccccgcgaccaaaccaacgccttcccttccctactctaacccaaacccccgcacccggcgagcgtgaatgtacgacggcgggtgtgtggggcgcagatcggacgaacctcgtgggtggcaggggactccacggcggcgttgctcccccccccccccccccccggcggagctgcgggtgcgtcgcggcggggtctcctcgtcgcggttttgtggggtttggatgggaaaggggagggaggga

SEQ ID NO: 4394 - DNA, 3354 bp, Oryza sativa
atctatattgtttattggaatttaacgaaatagggtaatctagttcttttgtttttttaaagtatggaatagataaaattgaatttattttaggacggtggaggtagtacttcggttcaaaactactccaatgctatggctcatattgatatatgaattttgaactagtaaacaattgaaatgttacgtaagcatgatcaatagataatatgcccaatagtagcatgaccccgcctcctttccttcacagcgttcggcgtcctatgcatccaaagtcattgtgttttggcggtggaatacataagtaaacaataagtaaacaatatgttagtatttagttatgcaaaacattgttgccaagacttactcaactcacgactttcacctgcttccggtgataattaccactatcatataaatgggagagtagagtaccaagatatagggattagctagcagatacggtttatttattacctttacttgataaaacatgagaggtgtaccaccttttgcctaaagtaaagaattcaaacgtttgcgacccaatttaatagcgccagggatgatttaaacacatccttagtggaacaacggcttcactcctaaaatgaaatcattaagaacccacgctcaatctctccacattgttagtccctcatgcagctttgaattaaatatatgatgtggcctcgctcattttttaagggttgtgtatgggctcttccctatatccgcaaagagtttagtttaaaactattgtgtctgtttgatcctaagctgcaaatgagtggaatttgatgttgaatttcaatcataaacttttgagagcaggaggttttgcctcaactcaatccatgaatgttatttcatttccgctgaattcaactcagtcttcatcctaccctagagttatctctcaaagttgaagctaggaggtatttgatttattggatttcgagccccttttcttgctccttgccattagcgcaaccctttttattttcttagctttatttgaagtatggtttgttacctgaaaagatactcatcatattgctgcggtacattgggcatattagcgggcctattccatcttagtatccgtccacctcaacgtctatacaaaggattacgtatggacaatattgaaactgtactttccagtagtatcgctgctgtttttttgcagctttcgtagttgccggaactatgtgatatgggtcagctctcgcaagcttattagagcattgaattgagctctactaagagtaagatggcttttattctactaaatccaaagaatgctggctagggtgacgctcgtgcttctttcgagtaaggcaaacttagtaaggggacttgtcttgtatagtgggcagcggatctcttctgttcagttctttccctgctacgctactttgtgatgtatcctgcctgccatcacttcctatcgtcaagtaagctgattgagtgattccaggtggtagtcatccttgtaatacctcatgaagaagcaaggctgcgctctgcgcatattgttcttcagatcgattgtgtcacaaggcagacagatagactcctttcccgctgctaagggagagcaagaaactaaatcaaatgattgtttttttcaccagcgccctttttttgcgggtactaagagtcctctcactaccaatctgcagacatcatcatttggttgggtcttgccggtatcaacatataataagcactcttatcaataaattaggttaggtattgtgcggttacctaaagatacctgctcaacgtagatgcaggggtagaaaggctgattcaaatttagcgccaactcttttgtagtgaccacagagtcccgggttgctttggtgcacccaacccgtaagtattgtgttgtacaactctcccccaacgtagattggtggcaatcaaccatgaacaaagcactacggtattgactcccaactgaatcttctatacctttaaaaataagcaaccataaaaccatcctctcagcataacaatctataataggcagataaaaaaatatctagttaaggtaatcaacatatcaaactgttatatttatctcggaatgaatacctcaatactatacaattaccacatcatgcatttgatatatacataggcaaaacaatacatgtgtaaataccaggtgaaaaatgggcacgcatagcactcttgtagtctcagtgaaatctgactacggtcaatatgaaatagattatgaagcagattatttctacggattatctacttcattataggaataaattaaatattttaataaataaacctaacaaaatcaagtggtctcattaatataataaaagaaagttttggtagaaactgtacttttttagtgtggagcaaataatcccattcaacaatccagtaaataattaaaaacaaagcctcaaatccaaggttagtcataacaagagaatgaaccattcaaattttcaaaaccatctgtgtaaataagcatatgtactgcattattataccaataaaattgctatggtagtccctggcaaactaatttttgttggaccaaatgcaacgggccggtaagccaaacatgtagatttatgcacctgtttttatctccttgggacttttctttaccaaagaagaggacaactgatccatttcttatcctcaataactgcaaaattcactaatctataaactgttcttgcccgagcacaatccacacacgtctggattgaaatttacaacactaagcgtaatttgttaacttggtcattggcaactgttacattcatagttactaatgaatgtaactaacacgacgccgaatgtttacatgagtgaaacaaacattggtacataacgtccgagcatagcatttgcatgagctgatcagaagtcctcaagcatgtatcaagtgtaacaacagcctcgaggcaaacaaaaatcaagggaaatggagaaaaagtgaaacaaaaactcaaccatgtataacactacttattccttacaatcagtaaacatcctggtaaaatatatcatagcgaagtcttaagagagactagaaagaatataagggagcatatctaccgacgcttatctcgactgcgtaggggagcagaggaggcctgaagcatctgcaccaaccacggcaagctcacatatggtacaaagctgcccttcgatcgaaggaacaaaccgggagccacagtacgggcaggaaacatccttctggccacggtagattggaacatacgtggcgccacagacaacaaatggatttctgtagtcatagttcagctcagagctattctttttgccactgcaactgctgct

SEQ ID NO: 4395 - DNA, 787 bp, Oryza sativa
agagcattgtggaattgacccatcaggtaattgttttgtccagcaattttgcacatgaaacccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagaattaacctttgctgcagatcaa

SEQ ID NO: 4396 - DNA, 10028 bp, Oryza sativa
agcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattgttcgtcctatgactcgtattcctatcgctaacaacagcataccgccataccctacgcgctttgtgtacgattaagtccagaacaaaacagagcaaaattcgcccaaattcacatgaaaattaagaactccggaacaaaggatcaaggggtaacgaaaataacctataaccaacggcaacaaaatggatggggggcttggaacagaccggagcaggtagaacaccttgcactgagcccgtctcaccggcatcagcatccagccccctccccacacccacacccacggccgcggtggcctggtctagtatctcaccgtcctcggcctcgccctccgccggatccgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctagggctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacacggatgaggattgaggcggtgaggcctcccttcgagcttacagatttggggagatttcaaatagttcgattcgaaaaatgaaattgggaggttctttgataattgaaacgcagagatccttaagattattttatataaaaatagttcgaatcgtacaaaatccttcaaaaatttcacgttcaaacggacttcttagaaagcaagggaaccattggcttgggccattgtttcctttccggaataagttcactttgggtccctctatttgtcgcccagaccgattttcgtcccttgaccgcaaaactgggtatgacccgtcccccaacttacgaaaaccggggaaacatggtccctcggcggttttaaaggcggttttggctgacgtggcgcatacgtggcttgtttgattaggtctccgtcccacgtagcattgacgtggcgcttacgtggcaactatatctcagcaaaataataaaaagtgtggccccacatgtcagctgcaaaaagaaataactttaaaatggtggggccatgtgggccccatatgtcagcatcactcctctcttcttccctctcccttctctctcttggtccctttcctctctctctcttcttcccgggcagaggacggcgcgggtggacggtggagcaggcgagctccggcagcggcggtgggcgtggtcggcgccctggaagatgccatcgatgccgccgacctccacgcgcgccaggacggcatcgccgagcgcttctacaccgcgcttgtcgtcctcccgccgcctacgccgcgctagagccatgccgagctccctcctctcccgccagcgagctagaagggcggcggatggctaggcgagctccctggtctaccggcgagcgcgcgtgagtcgctccctcctctcccgccagcgcagagagatggggagttgacttgaacatataataaacattcaatgatgatacaaactgcaaagacagcttgagaggaacactagaacactgaactctgaaccattctgcacgaggtagtacattgtcataaacaaacgtcgcaaacgaccagtctaatgcgtgctctaccactcaaagtggcaaccaaatcgatggcacaaccaatcgaccaaacaaattcatatctcttcctctttgatctcttctccctgctcaatctcaagaacatacattatgtgttcaacaaattttcatcaaaaaatctcaagaacacgtcgtgttcaggcaaaagaacaacagagacaagaggcgatcgatggcaatggccatggcgaagctgttcatcacagggctgagcacggtgatcgcctactcgtccgcggtggtgttcaagggcgccgccatggctgtcgtgctcctgctcatgctggtccagctcccgggctacctcagctgcctcctcctctgcgccatcagagcagccgtcgagagggccgtggcggccaccttcgccgccgccggggacgccgtctcagcggcggcggacgctgcagtggggtagagggacgccgcgtcgtcgaacagcaccgcggcggtggcattcgtgtaggccgccatggggaggcccaaggcgctgcttgccgagatgctcgccatattcggcctcgtcgcctcgctttcgtgcagtccagcgacgacgaggaggaagacttccttgttgggtccgccccgggcgctgccgcggcccgccgccaccttcttctccggcgcagttctcgctatccccttctctctatccctctctctctatcctctctccttcctcttctctctatcccccctctctctccctgagaatggtgagtggcgacggaaggcgcacaggggcggcgacggagctgagacttgagaggcggcaggtagcttgtggagcggcggctggaggacgacgagcgcggcgtagaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtcatgtggatcccatagtttttaatatttttcggatcaaattgccacataagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacggtctaaaatccttggcccagttaggcagaccatccagccaacccactgaacagcccatgccatgacggagctgagacttgtcggtgactcgcgacacgaacgttctggctagatcgctggacctgaccaaaccaagaccaagaccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacgggctcgacaggaagggggcgggggagatgacgaacgtgctggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggacatcggcggcgacggccgcgcgctcggcaagctccgcccgagtgcgagcgcgccaagcgcgcgctcagcagacagcaccaggtccgcgtcgagatcgaggcgctgttcgtcggcgtcgacttctcggagacgctgacgagggccaagttcgaggagctcaacatggacctgttcaagaagacgctgggacctgtcggaaggccatcgccgacgccaagctcaagaagtccgacatcgacgagatcgtcctcgtcggcggcagcaccaggatccccaaggtgcaggagctctcaaggagatgttcgacggcaaggagccaaccaaggggatcaaccccgacgaggctgtcgcctatggcgccgccgtccagggcagcatcatcagcggcgagggcggcgccgagaccaaaggtaacgcaaatgcgtttgaattaccagcgtgttcggctggtcacgccatgagtcctcctcacacattgctgttcttggtgaccagacatcttgctgctcgacgtgacgccattgacgctcgggatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgccggcgccgcgcggcgtgccgcagatcgaggtgacgttcgaggtcgacgagaacggcatcctgcacgtgacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgtccgccacttcagaaaggaaagatgttgtgaagtgtaaacggatctcttaatctcttatcattagacactaatcttttttgtgttttaattaccattaatcttatctggaatgcatcaatggacaaattttgaggtatccctatctaagtctctaagctgttcatcagctagaggattaacgaaatgcaagcctcccactacgataactttgtgtttgctcctacacttacacgggcccacgtaatacaattagctaacttgctcgagctaacacgccagcaagttgcaacaatcttggatccgtaatactcgatccgacacacgagatgacgaggacgcactcacgcacaccgacatctacacatatgcatctgcggccgcgtggccaaggcaactcgcgtcgcgtgctcaaccgcacccgtcatggcgcgccaccacgaggacccggcggctcggcggcgggggcgcgcgctcgtcgtcggcctccgggccgaacacgaaccgcgcccactccctttgccgcgcctccggcttcggctaggcctgctcccgttcccgcgcgctcccagcccccgacgccgacgcgagcaccgccgcaacgagcaccacgacgagcaggggagccagcagggacaccacctgcgccgcgctctccgcgatcatcgtcgtcacagcgagcgagcgcgcgcagccgccacagaggagtcgcagcagcgtgtgttcggctgctcttcccgggcgtctcggcggcggcggcggccggcgcccccactacatatacaggttcgccacgcgttagctttctcgtgcgcaaccaccgcgccatggatcgcgtgacgcagctagcgcgcgcctcgccgtctttcggcttgccgggtcatgaaaagtaaagccaatagcctgggaatggagaagagcagcgttctcatgcgtgtttgtgtccctcgtcgtcagctttacggttgcctgcgttggcgggaattaactctgctcccggtgatcctcggtctcatggggtaactgggtgatgcaattcattactggttgggagtttggtagtagtcgatacgcgcaatacacgagccgcacggactgaaaactgatgcagttcttgaattcgcaagaattgaaacagaaaccgagactgctttgttgctgtcgccgaaatgttgcattggattctgcaggtgactacagcggctgcggaagcacttcgtatagaaggagatttgccagattctttcgataattagtaggaaattactttgaaaataattgtcttttaaactatattaaacatttaaaaattgtctataaataatatctactttaaaaacataggataatatgtatagattaatcttgaaaattacttcagtataatcatatatatttattaatagccctacatatattcagagtcatttttaggataccgtgttctcgtctaaaacaattttttttttctaaatcgacattttttaaaaaaaatctggagagactacagagtatacatgcttcgttgactgagcccctttcagttgaagtatgcaaatcattcaggcacaacaagcatgaataaaacccactgctgaatttcataccgctatcatctatattcttgttttctgatctccaacataggatcatccaggggaaatttagtacacaataatcgccagctaattatcataaaaactacccctttccagctgagtgaatcttgttcttgtaccatcacgtacatgtcttgctgacttgtagaaccctatagctccaatagccaaccttcatttttccatttccgatgtcttcccgacgtcctactcaagagccggtgccacctcggttgggttaccttcaaacacatcagagcctgatgattctgactcttccgggaactcctgtgtttggaccgattccttgtaggaaggagtttctctgaagtctgtcgctccttcgttatacgttgccacagcgaacccacatgcaaccagctgcaaaagtatgcaaggtcaacagatacaaagtgagaaccaacatacaattgtaattttatcaggtcctcgagagataacatgaatataatcgatcaattgatggtaagaggatggaatggcatgcaaagttatctctgcagatcaggcggagacatgctgagaataatgttgaactgatgcgtgtcaatgaaaaagcaccaggtgctatcatcagtttaactcaattaagaaatgtcagatgatgtcttgctaaatagcatgtaaagaaataacttcatgtattcagcggctgatttatttccactattgaaataaatgtattcagcaaccgagcaacacacactttcttttccatccactagatgactagacactgcaatggaatcacttgtggcaagtaatcagtgtgctaagtgctaacaagcaatgcgatcaaatcctatatatatttttagaaggcgcaaaagctttgtgcgtcaatatattaaagatcaaatcttacatatgaatgaccgtaaatgaatttgaatgagtatgatgtctgatactctatattttagttggaacatcaagctcatacaatcactctaaaatttgaaacttgtaacttcagccccggacagtgccatggcatctcttctcatcacattgaagggcttgtccggaagttgtacttccattatcgaaggttttgtcgcatgcagatttcctttttgcacaattgcacattttgaagtttcagaatagaagcgtatcaattagctgaaatctaagtttcactaactgcaccaagctaaagatttacttctgagcacttgagcatggattattgataacaagttactagtttcccaacagcagtgcacaaaacgcatcaactgcagtaaagcggcaaagtaatggaggaggaggaggaggaggaggaggaggaggtgctcacgccgaagaagacgccgaacgcccacatgtactgcacgaagaagccgaaggcgtcccact

SEQ ID NO: 4397 - DNA, 3963 bp, Oryza sativa
acgcttctcaggatctgtgagggctgggagtgagagggagatgagataagattttcattttttctttttctccttttgttttctagttccgcttctctatttttcgtttttcatcgtttcagtcgtgtagcaggagcgctaaaagccatgaagaaactcgggtgttactgcattagatttcgccgaaaaaaaatcatgagctagttttgtctggtactccatttcaaaagagacaaaattatatgacattcggtgatttaggtacttgtataattaaagtaccctctctatttcatattataagtcatttttccttatttttaaaccattcttcttaaaacttctaccaggtttatagaatatatatatatatatatatatatatatatatatatatatatatatatatatacaccaccaaatcaattttattaaatctaacattgatcaaagctaaagaaacttgacttttaaaaaaaaagttaaaacgaattataatatgaaacggatgtagcaattttttttatcaaaataggtttgtttaatgcaataagtttgtaagatggcccaatagaaatatttttcaataaacaaatctaacatgttatttttatgtttttaaactactgtaaaattcattagtggttaaaaattttagagtttgcaggtcgactctagatctaattcaaaacatcaaggatttatgattggagaggatagatttattaccataatataaatatagtgcttacgttgaagagttcattcttccttccttaaatataccagaaaaactatagaacggtctcccgttctaacggaatgactcaatataatagagcacgactgttttccagatccatttctcagatccgttttcttccccatctttccctgagctgatcgccatcctccacctccctcccttccccgactcctccaacccatatcgatcccatgtccggtcaccggagaaccaattgacgtcgttcctaaccctaaggcgtccttcatcctcctccccccttcatacaccagattggacatcggtgagagagatcggcgaggtcatggggccatcgggaaattggtgacgtcagcaagcggaaggtcattgcgacagcaagatcggcgttgtcttcgttgaggacggagaagaggagagaatgcaaggctgagagtgagggggacgcgcgaggaccagtgcactgacgacaaggtgcttcctacgcgtctcgagcttgccgcactgtgctcctcgctgctcgtctccattgtttgcaggtacgtcatcctcagttgataccgggtaccaggcctgatacctcaggtgtcaggtactaggtatcaagcatgatacctcgggtatcatccttgatacctcgaggtatcaagcctgatacccactggtatcagacttgatagccaggtatcagccgatacccataggtattaggtgccaagtactaggtatcaggtatcatgccacgaggaggaagcgcgggttgtcacttcctaaccagccagtgaaccatttaccaccgatttctcctctcctcttctcactcctctcctgttctccctctctcccctcgacacgctccctcctttactactgttgatgcggcccgcgaggggggtgagggacgtattaaatcgttctaattatatttgtgcttatattttttaaatcatgattggaagaatgattataaaaaattgtgattctaagggctcctttaaattgcaataatttaaaaatgtaggaatagaaagtgataatatatgtaatccacaagaatatgtcgaacatgtattgtaggaattttagaggaagaatattatcaagattagacttgaaaggagagatgatgcattggacttccaaaaggaaaccaaaaccaagaggtttgggctcatgtttgaaattccccaaaatatagaggaaaaaaggattcatatgcaatttttctagcaaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtagcaacacagcaccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaattgtcgccggccagccttgcctcagaggaggacaaaaggcacaatgaacaagttgatgaatatttattggtacgagacaagtttcagactgtcctggaatcgcctgatatgcttcagatttcatttcgaattgaaaaaaaatatggtgtgcttgggtgagaggaaggcgacgtactgggtggagaggaactgctcgaagagaaccttgatgaggccgaggccgaggcggaccctgcgcaggttgcgggagtggctgccctgcttcttgacgcagtcgttctcgacgtctttgtccaggatgtcgttcagcgtgccgtacgacttcgccgctccgatgaggtcgttcacctgcagcagcagcagcagcaggattggtcattcacaagggaaatcgccgttagtacatttcttgccgccacaagtacatttcttgccgccacaagaattcttcgtggccaatcagaaaaaagaaagaaagaaagacgcaaagtcgcaaacgcgttttcatggagcatcgttgagaagtttcggtttttttttcctttcttggtttgcttttctagcgcaagaaaataacggaaaaggaatattccaaatcgggggtaggaggtgaacgctgcaagatctaatggggaacaggggatcaaacaggaataaatcgaaatttaaccagagtcaaaagcgaaatttcttgatgcgttgtgatgaagagatccaagaaacaaaataaagaatgagaaagacaataaaattaccaagaacaacaaccacgaacgagatcgagagcggtgtgggggatggacgagggtttaccttggcgacgtactcgatctcggcgaacctgaaggccatgccgaggcagctgaagaggacggagacgagcgcgcacgtgtcgccgaagggcccgaggcggagctccccgccgtcggcctccatcctccgg

SEQ ID NO: 4398 - DNA, 5478 bp, Oryza sativa
aatctcttggcccgtgtggagacgaggaggaatggaacaacagggggtgagctggtcgccagatcggacgcttcctttatataggcatcagcgtcaagattcgtgctgggatataggagtacgtgccacgagcacgagtgcacgaggtggagtcagccagcgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttctttttcgcattattcaaacaattttaaaaatttaaaattaacatgataaataaatattaaatatatcatttcataaatatataagttcagatttacaatatttgagttgtaataaaaagaacaaatttatatgtaaacagtatatacaattttttttatatttttaccttgcatgtttataaagtgatatattatatattaatctattttgtttctttttgcaatttttcatgactgtttgaacgttatgcaaaaaagaggggatatgcattaacaatataaattatagcataaataaaactttcaagaattttagttaatcattttaaatgtattaatggttaaaatcgaaacactaatgttcaatgtaggagagtatatgaccttaatttgttactactgctactcatatttttctacgagtaaagaaaaaactaagggaagcttccgaagatgtttgcattgagccggaatcgaccgttgaataaagcacggagaatcggagatgcatctgggagcttcttcctaaagtgaccttgactagtgtaaccgtgtgagccatgacctgtacccaaagtaatctaggagcatcaaagcgaatatacttctctgattgcgcaaaaacctttatatgtttatggacctgtctagatcctatttcaaatttttttactctatcacatcaaacgtttaaacacctatatgagatattaaacatagattaaaataataactaattgcatagtttactactaatttgtgagacgaatcttttaagcctaattgctccatgatttaataatgttgtgctacagtaaacatttgctaatgatggattaattaggcttaataaatttgtctcgcgatttactgacgaattctgtaattagtttttttattagtgtccgaacaccccatgcagatatgctaaaattttacatcccttatgttcgtgaatgtactcgttcccccaaaaatattaaggaaaaaacaaacaaacaagagtactcgttccagcatgaaagcaatgctaaacaggcagtagacagtactactaatcattatatgtgttacactaaaaatgtagttttatggaaccgtgccagaacttcagaacgggtccggctcctcctgcgcctcgttgtgaagcaccactaaaacagtctggatatatcattgtcgtgtacaaaaatgattacgagtcaagaaaacgacccgaaataatgaaaaacaacatgatataacaggtgaagattcaggcatttcttaatgctcgagagcttcgcaacgacctggatttctttttgctacctatcggtttcggaatgcttaaaaactcttgaacatttcgcatcttcgggcaggcgccgtcgtatgatttttccgacgcaaccgcaacttgcacgctggaatgctcacgcgcgaggcccagtgacaccgcgaaaagcacaaccgtctaaactgtcgatgagctggtagtgtacagctgcacatgctgcgcattattgcgaaaaattctgggcaactgttattgagcggtacgaattcaaatatcgatgaacaggttatttgttctattttttaagtttggtttagctatgaagcaaaattcagaccgcatatgctttttgtttagtggtgattcacatcggggtgctttagacccagtttgaagcaagcaaaataggagcatgaaacaaaatcaggagaagagaatgcctcatcagttccgttttgtaacccttttattagttccgagttgcaaaccggaccacgaatccgagaaccgggtgaaataactgggattatctttagtcccggttggcggttggtggactaaaatggtagcaccacgtgcatattggtggtttttttctttttttattgtttttttttgctgtttccatcgaatgaacatcacaaattcacatatcaagatttcttttcattgttttttcttaaattcacatatcaaattcacaaactcacaaatcgaacatcacatactcaaattcacagatcgaacatcatagttcaaataaaaaaaaattactgatcaaatagacactacaacagattcacagaacatatgaaaaaatgttcatctaaaaacatctaaagtcacaaattcacaggccacctgccgccgcccacccccctcgtgtgccgccgccgccgcggcccgcgagaggggaaggggaggagggtagggggcactgtcgctgccgacgcccgccgccaccaccgcggccctcgaggggggaaggggggagggggggagatggcaaggggggtcgctgccaccgctcgccgccgccgccgtggcccacgagaggggaaggagaggagggcaggggagccaccgccgctgccgacgcccgcgagagcggaggaaagggaggagtgaaggagataagggagagatagagtgtgggaggcgtgcgcagtggattccgagaagataagggtgagtgaaaggtgaccggcaacggttttgtttttaaatttttggtatctggatacaccaatcgaaactaaagatttaaataatctttaatcccggttggtgttaccaaccgggactaaagtgaggatcttttgtcccggttggtgccaaccgggactaaaaatccttagccccttgacaggccgttgaaccggttggtatcatatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaagttaactacttaggagacggagaaagtatatgcgagcgagatattttttttaatgaagaaatatgtaatttttagattgaggggaatatatacgtacatccacgcgttgccacgcgccccagcgccgtgccgtcgaggcatcgaaattcgaaccacgcaacacggcaagtcggcaaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttggatatatatatatatatatatatatatatatatatatatatatatatatatatatatatatatatatatatagaaaatcatgagatgtaattaggagtccgatcgtcttaacttagtatgcgagttttttaaaagagattatacgattccttctatatttttaaaagcgaacgaatttaaaaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgac

SEQ ID NO: 4399 - DNA, 17225 bp, Oryza sativa
taatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgacagtactaccatgaaaataaaaagaaaaagagaagcacaaattcatgccttctcaaacacgctgccattaattaggaaaaaatattagcatacgaagaatttctcaatactccactgtatggtactctccaaaggttacttctgctacaggtttctttcatttaccgatttcctggcaaactcaaacagaaatctcgttcacaaatttccgcgcctctgattaattacacatgaatgaagtgctgcagattcctgcgacaaaacatttaaaacccttttgttccaaatgagtactatattttgatgacttattttcttcagagttcagacattccatgatcctttgaaatgcaagattgtaaaatcaaaaaaacataaatgcgcatggataaaatgtcatacgcccattgaattcggatatagaaataaaagacaagtgaaagttttcatatgaaatatcctattacatagaaattccaaatgaatctatattcctttgttccaaaggagcatattggaatcaaactcttcaaaaactcttcaaaaaacaatttaattttctctcgttacaaaggtgcacttttacgagtttctcttaacccaaatctaacagtgacaaagtgagcgtagctcgactagttagatccttgttgtggcactagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcagcccccctcttctcctcgcgcggactccccggtttgaccgcgcatcgccacgcgtcggctcaccattggccggggccgcgccaaggagaggccaggcgagcttcccgaggagccgcacccgtcgctttctaattttttcttttctcccaccctctctctctttcggtctccactccctccgctcatccgttcctggccttttttacccgctcttcccccgatctccccggactcccacagccgcagcgaacaaatcccgcgcgggttgggaagagcgagctcgtgaggagagcagagggaaagcgcgaggggaaagaaggaggaaaggtgatctcttctctccccccttattctttttttgttttgcttgtctcgctttttatttttttgctacctttacggttgctgggatttgggggagttggtggttggttggttggttggtggttgcgtgaatccgaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacgaaatatgcacgcatagctgttcccctttcgagctaattcggttcatcgatctatcgtttttttacctattagatgcagtatgcctccgttgaactgcagatctagtcatttcgctgctgttcatgttgttttgaactgttagtctgtctgcttgctcttctgtggaagaagcagcagtggcgctgtcgttttcttagcttgaggtctggtggtattggactagatcactggtttggcagccactttcttgttgatttgtctgacggaatcactcgaaaagtaagaaaataaaatggagaaagtactctagtgaaagggggatggactagaatatttagttgcctgagaatgattcctttcgttcatggaaaaggcttgcgcttgttgtctaattgggaaaatgatgtgccatccacttggttggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtattgatttctggtgtttcaggaattagcagtagctaacagtttaccttttttgtgtttcctaaggtttattttctggttttgaatgtataggtaccttgctgagtttaagtcaggagctgagaggaaggaagcagctgagaacactcttgtggcatacaagtctgcccaggttggcctccgtgtacttttgccaatatatatggtgtatagcggtgatatttagtttgctatatcattatatttttcttggagtagctttataagttctgatatttttatgtcattcctaccagtgattttttatcctccatgctgtatcttcttcaccgtaggaaaatacttccagtcttgatttattttataagttcaattttcatttatgggatgcatatttgctcatgtttgagacatacgctgctatttatggcatgtatcatgtggcaacgttgagttatttattgcagcttcatggattttgatgcatatttatcagcagaaactgcacacgatgacacttgattgcttttttaggatattgcactcgctgacctgcctacaactcacccgataaggcttggacttgcactgaacttctcagtgttctactatgagatactgaactcaccagaccgtgcttgcaaccttgcaaagcaggttagtttttcatttttttcccttttgaagtttgtatcttcttggtatcttgtattacttaataacctgaatatttgaaactgaaggtgcttgattgctagtttttcatgaatagttatgcattttttttatgtagcaaaattcacgtgcaagcatagaatttaattttgtttggtaaattgagggaaaataactgatgattgcttatagtatgcctgttactaagtaaagtaaatcttctgtctttgtattctgttcaaccttaagaatgctgttcactgtgttttattatgcattcagatcagctgtgatgcgccctcttgatttgttttcagtatgtatttatctactccgctgcgtgtgttccatgtttcttctagtttgttgcatgctttttctagtttttagcacatcacattaaattagctactgctcaaattaacatactgaacgggctaatccttcagtttttcatctagttacctctgtgaaaaatgttgatcctgtcaataaatttctgttcatatctgaattgttttgtcccctagctttgatctggataatactgctttttttaaaaaaaatctgaaagatcaccaattaaagcttcgtgtcccttgaaactagagcttgttttctcacttggtaaagtctgatgccctcttgtctaggaatatactgaaagatgctaacttcatgtctttattttaggcgttcgacgatgctattgctgaactggacactcttggcgaggagtcttacaaggacagcaccttgatcatgcaacttcttcgtgacaatctgactctctggacctctgacaatgcggtatttgctctaatatgcttattatttttcctttcattcatttatactgtaattgttatcaaaacgattttctggcatctaatcttatgttcctctgttcttctcccttcaggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtcaatgttattttgaaggctagttcatttgacccatgaactcttcagtttatctaaatacaaccataaacacagtttatctaaatatacccataaatacatttggccccctgacgcaggatgccaagcttacaaatctgtcatctcagcagcccggaggctttcggtgggaggagtcgatctttgaactttttttattttaaaaataaactcccctaaaacttatttttaaatagaactcttttggcatggcaaagtaatgctaccatgccagctagtaaatacgttatttgatcacacctgatttggctatcctgataacgttgtttcgtcgtgccactatggttgacgtgtcatcataaaattatcatattacatgtgacatgactattattttgttgtttcgtcgtgccactatggttggcgtggcatcataaaattatcatattatgggtgacatgactattattttgtcatgttaggtggattggcgttaaaaaagatttaaattttagaaataagtttttagacggattatttttaaaattgcaaagacaaataaataataaaatttcgagtctctacctttaggctaatcggatctatatatcagctaggaagcacttgaataaaatgcatataaaatcatgacgatggcgatggttgtttttgctcaattgctccaagcagaagcgtcgatcccatacccaatcctacacctcttccctgatagcctctcgtcttctcttacctccattgacatagctattgtatgagattgaatttttcttatgcttcttgcttcgtttcaggttgaatcacaaacatgatgagtcgtacgctgttaatgattatattgtagtactagttcataccccatgcgttgccgtgagactttatggttataaacatcttcataacttttagtttacagaaataaaaataccaaacatatatatctaaatataatcaggttgcgaatatcaagtgcataaaaatgcttagttgcttctcatgccaaatgcactatgggtgtatggctcatcaaacagctaggatggctcaaataagagaaatgatataatctaatagtctatatttataggtgatgtgacttcttgtatgataagtttacatgagttagggggtgtttagatggggctaaaactttttagcccatgtcacatcggatgtttggacgctaatttagagtattaaatatggagtaataaaaaaactaatttcatgaatgagagctaatccgcgagacggattttttaagcctaattaattcataattatcaaaagtttactgtagcatcacattgtcaaaatcatggcgtaattagactcaaaagattcgtctcgcgaattagtccaagcttatggaatgggttttgtaattagtgtatgtttaatactctaaattagtgtccaaacatccgatgtgacagggacttagaataagtccctggaaaccaaacagccccttaatgctctaatgggttaaactacgtaggaggaatagaggatttgctcttattgacaaccaatatttactatttattcattttatgtagacagagttccaccagagccctagttttagttaaaccaaatcattgaacttctatcaagccaaacattcaatttagtcacatgattattaagctcattgctcgcttaattctgtctcctctgataaactgatcccacaacctgatcgaacaagttagccaaagaaccgaacgagacatgtctcgtgccctcacccacaattggactcatcgtaacgctattgtcaagtcaccgccataaccatggctgcttcctttccttacgaaattggggagatggggattcaaagtatttacaccatcacatagctatggctgccggtggtggatgagtcttctggatcacttgaccttttggttgtgaggctcgtatgcatgtcagccactcaaagttagagaactgtatatcaaagaatttgttttcgccaacgtcttgaacctatacgagtgaagatccagccctcgaataggtggagagtagccaaataacattttatatattcaattttaggtgtggtatatactactcctctgtacttaacatagttataactacactactttatagtataattacatctgaaagtttttggagagcttttctgtcgaaagtcatatacatagtttttgaacaaatactacttcaattattaaaatgttggattttgcctaattgctctcatgccacgggtttaagtgttgttgtacaaatatcatgtccgtcagtgtattaaagacctactcccatatccaaaaggaaaccccgtatctctttttctcctcttctcctcagcattcgtgtttttatcttcttaccataggagtgtgaaggatatataggtaaaagagaagattgtttcttattttactataatattctatttagagagcattttactcttagttcatggtgagtgtcctactttccatgacggtgtaagctggttggagatatatcgactagatatgagaaatttcagttcatttttccaaaaaattccaatcatacaattcaaatgcccaatattccactaatgacctcaagtttcaattgaaattgcaaaaaaaaaaaaaatcctcttcaagatatgaaacaaactttcaacttagaaccatagaaagtatcggctcataatattgatatctcaactccaatcacaaaaactttgtatctcaaaatccaactcaagtttggcatcgttcttttctgaataagatgtatgttttatctctgttctcattaccatgattttcatatcgctaaacggtgtattttgtgcgaaaactttttatatataagttgctttaaaaatatcaaataaatcaaattttcaagcttttaaaaattataacttaattaaccatactaatgtctttcttattttctgcgtcgtgagtttatcttcaatcagtttcttattatttcccccataaaaaaggggacaactttcgtttagcttgagaagggagaagccacgcccagaacgtacgccactgacgcgttgcggtggaaccaccgaaccaacgggtttggcccggacgtacgcaccagaccaggctcgctgcaccaactgcgccaaaaccacttcggacttcgcgcagcaagcagatcgcgatatcgcatcgcttcgccgtcgccgcccgccccaccggatcccgcgcagatccggacgcccagatcccacgagccccatggaggcctcgccggccgcggcggagcgcgaccgctcgccgccgccgccgccgcctcccccgcccccttcctcgtcggccgccgccgcagcggcgatgtcgtcgccgctcgccgtcgtctccagcttctggaaaggtccgccctggtcttactcgccccctcgtgatgatgatggtttgagttggtgagaccggtggactgggttggattgggtcgtctcccgttcaagctttcggggatagtgattgccacgactctagaagaatttgtctgggtttgttactgatcgcaagtggagggatcttaatctcggtgaaatgttggcctacattggcacttccgttccaatctattgctagcatttgcgctctctacttcctcaattagagtaagacttgcgatatgcttaacaataagtgtgggaagcaatttcagtagcataggctttgaggatgcagttatcatcctaaactagttctgtatagccattcgatctagcaacagcctttgtacaatgagttagttatgaatgtaaactttcaccatttgcttaatgttaagaggttagtaggtatgatttgtgagggtagcatgctgctttcctgctaactgtagtttctgttagggacttataatgtgaaataactaccgagtatgaatggccgtgcactataggagaaaatcacggcgagtttgttaagttctcttgcatgtcgatgaaggttgatacaatgtaaacgttatgctatctattgcggattatctgactcttgcttactttgcactttagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgtatgttctatctatcatctactgtagcttatttctaatccccccttccgccttagtatttttgccaaaaccacaaatttccaccaatgcttaacattttgccttgtttgttttagccagtttccatcttgttatttcctattgacgcctaagtacatgcctgaagaattgtacttgtagttgtatgtgacataaatggttatagtaactcttattgttctgtaactatgtacaaccgagcaagttgttgcaataatatgtccagttacttatttgaaactataatagtaattttgtcagattgcaaaatatagataacagttagtttgctccagcatagtagaagtagtaaattgttgaaattacaaagccggatactgcaattttgtataacaaagccagatgtctcaactttaagtgcttccagaggagagctttcaacttcattgttttgtactgcaatttcgtgtaacaaagcaagatatttctaactttaggtgctttcagtataatagataggcttcaattattttatggcactgacatttctccccaacctgtcctgtttatcatccaatccattcaggagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacaggtctgttctgattctactcagttgcttgctctcttttcttagctagaattaagtctatttcttgttctttccatgaaggaagtaaaaaaagataagttcggtcggatactattgttttttcactcgtaaatagtgacttattatatccacatactgtatacctttgaatggcagtccatttttctgacaatttggaacctttatctgtagaaattattttaaatctagtttcagaaactcacaatgagcaatattttagctattcttttgcatagattctacattctagagacagaaatgaatattttacctaatagcaatataagtatgtttttgttctgctgatattctgacctattaataatgtacttctgagcataacacagtcaatcaaaattatgcgataaacatgtctctattttacataagtatgtttttgttctgctgacattctgacctactaataatgtatttctgagcataacacaatcgatcgaaaataataaaaatgtttctatgttatttaatttgtatgaaaagtgaaatatttttttttcaaatatgtgtgttgcggataattattattggcccaataacttttcttcattaaattcctgctgatttcttccaatttatttcaaacgccaaacttccattgttctcaagttcttcttttctttttgcaatattctttcttccatttaataattttagatggaggaaaaagtcagagagatggttgaaatgaagcagaggagtttggcagaagatagccagaaaactcttgaagccctgaaagacaggtactgtgaattaatggtaactagaaatataactgctctatgatcatcatgtttccaatgcttttttttttgtctgaagcatattttttttaccttttagtttttcatggttgtagggagcgggcattgcaggaccagctaagacaagccacagaaagtgtaaagaatatgcagaagctacatgaatcagcacaaagtcaattgtttgagcttcgtactcaatcaggttacttttattacaactgtgtaaccttgaaggtctttgtgactttatgggagaaacatgttcaaaggtttcgctgttgtgatgaagtatcatgtttctttcagaggaggaccgggctgcaaaggaaactgaagtcaatcttctgttggatgaagttgaacgggcccaagcacgtttagttagtcttgagagagaaaaggtagccttttgttttgaaatgcgagcttaatgtgtttgactagacaaatatttgaacataacattgataacagtgctatctgttttctacaaatcatgcaatgaccattattaccaataaccaaatacatggatgctactaagttctatcatcactgaacctttgcaattgaaccatatacaggttcttgattcatgcaattcctgcattaagaaatcttttaagacatttggtatacataacattattgaaattactgtctaattttatatcagaaaatcaatcgcataaaactagtagagttactaagtaaaccaaattagggaattggacaatgaaatatctagaatatctacatcagaaagaagttgcgggacttacatgagactgtagctgtagtttgcacagctattgcttgccagcgtctgatctggaataccatgttttatgcctttattgttttcctgcagggtgatttacgatctcagttgcaaacaacaaatgaagatgcaaccaatagtaggttagtttatttgcattttccatatatatgatgtattaagccttattgatttcgaaagtgtagatttgtcagcatccataattcatatattagtaacacgtggctcgcgcctttcaccagtattgctgtttattagcattttatttgtttttttctgtgcttacccaaaagtaaatgctgaacttattgtctgaatcatgttattctacagtgactacgtggactcaagtgatatacttgagagttccttgaatgccaaggagaagatcatctcagagctgaatgcagaactgcgtagtattgaaaatactttatcttctgagagagaaacacatgttaatgaactgaaaaagttgactgctttgctcagtgagaaggtactcgtcatcaaaagaccttactgtgtaaagtcgataactgtttcttgaaataactcatggcaggactgtagtagaaaacaactttaaagcgatcatttacctgtctattactcatttatcacaatccgttgtcgaaattttgttgaatataggttaatttctttgcttctatcactatcgatttctattatgctagcctcaattgttatgtgtgggttttatagaatgtaccattatatgtattagtcacatttttggtgtggattgaagcatcaaaaccatgcatatattatttggaatgatttctttctttgcaactgtttgttacccactattttactttgctaattaacttccaatctgtaggaaaatgctctgacagagttgaagaaagaacttcaagaaagaccaacaagaagactagtagatgatctcaagaaaaaggttcagattttgcaggtatttagagaaaatactcatgtcatgaaattctttatgatattttctgtagtacctgtattacatccaccagttggttctgcactcattgcatgcccatttaatgtaattgcaaatctgaactgtacatgatttctgctttcctatgttgcttcctgtagctgtgtaagtagtaccctcatcatgttgtacaggtggtgatcctaaaataatatcttcgtggtagcattatgttcttttccatcatttctctacgaagacctctctcccccttgttatgcttattcctgatgacataccaggctgtagggtacaactccattgaagctgaagattgggagctagcaacaaatggtgaagaaatgagcaagttggaagctttgcttcttgataagaaccgtaaaatggagcatgaactaacacagctgaaggttggttggcctttagtttggatactaaaatgcatctaggcgattcctcgtgcatacagaaatgcaaggtgaacttgtttctctgttctgactagccatgttcttataccttgaaggtcaaaatatcagagaagtcaaatcttcttgaggaggctgaaaaaaagattgctgagctaactgcaaaggctgaagagcagcagaagttgattttgaaactcgaggatgacatactaaaggtttaatcagtagcaattgatccttatggatatagtactttaccattttagtataatatgtcaatttgaatcatgattcatactgttacaattatgtaatctcacaattcagaaaatgaaaaaccaaatgatttattattttagtttcatcttctgaaggacatgcaactaatatatattagctttattgcagggctatagttcaactgataggaggacttcacttctgaatgattgggatcttcaagaaattggctcaaatgaagtagcagaggtaatttccaggttgttcagtatcttatttgtttaaagcttgtgctggttgaagtttgttttggaatacaaactaccaaatcccatcctcaaagcaccatatttgtttattatatgatgtataatgcctgctttaactcagcagtggacaaaacatgcaagagaaactcaattgaaaagttcaattttaaattcttatatacatcttgaagctgtcataaagatctggatttaccatgaatgttgtcagtgtacagagatgctgtactaaacctctttatctgacgtatggattaatcactggtcttttgtatacactattttcgtaactattggtttgtaaacttatgctttaatctaaaaatcctgtcttgcctttccaagtcaataatcaagctaacaaactatagtagccttgttttgccatacttagacaaaatgcgctaaaaatttccttctctattcattcccaattcgtagcaaacatgtgttattttcagttagttgctataatagaatagccttcactcccttgttaatacatattttcagggtactgatccaaggcatgcaccacaagaccaagaccaaagttccatgcttaaggtcatttgcaatcagagggatcgtttccgtacacgtctacgtgaaactgaggaggtatatttcatgaaattttgaaaagggactgtaccagtttacaatttagagcaacgatgatagtgtagttctcatgtgaattagatgtgaaatgacatgatgtgctaatttcttttagtcttttcgatctgttgtcctttttactatattaatggatagcgagatgagagggtcatgcccttgatttttctttgaagtggggatctgtatatgtttatttatgatttcatttttatctatgtgcctctttgttttgttttgttttgacttattgccattttgtgtctcctaggaactaagaagactaaaagagaagtatgaaatgctagttgtagaattggaaaaaactaaagcagataatgttcaactgtatgggaagattcgttacgtgcaggactacagccatgagaagattgtttccagaggaccaaagaaggtttatacacatcctttcaagggaaaatagcaaaatccacagcattctagcttttgacctttgttacattgtgttttgcagtatgcagaagatgttgaaagtggttcttcagatgttgagacgaagtacaagaaaatgtatgaggatgacataaatccttttgctgctttttcaaagaaggtaacaaaatgtttacgttttatgataacgtgttatatacgttactctatagcttatacatacatttaattccatatccaggaaaaggatcaacggtacaaggaacttggtttaagagacaaaatcactcttagcagtggacgttttctccttggtaacaagtatgacaccatcgttttctccctttttttctttgggttcaatttcaggctttgcctcttccttttcatggcacatactgatctttgatgataactggtaaacactagttagagctattcatggcaaacttctatgtttcgaccataccaaatattatgatcttgtgtttaatgatgttaggacttatgagtctagttaatgtgccttgcggccatgcaaacgacactctccctggtagcatgtttaaaccagccgcttcttattaatgttagccgtttaatgggagagtaattcttttctggaggaccaggaaacacctatcaatctgtcataatgcataacagatctgctggttgagttttcgttcacttttcctttttttttaaaacttatccatgtagcggaatgacaagtagcttatgtaacatcttttctatttgtattcacagatatgcccggacatttatattcttctacactattggattacatctccttgtatttacattgctgtacagaatgtcagctttgagctatctcaggtatgcatgcatcgccttttcaaaattttaaactctgttcctgagcatgggctaacatggaatatttgcacagcacaacacctgcaaatgatgaaatcatcttggacgctggcaatcagacgctaccacatgcgctctaaatggaagttccatgtgtctggtattatcacttcatcacgctgaaaaccaaaatctggggtttgatctcaggaaatctttgcataggaccatatgactgaagccatagttgacatgtattctttatgtccattagacgtctgaatacgttttctgtagataaaaattttccagatatggagacggggtggatgggaaatgacaggatgaggcgtggtcgtgcgtttgagccgttattatgtaaactgttgtatcactaattgtcaattctgtgggtaaaatgaatgcacgcctgataatgatggttgtacaaatgccaaaaggataaagtcaaacaacttgagtaatgaaatcaaagttgtcactaccattttcaaatgaaaaattttaatgcttagaacatccactacaattctagtggtctaattctttttagaggaattagtggttcagctctaatgctccttactccgaaaactacaaaccagacctgatgagctttgcctgaacaggattcaccaaacacagtactacacaacttgtccaaagtcacattatcgacagtatatttgcttgtcttcgccacaccaatcattaattctgttctctcgagctgctggctctctcgaactaacccaaaaaaaagaagagaaaaacaagcaaaaaaacatgtaaaaactaacttttccttttttctcatttcggtggggtttggatcaggatttaactaagtctttgtatttagacactaatttagagtactcccttcgttttttaacagatgacgccgttgactttttctcacatatttgactattcgtcttattcaaaaaat

SEQ ID NO: 4400 - DNA, 16194 bp, Oryza sativa
ctctccggcttcgacgtgccggacatgaggctcgccagcttcgcgccggacatggagagcctcctcatgggagtcgacgaggggttcgacgatctgggcttcttggacgacgagaagcctcacgtgaaactggacctggacatggacatggacttcgcctccatctcgccggcgccggcgccggagcgggaggagaggaagaggaagcggccggagatgatactcaagctcgactacgagggcgtcatcgactcgtgggcccgcgacggagcctcgccgtggttccacggcgagcgccctcgcttcgatcccagcgagtcatggccggacttcccggtaagctctcacgcagagatctgtagctttctgccggaattggattttcatctctcgatggacatctccatcttagctcctttattccgtattacctactccctccggctaaaaaatataagcatttttaaaatagtgttaagtcaacatttttaaaatttaactatttatagtaaaaaaataataataaaaaaagattaatcctgtaaatttgatgttactggatgtattattgaacaaactgtcataatatgtaactctttttatttataatatcttagctttgtagatattgttggtcgaagtagtatctcgacgaccgtgtcgaagtataaaaatacttatattttaaaatggatggagtaaatagttattatttttttaagaaaaatgataacatagattaatatgaaatgtatcacctccgcaagcatacaaggcttaacttttacaattgcaacgaaaggaaccaatcaaactgaaaatagttcgtacatctgcaattatattttttcatgtttgttaaaatttatagaagctgaatttaaaactgtatgtttataaagtgaaatatttaaattaatctattttatttatattttttataactatttattagatgatgaaagcactttcctctttctgccattttcttcacgacctagcttgtgtactgttctgagctatcctatgcgtgcgtgcaggcgggaagccggggagggctcggcgcggcggtgacggcggtgaccggcggcgagagggaggcgcgggtgtcgcggtacagggagaagcggcggacgcggctgttcgccaagaagatccggtacgaggtgcgcaagctcaacgccgagaagcggccgcggatgaagggccggttcgtcaagcgcgccgccgcgctgccgccgctcccgctgcccaggcaccagcatccgccgccgccgccgccgcgcgctctgccgccggtgccgatgatgctcgcgccgcgcggcgcgcacgggcgctaccgtttttgagagctaccgctctcgatcggcttccgatgcgcatgcgcgcgtcgtctagctacatgcatgcatgcatgctagcgatagccgtttgcgtgatccaacaataagtacaaaaatactactatatatatatacaaacatacaaactcgtcgaatcatcgatcgtagcatgttggtttcaggtttaattgtttgggggtagtgttagttttgagcagaattaatctttgtgaattagggcgccctaccactctactatacgtaccaaatgtaccatgcatgtgtgcactgaagcagccggcaggttgtgtacttgtgcacaatttcatgtgcaaattaagtaggtaagttatgtgtgtggtagctaggctaggatgtgtactttcttggttttctgtaagaaagatcctgctaattataaaggttgttgtagattttgatcccggatcaatgtatgtaaaggcctatatgtatatactggtatatatatacagtgtttaagatcaaagtagagaaattacaatgggagcttgtatagttataagcatgtaagtatgtaactagaggatgttgaagcggaaatggctagtgttcttctatttgtatgcatgccttccaatgctttgttagtttgttgggtgatctcaagagcactaactgttgtaatcacgtgttaaatatttttggataaaaaaactatagacatgtttatagtgtatactttctatctatatttgaatacttgatcttgtctgttacctcctccatccctaaatgtttgacaccgttgacttttttaaatatgtttgactgttcgtcttattaaaaaaataagtaattattattatttttttctatcatttgattcattgttaaatatacttttatgtatacatatagttttacatatttcacaaaagtttttgaataagacgaatggttaaatatgttttaaaaagtcaacagcgtcaaacatttagggaaggagggagtatattatttgctatccttatgttctgtatggtagattcgtagttggttagtcgtaacaatatttacatatctgggatcagggaagacactgagcatgacgttttcactttgccattcaccaagtggagtagttatatagtatgatttaggaattacgactcgcaacacattttatatttgcatcgttacagatatcaccacagtgatgatgtggtgtacgaacgtacattcttctccattacctggcaaatctatcgtgaggctgtatttaaaacaaacaatatacaggactccgcccatgctaacattgcataataccgtctcatagtgaaaaagatgttcacatattcgcgaaaagaagataacaatacatccacatgccaatacaaagacccattcgttctgtaagacgcgatccaatagaattactagctcggctgtcttacaaaaggaacaaaaaaatgaataggcactgtttaacttacactgatacaccctctgttagtcgcttgaaatcaccgttcttaccatacaatgaaccgctcaacaacataattctacataaaagaattagtggctacatacaattgatgtacacgaccccccatttacaaaaggagaaatagactatttctcaataccctgctgcaagtattgaatcaagtcgtaccctgcggtagtccatttgttgtaggcatccacacatgttctgaccataaaattagcagcctcacgctcgttcatctctggatgaaaacgttttcgcagattagcgataggttctcccctgctaaagcaaggcaggccactgtccaccatcaaattaacggtagtaataatcccattcatgtgtctccttcctgctaggtaccctttgacacacaatctgaaagaacaatgcttgactcagagcatgtgcaacaactccaattctagttaattagaagaaaatgcatggaaaatatttacctcagaaactgattccaagtgtcactcttcattgttccagatggatcaagcaattgagtcatctcatggcttaacttgaaatgtgcactttcaaaccccatgtttcctccaggcgaaatctccaaaataaatccaaaatcaatatggactagtctcccgtggctgcacaagcaagatgatgattaaccaggtaattccaggtttactcattacaattaggacagaaaagtaaatcgtacctatcaaagagaagattgccattatgccgatcctttggctgaagaagcaagctagcaacagcatatccagcactactgatcatgaacatttcgcgagcagcttcgaaagaaggtgaacctacagggccatagtcttgctgaaatatctctaataaaccaccatcagttgtttcacccatttgatttctactccgagtatttggtaccacctgcagtgtggtcagatcaagaaggttgacaagaggaaaccaatagaacaggtaaacaacaaatacacaacgacaattgctcagtcatgaaagacgtagacttgactcattacttaggtgtcaacttgtcataaaaatggtagctccaaatatttcatttaaaataaaccagagttagagttgtttttttaaaatatcttagggcctgttcagattgtagccaaaataaaccttaccaaattttggcaggatttcttatgtatttaccaaatttggcaacaaactaaatatagacattttttttgggcaattttgccaaaaataatggtatagttgaaaatggcatcaaagtgaacaggcccttagacattagagatcacttgattaaatttggagaaaagagtccagagcatgttttgaaccatgctcattttagttgttctattgtcaaatataacatactcctaatttgaactagaaaggtagctatattatgggacggagggagtaataacaaagtaaagttttcttgttgaattcactattcacatttgcagggatattatactgctaaacatgacataacggtgtaataaaatgtcgattaactgctgttcaagatcagtaataagtgatccctagtccatatagatacaaggaactaaataactacagatggatgcttacctcaattatgcctcgctctggtccagtgggtaaaacaccatatgggaagagataaaggtttaatccaacagcttgaaatatgtcccttagaagagcaataacttggagtgccagcacatcctgtctacaatcatcaccaacctgttgtaacatagaaaatgctcatgtcaactgtgaagcacgttggatgctagacactaagatggttcctgccacatttgctgcatccttcaatagatttacttatccaatgcaagttttaatttatgttcagttaatttatgaactgaaattccatagtaaacatgaattgagacttatagctccataactcgttatatccataggttacaaccatgagatttcactgcaaaagatatatttaccttaaaaatgcaagcctgtggcttcacatcgtttgggtccccatcacgatcaaccacattgaaagtaatcattattggaactttagcagcagactggagaggaatgccactgtctacttgaatgccccgtacaaacttgtttgttgcagtaggtaggtacagatcatcacctggcacagtaatcttctccagctccctgcaaggacaagtttaggataatgagatactaataaggacatatttaattggaacccgcatgagaagattgaaattatatcagtagaaagctcttgatcttcaatgaaacattacagtggtttttactttgtaccttttaatacccgctcgccgctcttctttgggaagaggaaaaagaacaccagaaatcgaggtgaccttgtcaaaaaattcgaactctctttcaaacatgtcacgagcttctggagtaaaaccgtcaacaattttctccctaacggcaggaagcaaggaatggaatgcagtggcctgaaaaataattggagctattaacaccacattgcatatcttcgagcttgaaggagggcaggaaacaaaactgtatgacattgccacagttttataaaacatctcatatgaacaaattacaagtcaaagttaccattttagtcagaaaagcatcacattggaagggcaagaagcacaaggacaaataatctcatgtttcaaatgcatcatgcctaccgcaagtctaaatgtaatactacgatatgaggttcttcatacgcacaagaataatgcataatgaattgttcaagccctttattaatgaactaatacaaacagaaacaatagtacagttccatgaagggctagaaaacttctggaaactcagattatcaattaccatcacaaaaaaaaaaagagttccaaaagaaagaaaaatggtgcttcaccgtgaggttaaaaaatggggtaaaaactaaaaaggcataaaggcttcaacaagtaattgccatgtgccttatcaaacaaacataactcatttttaacttatgaagatatatgactttgtctttaaaaagcaccactcttctcaataaactttcagacaagggatataatagaatgacatgtttggtcaagaaaaaaaaagacatggtttctttttcaaggtggtgttgatgatgcaacagaatatgaaagtcgaagcaaaggtacataaatcttaaaacatggatacctttggtgcagctgcttccttcccaggttcatcgggaacacattctccctgcaatttacatttcctaactcaattagatattcaaataactcagttatcgaacatcgcactaggcatatattgaagaatgaaacatgtttttttatatttgaatagagtagaatatgataacatggtataacagaataaaaataaaataaaatttacctgcagatgccatattaaaatatgagcaaatatattacttctccgagcagctccaagcaagtatccttcaaccaatttctgatgagttcaaaggcaagaaaaaatgagacgaatgcattacattctttacgagtaataaagtaagggcgcagattgaagcaataaatgttttcctagggtgcattcataacataataaatatatatcactggaagaaattctcacatcatcatcatatctgagagactgtaccaactgtggcataaagaaggtaacagtctcaggtgggtaagtctccaggacacgaagaacatatgccataacacggggatgtcctttataaggaggggtaagaaactccaatgcttgtgtaacagagcatggagcccaatgtggaagttgctgtaacaatgatgaattttcatctactgcctttggagtgatgaaaaagggtaatgcttcaggaattgtacggagttccaatatatgtgtctacagggacaagagagcattgtaagacataacagcatatggcacccttcttactgaaagaaaatagcagttgaacaatttacgaaatacacgaaaaaaaatcaaacacaaaacactatcactcagtcagcagatacacctactacctcgactctaacaaaataagccaggagaaaatctgacttttactacactcagatactgtttatttggttacatgagttcaagtggaagttcaagtgttcaacacagtgagagcatccgctagttccaaaattccagtatttaaggtaagacatagcagaaacaaaaaataaacaaacattgcacaacacactgttgtcaaaagaagatttggttctacccttacattctgaaaatatcactaaaaaaaaattaaactggcaatatcggaaagcaatagtatgttacattagctaccgttcttaacaatagactgaattactatttaactctcgtagctgcaccagttgtcatatcattcttcgacttaccagtagacatgcccataggggtaaaatataccgtaatagcaccctaaaattattttaatttttgacacctccaattactgtcctcaatgtggttgcatggttgctttaaggggatttatgatgctatatcttttagattactttataatattcttgaagatggcatcttaatatattctaaatataaacaaatatgccatattgaattaaagttaattgaagaaatgcaccaagagttctcttgctgtagctgaaagcctgaaaacacccctaaagataaacaagaataaatagattttgaaacagaacttgcatgacaaggaaaaatgggtagaaactgttgtctgagaaggtagcagctgaacgcagcaagaaccatacctgtaccaattgtgtaatttctgatgataatgccgagtttgtgggaaacctcataatcattgagaatgcaattcgaggatcaacagcaaaagcagttctggcatgatcaatccatttatctgagctaattttaccacgaaatgttgctgcatctctgccatatataacatgctatacatgtaaatttgaactcaaagcagagtcaagaataaataaaaaaaaatcccgacgatagttactttgtatttatcggttgtgcccacacttcaagtctgtctgcctcattctgagaaagcataagaagtaattgtttacgcttttcccgtacagttgtatagttatccactgagccccagacagggtggttctgatccagctgcaaataaatgaatgaagcgacaaggtgagaaaagttttaaaagtagttagtgaagatggatgagaagtgattttcatggcaattattttaggtcaatgcacacggagggcagcgacagcagcattaggcatcagcatgtgtcagcagactaggcatattcatcccttaggttacctgttagttctctattagttggattcaataatcaactagttatcaggactctcctatgaatcaagccattatccttcagtttaaaccatagaagaacaaactaaatgccatttatctccatctctctccgtctcacttgtgcatcttcccctcttgccaagccctgtttatcttgttctctatctgcctgttactcatctcttctttatctcctcaccatgggttcacggcaccaggccacaacatacttggacctcatccacataccaatgacagtcatcactagtggtctgtactgtaagcagtcaacaagtggcgataaattatacggagtattatggtagctggtactgcgcatgaaaaataccagcatactacatttcctatttccttgaataaataaataagtttcctaacaaaggggttagttaaattagtactctatcaattacttaggaaaattatcagtttaatatgaagttagtctttgagatatggcttgtaagggaagttgaaattgtattcttaagtgtactgttatcacgggaatctcccataaaaggaatgtactcccattgtggtttaagcaatgagacctgaagttgaactaagcccgacaacctctctaccacgtcagcaagaagctttgccagaagctagatgtgaggcaagccctatggccccttacccatggtctttgaaccatacccaaccagctacgccatacaattgatagttatttaggtgggtaagtgcaaagaaacaaaaagggaacaaagatgcaagttgcaccataccatattgggttcaccttcacgtccctgtgacttcggagcagaatcagcagaaccactggggcgctcattttgtagacaatggacaaatattgacacggattgggcctctctctgagcaaaacttttgttttgagattcataccactcaggtgcataagcaaaccatcccaaagcagcactgaaacaaaacatgtactactaaaatatattaacaagtaataacatattatagctggcacaaaaaaaatgaagatgcaagcaaataaagtgtaaagcaaaaatgcatatacatgcattccttcttaatgatatagatgaataaccaaaaaaaatcattggttgatgcatattatcatgcttgacaataagaaattgatttcgagcatccatattctaccttaattttcagtacaacctgtaactcttattttgttttttcctgaagtatcaacatttcttaagtaacaaataattgtacaaatatagttcagaagtatggaaagagagcattgtattaaatatgaaaaatatgtattggagtgattattaccggtataccctgtcctctaataactgaagtcccatattacatttctgcaagttagactgagactggcatgagcaaaatttcagccccaggagcattgcagtgaagaaagtgccagttgcagcaggatggtgagaaaaatgagtagcagatttcattgtcccttgcaacatccgacccagaagtagaagctgctcaatgctatcatgccgaaccacctaagtaaaaaattgttgcagagtaatcgtaagttagacatgttgtctatcctggaggcaaaagtgccttaaaaaccagcctagggttcaatgcactgatcttaaacgttcagggagtaaagtggacagttttgtggtctagggtgttaagtagaggcaaacataaattgtacaagctaggttgcatgcatgccaatatcctagaaaagcagaaagaaattgcatgagatccataaaataaacaaagtgtgattatcacctcaaaccgatcgatgaagaagccaagccagagcctatgggctattattgcttcaactggatccttttctggtggtgcctcaggctcaccagaaatgagatgtggcctcaattttgcatcagggccacagtaattcatatctgacgcaaacagaccacattttgtatctattgtccacagccatgcatcaacaagttctgcaagcacaagaggacctaaggaaggtgctgcagatactagccaggtccagataaatatcccagtctccattgcatcaggagtgcatatataagcaggacaccagcatagaagacgtataagctgagaaaatccatctagatttgctctagagtcagacacctgtgtgttacatcattagcaaatgcaatcataaccaataataaggtattatgaaatatgttcaaacaatttaccatatgatcaagaagtaatgctgtagactgagaacaagtttcacggaacactgtattatctatttgatttttctctgccgtaacaacgaagtcctgaagaagacgaacaaatcttgacagaaaaacttcgtcaaatgattgattgggctgtgcagactgcataccaaggggggacatgcccgtgttcatgcctcccatagaactgaacaaccttctcataccagcaatctcccctgcatggttgcatttaacagttgcagtcactactgcagttgacagcacttccagggtgatgtcaggtgcttcttttttggcccctgatgctgctgcagcagaatccataactgcaggtacattggctgtcctgatgccattccaatcattctttccactacaaatacgtatttcagatagaagtgatacaacatctgctgtatgttgtgatctttgtgctccacttggcttgcaaaaattttcctaagcattacaattaaaacccctatcaatcattatgggacttgggtgaaaataaaacaaatagtataacttttgatgccaacaggaaggtgcctatggaacaaagtttgtgcaataaacaattacagaaagatcagcagttgctgctgtctcagagccttttttaagtcaaccatttaaatgtgtgtatcatttgaccactggatgacaacgatggacatgctttcattaatatatgttatgaatatgagcctactggccagtgacgcagtcgttacaaacttacaacagtagacactcctagaggattttttttttcggtaatttctttctggtggtacaactgaatggttagtttataccatactgactctcattagtattcccgtataaaaaactgctaatcagacatttaaatcctttcaagtttggttgggaactctgaagaacctatgactactatgcaaaaatctaatggaagttaaaaataacctatgagatagcaatctcaatcttaaccggacaagcgaagcgataggtatatcattaacatgacaataaccatctactaacaagaaatgcatcaccataatcatctttagtattcctgtagaaaaactgccaatcagacatttaaatcttttcaagtttggttgtgaactctgaagaacctgtgaccactgtgcaaacatctaatcgaagttaaaaagaacctatgagatagcaatctcaatcttaatcagacaagcgaaataggcaaccttatcattgacaggacaataaccatctactaacaagaaatgcatcatcatacaacaatgctactagacaaaataagacaaaataatattatatttgctaaacctgtataaggccttgagttgtacatggagcatatgaaagagcactcgttatccattccctggcaatcttctgatatagtgagcgtacagtggcaacccaagcaggatcgctaactggaccagaagtcaactcattatgaacagatattagaagtaaatctacacatgatgagttccagaggacctgaaaatttagtatactaggtgtcagtgtctcaaatcaataaaaaataacacatgagacaccaaatcaagcagccaagcaaacctgtggaaacttttcctttagctgagttaacagcttgacactcacatcacgaacattttcatccctctgtgacatgctctttataaggaagcaagcatgaacagaaataacagattcccttatatcagctccttctcctatgtcacatatacgatcctcctgggcacaaaaagggtaattgttccagtgcacatctacaagttagaagtttatcatgtgctctagaaaaataagacaatacaaacaataatcaccaaactgactacaatgcaaagtcaaaaaaaaaaaggatgatgaagtaactcgagattacacaaaacagaatttaaagcactcctaaagtatgaaataagatgcaaagcagattccaattattggacataaaattgctattgttggttgatgcttcattaatattgctcaggggaaaacaaaaacatcccaccatcaatgcatgaggcctttccttgtgggagacaatatctttatttgcagatcaagaaagcagctgtttgtacacttctaatgaatatatgttcgctacaatttatagcttactcaacaatagtcctatgtacaaacaggcatatctgaagcaaaaggagatattagtgctgccataagagatcaaggctgcaaaacaatggaaagaatgtgtggttcatcacaataggaagttgtgtatcttttttacacaaggagttgaattaacaaaaaagggaactattgtagagataatggactacagtactacatagctaaacaccataatgaaaggacaaaaaaatacatgacttatatcctcaaaaaattgatgaagtgtgagttgtaccatccatgacaacactgtttcaaaagctctatgcacaactgcagtcaaacactgagatactgctggtgtcaagttcggggttagcaggtattcgaacacacaactgaatgcactatttgatttattcaatgtagaggtggctgaaagtatgccgccattgcagctaaagcgcaatatctcaaggaaagcaactgcgaggagatatgtagctttaacccctgaaaataaagcaaaaagaaaatcagtttcatacttaaagaattcaatttatctaatgtaacatttcataaagaaagccactggtatgtgagtccaataatccagttaagttaaacttctaatgatgaaaatgaaaattgaacatttttctcataatctcatccttctctcttcaaaaactgcagattctagcttttacaaattaatccttgcacaaggccaaaaagaactaccgccagtcacaaatacatgtcggcttgggcatagatgcactcaaacttttaacttttgagtatcaatgtctttttaaatatttaggttgatatatgaagatcttacatgtaaatctctcgataaaaactttcataaaattagcattttctggtaagtggactaggcactattatgtagacatgcacaagacattttgctagtggactgtccagatgattgtgaattttaaggacctaaatgcaattctacattaattttactatattggaggttaatattttatttgtgcgagacaaaataaacaaatgcataagcagcgaatgactcgacagagaataaatgttgacctgaaattgtagtcattgctgctacctcaactcgacttcctaaagccgcagaaagtgcagttctctgtccaacagcagccttttcattactattgccacggcgactacctgggttatggagagcatttaactctagctcatcttcaagccatttcactgaactgacaacctgaaatgagaaaagcaaacatggtagatacaaggtattaaagaaagtaagacagccaaccgtcagcataggatgatcaacagggggttaagaatcctaactgttaacttctccatgaaaggagagacaaacatatgtgaatgactgaggacagtagttatcagactattctaatccattgttatgtaaaacatcaataggctttaaaactaataacactcaataatatgttataagtacctcttcaataataagatatgctctctagtaccaggaaatgaatgaaaacaagtttgaatttacttattgcataagaaacgatctgttttccatccctatggacccaaacaacctaccagtggtggagttccttgtgcaatacgttgcactgctacacaccattcgctattccacatgtagggtccagaaacagcctgaagagctatagcactgatgctctccatagtgttcaatgaagtggaaactggttttgcaggtgtctgattgctttgtattggaggagctagtccaaacaagacaatgtagaaccacaaattacggaacaatttcaataatgatggctcaacagttgaaactgggtcaaaatcagaacatatttcagcaactgcaggaagtaatggacccatcaaatcagcaccactcctgcagtaaaggaaatattatgttaagcacacagtactgcagttaattagttaagacataaaaatacatcattcaagtttgaacatcaaaactcatgaaatcgatatatatcaacaatatggcaagttacctcccacttttagactcagcagctaagcccacatctgagcatagagataatagcctatgacggtaatcagacctgagttttgtgctggtgagattagtagcaacaagcaaaaaccctgcaggaagagtctagaattttgtagacacagttagcatggaaattggaacacaagttgtaaaataagtttcttatgtagtacacacctctattctctcagttgttgcttctgatggcactgtgttgttttctgcagatcctacagctttagccttatcgagatagcttcttgtcatcaagacaatgctctcacgatatgacttttcaaaacccaagcatgccacacgagatattgcatctaacaactgcagtagagtacaaaaagggtgcttttgtttaagagtcacaagcaatgccactaaatttgaacacaggtaagagcaagagatatggaacaaaaataaatatggtagtgggtacaatacagaagttccatacccgaagtcgcaataaacttggagatgaagcatcaccctcttctaaatgttcaatgaaaagaggcaaaatcatgtctacaacttcccattttttcaagcatacacataactcagcaagaaggcggataacattaagtcgcatcaccggaactgcgtctttttctttgccatcctgaaaggattcacggtcaagaaaacgaccagcaattaaaatctaattaaaaaaatattgtctttgtatgcaggcaggcaaaagcaagtttaacttgaacattagcatatattcataaacaactagaattccgcaagaaaatgatgccagcatatttgtagccagaaatgctctctgataatcaaactccatttttttttactacaataaaataaaaggatgttaacagtcagaattttattttggagaatgtgaaaaggaaaagaaacactccgattttaacctgaatctctggtttcacagtataatcatgagtttaccacagcatcatggatgaaaattgcttatagaaagaccaagctaatcttctcttacacccttacagccttactcatatgaaattaaaaagcaaacctataaggctaccaatgatgcatcatggtgtatgaactatttggctttttaatgaaagctgggcgtaaagccttttctctaaaaatgatgcatcatggtaacttagcatgttgaaagactgctgaagtgacaattgttggaataattggggcatgttccattcaacaattgtaaggtagataataactgcttttatgttgaagctttttcagtgtggtggcaactgtactaactatcaagtaccagtatatattaaaaaaacttagctataactttcatacgttaactggcagttatttttttaaaaaaaacagtaacagtgttttcataaaacatgcatgaataacacatagtgagattgctcatataatgcttattaacatatggtacaacatgttcatctagtgcccagcataatgacacttgtgttgtagcaaatcttatttaactagaaaatttccaaa

SEQ ID NO: 4401 - DNA, 1755 bp, Oryza sativa
tgtatgaactatttggctttttaatgaaagctgggcgtaaagccttttctctaaaaatgatgcatcatggtaacttagcatgttgaaagactgctgaagtgacaattgttggaataattggggcatgttccattcaacaattgtaaggtagataataactgcttttatgttgaagctttttcagtgtggtggcaactgtactaactatcaagtaccagtatatattaaaaaaacttagctataactttcatacgttaactggcagttatttttttaaaaaaaacagtaacagtgttttcataaaacatgcatgaataacacatagtgagattgctcatataatgcttattaacatatggtacaacatgttcatctagtgcccagcataatgacacttgtgttgtagcaaatcttatttaactagaaaatttccaaaaggataaaggaatacctcctcctcataatcatttcgttcacggacatatgcagctaaccgcataatgaatgtgtcgaccagagccctatcctttgtccagccaaactctataatttcacagctcaacttaaccactgcatcgaacaaagccccagggctactacctgtcatgtcagcctataccaacgtggccggtttcacatcagaaagcatctctataaacacataaatttcaggagtccaagcgacagtggtgcaaaagaacatgcctgggaacaagtgctgacgacgagaggtttcaaagggatcagcagcactggcaggagttggccccctcgtgagacagttatctggctgataccattgagcagcgtgcaaaatagctcctcgcagatcttcagtttgcgccaggatgagaggatgcatgacttagtggcctcgataaaccaagctagagtctgctggagcatatccttggaagccttgctatcaacatccatggcagaaacgctccgaaccagcaccactaccgcagcctggcaacagagtaatttggtatttatccttgtctttagctgtgccccctgctctctccagtcccgtttcctaatctgcggagtgcaaaccatcacatcaatcatgaagtaacagcaagtaagcatacatgatacacccaactcgccagcatgtacacggcgaatgcaaatgcaggaacctccgttgtgcacatgaaccgcgaagggtcatccacattctagtctcaccttcaggaattcggagagcgaccggacctgctttgcggcggcattcctgaccttggcaacattatcggactccagaccaccctcgccccccaacacatgcacgatgagcctgaaggcgacctccttccgctccagctcctccacctcctcctcctcgaacttttgcaccacctccctgacccctccattttcctctcccgccgcgtactcccccttccccttggccttgggcggcgcctcctcagagcccgcgaactcgaggagcagccgggaggcgacgggcgcggcatccgcggggaggagcgtcggtgggctggccgccgcggcggaaaggaacgcgcgggcgaggggcgcggacgccgggtcagcgacgtcgagcgcggcgaggagcgccgcggagagcgccgacgagagcgccgggcaggtcggccccgcggcgagcaaggggaggagcctggagaggaagggcgccggggcgaacgactgcggccagaacgacggccagaggaaggcgttggaggcgaggaacgccaggagcggcgcgggcagggagga

SEQ ID NO: 4402 - DNA, 2468 bp, Oryza sativa
ctccccgtcctttttccgacgcgagagtaattcgcggagccagagggggggagaggacaaaggtgagggtaatttgggtgagtaatttattttattttgtttaattttcttttggttgactctactccgcggaatgttgggacagggtgagaggggccgagggccgcgagagacaagcaggcaaggccaacgtgcaaatgccgggttttctctggagccagactggttgcctgtttgccctcggtgaaaacgggacatttaggctttgtttagttcgcgaaatgtaaatttttaagtttcacgtcggacgtttgaccgaatgtcggaagaagttttcggacacgaatgaaaaaactaatttcatagctcgtccttctcctctcgaaattgcttttttccttttcttattcttcctttcctttcgaccatcttactttgaatccggttggagcttttctagagagggaagaagagaagttgtgtgctccctacaaaacccgttagacccactcatgatagatcaccttaccttcgaaggcagccaaacatgccttctcgtttcactaaacaggcctctcaatccgttttgacggtggtacccattctgctagtgcgaaagttgttcccgtttcttcgtgatccgatccggtatcagcggatactttaattttaccgggaagggttgaaacagcgcacttcgaaagatgatggtgtattctgaggatcagtccgttttttattgaattcgcaaattgatagatctggatgattcaaagaatgattcttccctgggcccggtaccattatttaaattggagcttttcaattccattttggagattgagggttcgattctacctcagaacgatcttcatgaaagtgaaaaatcttcgtcttaccaaaaccggatcttaaaaagtgttcagtgcccaacaagcaacgggggcccctttgtttctgtatgaatctcttaccgcacaaaatctccatagccaattttacaaattagatttttaaatcagaggcagcttttggtactatggcatggagcaagaaaatggattgaagcagagagccagcacaccttagtgaatatcattatttaggacaagcacgaagaggaagagctttgtccttcggccttgaatcagcataaagcccctcgccgagccacttctttgacaatacatcatgatgaatagggttcgactcattcatgtctccacacccaggttgtgccgcagccgcccttctgcccgcagccctattctataaatttggctggctacgttacttataatcgcagaacgagcaatgaatccccaacgacaaacgaacaaggggcgaggcattttcggggagtagccgcgaatccgagtaaggtctaaaggcatcagattgaggaaggaaatagagaatgttttcatagaagctttctttttcataggtcaactctgagatgaggtatgctgaaatcgcaagacgaatttattaagcctaattaatctgtcattagcacatgtgggttactgtagcacttatggctaatcgtagactaattatactcataagatacgtctcgtgatttccatgcaaactatgcaattatttttttatttatatttaatacttcatgcatgtgtcaaagattcaatataatgtttttggaaaaaaaataggaactaaacaaggccttaactatttgcaattttaaatttaatgtttaatcatttgtcacacacgtgttgatatatgaggacgagtctacggctcgggcacccgattggtttggaaaaaaatcgggcgctgacgtcagcgtatgatttacgtgcaaaactattttaaactgatttttctcttaaattacttatccaaatcatgatccgattgcaccattaaatttattgcaattaaatcttcaaaacaagaccatacatggatatatttcgacgggaaaaaaatagtttattattgaattatttttaaatgttgcacgatgttccaccagatatatcggaatgtttcactcatttaaattgggtgttgtttcaccttatataaaaacaatgtttcagcaaatagcgaaagaatgtttcagtttactacaacatttgatccatacatagtgaaatattataagtacacaagatgaaatatttttcggtggaacaaaaaataaataaattgaattcccttaatagggggtttcaaaatatgtaggttttttttgttgcaatggagtatttcagtttactgtaacattagacctatacattgtgaaacattgtgagtatactaggtgaaacattttttatgaaacaaaaaataaaccaaatttccttaatagagggtttctaaaatatgtaggtgatttgttgcaatggagttgcgtgtgtggataagtggccggtggggacaggggatatgtggtggggacccaggtgcgcacgtgatggggggagggggaa

SEQ ID NO: 4403 - DNA, 6600 bp, Oryza sativa
tttatactgcagattttgtttgaacatatataaaatctatacgtgagttgtaaagcagatcttgctcgtttccttgtagtatcatcgatgtcttagatagagcaattgttccaagtaatttcagtagatcctttgaaccttaaaaatcgatcggtagatcttctttactcctattgcatataagaggaagccaaagcaacaaagctcgttctcatcgatttaaacttgggtttcaactttgaaaaggctgatctcttggcgttgatgccaccattctgcgtgtattgtatgccgtcttacctctccattaactggtgtatactgtgtataatacataattacacacataaacacatcaactgctgtaagcctgtaattgcagtaagcttccttacggaaaatatgcagtaacttacagcaatttccgttgacaagagattcactcaccatgaatggatgagtcttaagtaaaatctaatataggatggtgctggccacatcttccaacccaccatagttcaactaaaactaaaataaactaaatctcacttttaagggtacccgcagatcagcctgcacccatctgtactcggtgctcatgaattgctaacaccgactacagccttcacaaagaattttgcactatattttctatgaatggttgctatactggattcaacaaccaaatgaaaaaagcttacatgttgcagcagccaaaattgatctacagaaaaatggaaacaggggctccctcggttaggcaacaaaacttgcagaggtggtgaggcgagcaaccaacaggtcaatcggtaaagggaggaagaacacaaaaaagagtaacacggtttgtcgatcatctcactttctttgtttagccacactcatcgcctatctacagtaaaccatcggatgataaactgtgaacaagcctttgctattgtacttctcccttaagatcatctctctttcttcggccaaacccacatctacagaagtattcaacaactggcccctggtccccagcaacccaaggatgctcacctacagcctgcagggtgatacgatttgctggatctgcaagacaaccacatgtggaaacacaagagaatgttcattagtagaataatatatctggcactaagacacaaaatgtgccagaatcataaggcggtgaaacagtttattttgaaaaaagaacctttgcagagaagcctttccagcaaatcagcaagttgggggttcatgttgtcaggtatttgcaccggatcattgacaatctattccacagcaatgtcttgaatgagttgaatgaaaaggtaaagcaaaaggaaatggaaggggggtatttttgtaccttatcataagtttcctgtaaggtatctcctagaaatggatagtgaccagtaatcatacaatacagagtaacgccaactgcccatgtatcagctgcccgaccatggtaggctgaacctgaagtgaattagattgaaaggttggtcatatttagccagcctgcaccaatggccaaagactatatgtcgcaatttgagccaacggcaaaagagtcatggtctttgccctctttagtttttaatcattggcataacattcatagccatgctttggccgcttaaagttgcagtatctaagtaattcgtttatgtcatattctaaatctaaattgcatatttatgttggactcattccgtttgcagttgggtgttctgtcgagaacagattactttatctgctattctgcaatcaagtaaaaggggaacatctacagctgctgtctatctagcaattgttgaacttcatacacataatttggtgactaactgattctgcacgcagtaaatactagtactcaaatataaaaggtaggcagttgtaccttgacagcattctggtgcagtgaaaacaggagtacctggagacctccaaagcagatcatcatcatcctgcaatacaatcacataacactttatcagtaaagtactaagccattagactccacaattgtacgaagaaattgcctaaaaacacttactccctccgtcccataatataagaagttttagagttagacacggttattaagaaagtaggtagaaatgaatggtggagggttgcgattggatgagtagtggaggtaggtgggaaaagtgaatggtggagggttgtgattggttgggaagagaatgttggtggagaagttgttatattttgggacaaatcctgagggctaaaagttgttatattttgggacggagggagtacatgttaataggcatttctacattagcacacaataaaaaagatcatgtatcaagttaaagataatcaaatgtggtatgaaaccatcctgttttactatataaagtcatgggcctgcttaactaaaaaaggtggcatgcaatcatctacttgagtaatcttaaaaatattcaggatggaaggaaatgaacaatatcttttgaggtttttgaattaaaaaatgcttgtcttagaaattgagccccaaaattgcatttttgatacagtctacagtctaaatcatgatgcacacaattttctggggatccattcaactgaaagccctttatgccatgacaaggaaaatagcattcattactacaatacagaggttagaggataaaggcccacctcaaaaatctgactaacactgaaatcccctatcttcacactgccagtgcttgtgaccaacaaattgtctggtttgatatcaccatgaataatattctgcgtataatgacaggaagcattcagtgacatgatgagttaggaagcacataacacagtgcagactgcataacgtagataaatgtgtgactagagcaacatgtatctgattataatatagaagtatgtacaaattggggaaatagaaacatcaacaaggaccaacttaagaagtaatgaattgccagatgttaaggaatcaagtaacatgttaccaagatacattatgcacataagagcatggataaattaagatttcttatatgcatatcactgtcctaatcagtgttctaaaagtcgtctctaggcgccgggtagccgccgccattaggcattcgatggtgtattaggcagctgagctaacttggctagtgttttttttttttttgctattttagtgttatatagtctaatttctatgcaatatgcgtgctatttttttggatttgactagttgacctgacctaggcgccgccttggcgccaattaggcactaggcgccccccagccacccaactagcgcctagtgctttcttgaaccatggtcctaatgattgaagtttaactagtatcatatttctagctaaatttaaccatggtcctaatgaactcaatttccaatacaatcaaacaatggataagagaagaaatgtgtgtgtaggcacaaataatcctaatctagaactaaaatgggatttaatattttctttatgaaaccataaccattcaaatagtaccacttagctgggcccaaaaaagttggcatatgcaaatgcaataattacctcaaagacagaaagttaagtagctaaaggaacaaggaaagtaacatgcaattagaacttcagcctacaagcatagactaagactatagtacaaataacgataacttaacagtggatctcaacctctgctcaacctggtcaccgatttaaccaagtttaagcaagacttttttagaaaatgtggaagttaaaatatgttgcttgcattaatctgcacaatacaaacttgaagctgcttaaatatatttgtacagagaaactatcattatatgaccagttgatatgactgctagtggaacacactggcaaatttgaatttcctttgatatgaccagttgatatgactgctagtggatcaaactattcatggtaccatgaatagtttgatccatatacaattggtgtttataggctgtagattctgatatatggcatggcgttcaccacaatttaacagatcttttagtgaaggaaatttgaatcttacatgagaatgaagatacataacaccagagattatgtcgcgcaagtaatttctggaggtagcttctcctaaaccattgtcacagaccatttttccttcaacatactcaagaactggcaataccaatggacaatgttaggtagaataatatggagaattaaataaagatgctcaaaagttagcaagaaaaatctcatgctacaattaaacaaaaggaaactattttttttaaaaaaaatgagaatgtcattacatacccatgtagaatttatctgcatttgggtcatcaatcacttcaatgagatttactatattaggatgatccaacattttcatgatggatacctgtcaccaatacaaaaggtgatgctgtcagataattgagacgttaaacagtacatagagattctttaagcaagcaaagtttattccagttattttattgtgttcatgtcctgaacagagcaaaatcagtgagcacactcaacttgtatcaactcaacttgggtattgggctcagggccaaggccctaggccaaggaggaggaagaggtgcacatggacatgtccagtatcgcatggttattgttcacatgggtgtatagaatagattgatttgctagctatttataaaatcttagagataaactccttcaaggtcaagccatcctatttaaataaggatgggctgtatgtccattcgttaatagtctctccctaatgttcatcatctaagtctaagttctctcctcatctgcagcaaccatcgccgccccagctatcctctggtggtgtttacccaccatgatttcggaccatgacaacttggttactatgtatgtggttggcccgatagtgtcagtgttatggtagcgatgcatcctcaaagtgcacacaaccaaggttatcataccaagcccagcccaatagtttgaccaaaaaggacctgaagtgagcctcccggtagactgtttttccttagacaattctataatcatccatttcgatcaggagaaaccatgtttgaactggctagtttaagagtgaacaagtcaacatgagccagacgataaacccagcttaagaaatagccaaaaataatgcacaatgcattgtgcatgaactaagtgggcttgttggtttgttatttattgtactgagaaacttatgtaagtccatattgagtgcaagagctatgctaattatatcaccacatttacatattacccatttaaatagaatgtgcagacactgacccaaatcctaactgggtcaagggctgaatgggcagcactacttttccagagcacttaagtcgtgtcatgacaaaaaagaaaaaaaaacatgtattacaatcacaagtaaactgagaaagttactcacttcccgaagaacatctgtcatggcagtttctgatcgcacaacacgtactttcatcatgtaagatttattcaaaacctacaatagaagggcaaaggctacagttccatcagttagatgcagacactgtgcacgcaacataaatttaaccttgtaaccataagaataatggtgctgaacgagtaaaaccaactactcagactagcagctagttattaatgagttcagatgcaagaaataaaaattagtaactaacataaagaaatcagcacataaggacagcgaaaaaccctaccttcactgcgtaaagctttccatctttcatgcttcggtataagacctttaagccaaaaaaaaaaagatttagacatttaccgtgggaagtcacttcataacataatgtgagctatcttaccactttgccatagcttccagaaccaatcttccccaggtggacatattggttgaccatcttgctgccattttcatcctaaatgtgccgaaaggaaaaaagttattgtactgtttaatgcaaaaaggtaatagatcgcatacagctttatggatttgcaaaggtcacgacaacactgattgaaacagtagatcatctgagcatggcgccttaaacaattaaagtttacatcttatacgtataatgcaaaagatgttttaaccgatcatttataacacagttataattttctataataagttaaacaatgttactctactaaataatataacgacaaggatagattaattaccaatcattccaaaatcgtatactacatagcaacaaccaaataatctagactttccatgattggttagtgggcttcaggttgtcactttcctagcaggaggtcccacattctaatcctagcagacgcacaaaattaggacaaatggcagttattctacaaggatggattaattattaattgttccaaaaggaaagtggcataatgtgcggcattagcattgatgttgtcgtagaagatgccacgttcaaaacctagcagaggcgccaaaatttgcattcctgcatgatggagattcaatcactcgaacaagactgaactacgacatttacctatttcgcagtctaaccgctgagctaaccttgtctttaatacaatggtccatgtgtgacagtttctcatgcacgggctagcttgtaaaagaagt

SEQ ID NO: 4404 - DNA, 570 bp, Oryza sativa
  unsure (1)..(570): unsure at all n locations
nnnnnnnnnnnnnnnnnnnnnnnnnnnnnnnnnnnnnnnnnnnnnnnnnnnnnnnnaccacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactaggctgatccaacagggtcggtgctgtggccgctaccccgatttggcgcagctaccgtcgcccgtcatgggtaagcgtcgtcgaatcgcgcctccgtccactagctccccctatctgcctctagccctctaccaagaaacaccatcgttgtaaccttcgccaagccaccgtgtgtgcgggtcatggggtgggttgggagggaaagatggagagagagaggaagaagtacatagattgacatgtggaacccact

SEQ ID NO: 4405 - DNA, 614 bp, Oryza sativa
caaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtag

SEQ ID NO: 4406 - DNA, 734 bp, Oryza sativa
  unsure (1)..(734): unsure at all n locations
nnnnnnnnnnnnnnnnnnnnnnnnnnnnnnnnnnnnnnnnnnnnnnnncatggtcagggtaaccgaggaggtcgccggagaaactcgaacgtcgccggacaggtggcagacgattggccttgcataagggaagccttcatctttactcttatcatcacaacttatcttactcttaggctttggaacttcactctctgaaactgctggaacagaagggaaaaaaattcagagatagaattggccagtatacttctatggctgattttactggggatttaatcatgtactaggaactattgagtgtatcaagaaatctctgaaactgctggaaaagaggggggaaaacagaaatgaatttggccagttttctatgctgattttactgagaaattaattaactaggcataaaataagtgcatcaagaaatcttttgtattattgttggtaactctaacctgtctgtggtgattttgtcaaagattctttctttccaggagggggatcattctctgtagagattgcaacctgtctctctgatcttgatttattctctgaatctgtcccattcttaaaattttcatttttaaacacggaacctgcagagcattttgaatttgtaaagatttttttaaataaaatacaacctctccctcacctcaactaaaaaacaatgcaagaatcctttattggcaccctaatcattaactgaaagaaaatttagcagattgtcacta

SEQ ID NO: 4407 - DNA, 422 bp, Oryza sativa
tttaccaagttcccggcacataattcctatacatgacatgccctttggggaatataaattctattaattaattttacagcctgtgccaccatttcaattatttttgtaccttttatgcttccaatattgagatggattagttgtaatggtactttgcaactgttcccctatcagttaccctgtgaaaagctttgcctatgtactgactatttcaagattgtatcatcacacaattctcagggtctccttactgctaaacatgattatgcactgataatttttttcctgtagttgtgctgatgtgattggtgattgatgactataatgtattgttatgttttataggtcacagaggaaattcaagaaacaagatttaacactgcaatttctgcaatgatggaatttgtgaatgctgcatacaa

SEQ ID NO: 4408 - DNA, 970 bp, Oryza sativa
  unsure (1)..(970): unsure at all n locations
nnnnnnnnnnnnnnnnnnnnnnnnnnnnnnnnnnnnnnnnnnnnnnnnnnnnnnnttagttaattgttacagacttacatgtaagagtgaaaaatagtttaaatattccggtgaaaactggtaaaagcagacagtagctacgatattttcgtagcattttttctagtttacaattacattgttcatggctcttcattcgcaacacacatctataattatatctgcttgacatatgtctaaataaacgaaagccagcagtaaatccttaaccgtatatgtaattatggatttgttgataaatttatactgcagattttgtttgaacatatataaaatctatacgtgagttgtaaagcagatcttgctcgtttccttgtagtatcatcgatgtcttagatagagcaattgttccaagtaatttcagtagatcctttgaaccttaaaaatcgatcggtagatcttctttactcctattgcatataagaggaagccaaagcaacaaagctcgttctcatcgatttaaacttgggtttcaactttgaaaaggctgatctcttggcgttgatgccaccattctgcgtgtattgtatgccgtcttacctctccattaactggtgtatactgtgtataatacataattacacacataaacacatcaactgctgtaagcctgtaattgcagtaagcttccttacggaaaatatgcagtaacttacagcaatttccgttgacaagagattcactcaccatgaatggatgagtcttaagtaaaatctaatataggatggtgctggccacatcttccaacccaccatagttcaactaaaactaaaataaactaaatctcacttttaagggtacccgcagatcagcctgcacccatctgtactcggtgctcatgaattgctaacaccgactacaggctttacaaaaaaatttgcactatattttcttatgaatgggtgctata

SEQ ID NO: 4409 - DNA, 639 bp, Oryza sativa
tgactggacactacccctcttcttaagtgttgaagaattataattcaagctttggcatagataaaactagggtcagatttaaatcataatgtttaattgacagtcatcttcattttgttttggcagaatgctgaagcagcaggcaaggttggagcaagcgccaagggcaagcgtaagcggatgagcagcaggcaagctggtaggagcaagtgccaagggcaagcgtaagcggatcgaggagtgctgaatggtactccctcagttaaaaaaaaaaaacaatcctgagtatgaacctggacacgtgtgtgggctcatacccaggatttgttcttttctttttaggacggagagagtagtatatttctgttgcttatcatgtgcgcctagcatgtcgcttttttggcttacatcctgtgagatgtaatgttagcatgtgtttggtttcgggactaagtgggatgggatgaaaccatccctgattttggagttgggatgattccactcacatgtttggtttgtaggatgggacaattctaattttttgtttggttgaaaggatgagggagaaatgggatggacgccgtttgccatcaccgtcaacgaccgtcgcttgcgccacctgcatccacgcgtggaaca

SEQ ID NO: 4410 - DNA, 637 bp, Oryza sativa
  unsure (1)..(637): unsure at all n locations
nnnnnnnnnnnnnnnnnnnnnnnnnnnnnnnnnnnnnnnnnnnnnnnnnnnnnnnctgccgacgggggcggtgctgatccaggtggtgccgtacgggaagatggagcacatcgggaaggtggacttcggcgatccggcggaggacatgaggctcaagtacatggcgtactccgccggcgtggaggagagcacgctggtggagacgctggggcgcgaccacccggcggtgcgcgacccggagtcggtccaccggagcgggtgggggaaggtcgccgagtactacctcggcaagcaggacatccgcctcgatctcgcccgcttcgagcccctcctccgcgacgccatggattacctcaaacaccagtagaggcgagctccatccacaaagactactgtaattagctactagctgcaacatttttttttttttgaatgcctagctgcaacattttcattttcgttctctatgcttttttttttttgctttctattctttcgagttctttcacagaaaaaagaaatcgatcgattatttgatcaggattacagttacattatactacttctctttgtattccctttgatgcacataatggaggatggaatggaacgaaatcgattcattattagcactgaa

SEQ ID NO: 4411 - DNA, 614 bp, Oryza sativa
catgttcatctgctggcaattaggcaaaagaacattttcttgcagattgctatgtaaggtgagtggtttatatatgatcagtattgaaattctcaaatgtactccctccttatggttttccatcttgaaggggagcaattttcttggatgaacagtttttaagttttataaccacagctgtacagatttgttggcagatatgcagagagatagagagagagtggcgtacaccaaccactggctggtctcgtccccgtgaacaacggtctgaatgtatagaggctagcttttcagtttgtcagggagggaggggagaaggtaaggtactagtaaaatgtagggataggataggatgatggtagtaggaaggaagatgcatttggaattttgctctcgtcttgtataccgatgcagcagcaacagtatcatccagcatctcacatgcgcccatagaacacaccttcttcaaatcaaatacagcggcggctttcagcaagcttgtgattgtgaacatggaagagaatagtaaagtaggagtacaaatgaagagagaagcttccgtataatactcactacttcctccgttttacttcaattttttcaaagtcaaattt

SEQ ID NO: 4412 - DNA, 1071 bp, Oryza sativa
aggtcaggagctagttactaattgagtaattgtgaagcatgtttcttgcattcagcttgttcggtaattactacttctgtgaaagtatgataaattgaagaaaacaaaaggaattcataataaaatcaaatccatagtttgtagtaataatatatggaaggacaaatgaataaaaacacaaatatgcaagcgtttatccatggaaaatggtaatagaaaagtttaaggccttgtagcagtattaccattcattctccatagcttcacttgtcggtcatctgccccggaaacaatgagtggcaatgtggggtgaaatgatgcccagttcaccccacggtcatgcccttccaacacatattttacaactgcatcaacacctccaaacagatctgtgttcatctgggtgagacgcaggatgtcatctgcaggtgacaccgtcttcttcctcaaagcaccaatatcccaaacacggacagtctgatccagtgatgctgacacaaccaggtcctccttgggatggaatgatgcgcacatgacatagtggttatgtccagtcagcacagctacacatgtgcgtgactgccagttccagatccggattgtctggtcatcactagcacttactatccatgggtattcgtggtggaattgcacggtgcgaatatagtcaaggtgcccgtgaagtgtgaagaggcagcggtgtgtcttgtaattccacaccttaatcttgtaatcatcacctgcaatgcatcacagaaatcttagaatagttcagaagttcaaccattccgcatcccaatcatattagtccaccgagcaatacgaccggacaccagtatgacttcgtttcaagtttcaacagatcccaaagtccaggtttcaacaaattccaaaggtccatgatggcaccttgccatcgctaacttgctacttgtatcagattcacactacaaaagctgattctctctggttgagggctacacatcgactcattctacttcctatcatatctcttctacggaaggattgcaaaatcgatggagatcccggtcataaatagaaacaaaatgt

SEQ ID NO: 4413 - DNA, 3735 bp, Oryza sativa
gtatctacctcgagtgtcctcattgcaccatgaaatggatcacgcggaaatctaacggccacgcgagacgtcctccaaatccgaggaggaggatccgaccaaacacgcgtcgacgccacacccgaccccgcgagcggcgaaccaccacagcgaaaaaaaaaatgctcgaggcgggcgagatctaggcagggaggaatcgatgtttacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttctctagccgtccccccggcgcgacggcggcggcggcggcgaaacccctcgccgctgaggcgcgcggaggagagagaggggggagggggggtggtatggcgttgggtggagaggacgaaggtgtttttgagatctcggggtgggaggaggaagaagtggggggagagatctgggtttcggacgcggtggtgaggtggtgggaggcttggccaccgttggattctggagacggggagatctgggccgttggttccggtgtggccgtgttgtcagattggggtagacttgtttaggggtgagtcagcttggtccgtaaggtacctgatgaatactgtagcttcagtacgaaggcagcgtttttgacttgtcagtagcagtagagaaaaaaaaaagtttagggccatttgaatcgcatggttgaaagaaatgtaggaatataaaaaagacaggattctgataagaattgaagtgtaaaacagaggattgcaatatacatgaatggtcgtttgattagagcgcagaaaaaaaacgcatgaatcgaatgagagagatagactcaaaggacattttctaagaggttggagctcttgctaaaattttcctctaaaatccacatgcaatgtgtcattccataggaatttcataggttttggaaagcttcaatcatttgaatcaaagtaccaaatagaaaaatttcctataggatttgaatcctatgaaatttctacataaatcctttgtttcaagaggccttaccttttgtagttatgtcatttatatttaaaaaacaggatatatcatataaaaaattataaccatgctagtagaaaaaaggaatttataaggctggttataaccatggtttatacttatgctagtagaacaaagagtttccatgtcttaaaatgtcacaacagatgcaagcaaacaagcacaaccataatacttgccgattttggcaggtacagtagtataggaatgagcgttggttactgcaattgtttctccgatgaatcaataagtgcattatcgattggaataagataacttaatggacgatccttcccgagtcttcatcaacaaccaagagaaaacgatagacatcagaaaaggttaaaggtggtaaacaacataattccataaatggaaggggacaaaagacctagacagtatatcactatattagatctaatcttgtaaatactttatttgaaaaacaaatctaaaatattcctaaaataaaatagaagggcctcctcaccatcgacaagggtgctaaagacagtagggaagggaagggggactagatgggttgtgaggacgaaagccttcatgaattaaattggtgattcatggtacgctctcgctatgacatattccagtttaccatccaaatctatataatactttatctatagatatatccacctagtttatttgctataaaaaatctagcacatgaagtttaaagtgcatctaggctctaattcaatttcagtaatcaatgactagcgattagagatgactaacacctttgcatataactctttgggcctacatgtcatgtcagtggctagatattatggaacttggtccctaagctttctaaaaatcttgaataggtccttatcttcaaccacaaataagaggagtgtaataagtggcgcgctcagccaagagccaaggcatgcccaggggacctccgtggtcccttcgggtgcagtaggcacatcatagagtggctagaggacgacgggcgacgagctcctgaaaagccgtggccatgatgcttatggtggtgggtaggcagtgctcgggtggtagaacggcaatagctctagcaactacatgcatagggaatagggaaaccgtaagcaggctagggattttctcacttagaagggcttttcccgcacttagtgatggcgggaggtagcagtggtgcttcggcaagatatgaacaatgttggtaggcgcggctattcgggaaggggaaaacgagatcagtgcaacatggggaaaaaggtgatgcacatggttgaaaggtgatctcaccgaggacgttgcgataggctcttgtgcttaccagcaccaatgatggctcctttattcctgacaagagagagagccatgagctccctcaagttggaatagaatggggcgagttgaggaaaaggagtgcaacaggaaggtttatgcgagggttgcaagctcatttcatggcattactctaatatggcgacctcaagccgtgtggtgatggaacgggattgtcgggggtaccgtggtatcagggaggagccaggaggattgatagcttgaaatctttggtcagcattgaaagatttggtcggtttgacttagtcggcacaagagggaccgtatacgttcaacgattagcgagaaagaaatagagtaaattccctgtgtacccctgaaaactcactcaatccctttcatactcctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaaatgttgtgaacattggtatacctatctttatatgaatgctcctcatttttatgacctttttttaaaaaaattaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctcaaagaaatatggtgagagatgagtgttcaaaggcgagtaaaaaaaattctacaaccacattgcataataaaaaaaatcaaataataatttcatataactagactagaacaaagcttaagaggtgaaagg

SEQ ID NO: 4414 - DNA, 5806 bp, Oryza sativa
tcgatgatgaacaaattgaatgaagttaaatttctatttcaatggtagaatttaataagtttctaatccatgttaagctaatcttattgaagtataatattttctataaggtcatcgggctatgtgatgtattttgccaaaagtcttcacagtttatttatgggtgatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaattttgctttgataaaagtatttttccttgcatttcatttgcataaaatgttgttacgtgggtgcatggtttgggattaaagacgtttgatttattatatttgcgtatgctatgttttgattttcatttatatgtaaaataaactattaaaatgagttttaacattttaaggcagctaaatgcgtcccctccccggtccagtccccggcattctcagcggtgacgagggaaagggtacccatcttaggatttattccaattacatcctcctattatcaatctaggatatttctcccatggtgtttcttgaatcaggtttggttaaattcttttgctctttttacatctcttgttggaggttatttcgtttgcaagattcccagttcgccaatgaagcaatcaatggcaccacctttaaggttagggtcaccgatttgctgatttatcaaaggagtgaagatagtggcctgtgttccttgatttctttgtgtgcatgttggagttggttagagttgtctcactatccattgttaataagagattaagcagcaaacaagagactaaaatgtggtaaatttccagtagcatggaaggaatttatccgttcactaatgaatgattaccgcgtctaagagcataggggtttgacgccgaacaaagctaggcctatatttttcagttaggacaatctatatatatttttaacttttctggcatgaacttaatgtgtctaattgtactttgcccccaaaaggcctatgcccaataccttggatgtaaagtgttttttttagtcatttactccctccatctcagaatatagagagttttaacccttgacatggctattaaggagaagggtagaaagacttatttgccatcttaggatagatgatgtgcatgtactgactataattaaaacaaggaatagttaggtaatatgggtagcttagtagaaaaaatacaacctattactaatactattttgctatatttgagacaaatcttgaattctataagttgttatatgctacatttgagataacttttgaattttatatttgagataacttttgaattctatatgaggttatattttagtacgaagggagtatgggaaaatatgtaatgtagtagaaacctaaaaactacagttggattcaaaaaatagcacccgagtgtaaattttttactcttaatgacgtgaaaaaatctcatacatttattttttttatttttagatcaatgataattataagtttctattacatatgtgcatttttaggtgcaacggtagtttgctgggggagaattgctgttttttttttccagtacccaagtttacactgcgccaacaatacaagggaaatcttttcccagcatttgggtaaagttctctctcctacttgggagcaccggatttttttttctcacctatataactttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctctgaagcttgcagttagtgaagtaagccgccaattcttgttggcggttgacatcatctctcagctccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacgttaggacttgcagactcgctccaacctttctcaacagcgattggtattatgggggcagttgcaagtgcacgaagatatgagtggctgcccatgtgcagatcaacaaacaggggcttgaggggagcaaagttttttatgcccaactggcggctaagcaacctcattgcagtgtcaaagttccctgctgcggcatgctccccagcaagagaagatttctgagtccaaatcaggctgacaggcatgcctggtggaggagcaacgaagaccgctgagcgtgcattgccagcatttttaggggtctctgcttcaggcggaagttccagatcttctaggtcccaaccaccttcctcgccatcctcctcatttgcttcaccctcctcagcatcaaaaccgtcaccaccatttgccatcgcttcgcttgcatcaaccatatccaggtcctcatcaccccagtcagcaccagcagcttcatcgtcttcctcaagttcagccttcccagtagcatccagtccaccctcaaagataccatgcatcaccctaagcaatggccaatcaccactggctgtaagaggagcaggggggatcaaaagagagcgagcttttccttcaggaagagaaggaatattttcacccagctcagcggcaagcctatcagcaatttctgtgagcccatgggtggtagcagtaatataagcaagaggtagctgtccagcattctctaggatctcaactcttttcaacgcatcaccaagatacagagcattgtggaattgacccatcaggttattgttctgtccagcaattttgcacatgaaacccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagaattaacctttgctgcagatcaaagatggtcactcggtcttcggctttgcacagcaagttaccagtcccagcataataaattgcatccgtggcaataggaagagggcttttctttacgatttcattcttaagattcttcaccaaaacttgattgctactcttctcaaggactgcaaacctgttgcgtgccacgaaaacagctgacccaccagctcccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgttccagcctgaacgtttgaataccggttcgctttgtggcatcccagatgcgaatgcttttgtc

SEQ ID NO: 4415 - DNA, 575 bp, Oryza sativa
ccgtgcgtattgggtaaaaccattttgcaatatataagtgtgttcacagaattcctttggataaaatttggagcaccttccttcagacatgcatggtgaataggaaattccaggaccgcaaggcccatggatcataaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatcttgaagttggtgtccaggtgctagagcttgtagaatttttggccaagatgcatttgatgtgaatgtgacaaaaagatctgggcaaccatac

SEQ ID NO: 4416 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnnnnnttttctttaataatatctcaccagatgtattctccctctgtgtacttgcataagcccagttcaccttgattgcttggccacatctgtgcaaaaaaaagtccataatgaagaaaccctaaaagaaacttgaggctctgaaacctgtgctgttgaagttaatggaacacgggaacttacatgtgacgaccatgaagggtcattattgcaagagccgctgacctccgatcataatagtcaacaaaaccaaaggaagactgtaacgaaaaagtgaattctcatcaaacagatgaatattaacaaaatgcagtaggttctagttattggccctgttcttttcagctacttcattggattgttacggtggattatttgctccaacgactctaaaaatatattttctcaaaaaactttcttctactgtattgcttaaaccacttgctctaagctactacctccatcccaaaatataaggagttttggggttggacatgggtattaagaaagtaggtaaaattcaatgtgtgatggttgtgattggttgagaagagaaggtaggtgaggattttaagaggtggaaggttgtgattggttaagaaggaaataatttgttatattttgggac

SEQ ID NO: 4417 - DNA, 5408 bp, Oryza sativa
cattcatctgacagttaaaaatataagtctgtatgttgtagtgttactctgagtgatctctgttcatttccacaatacatcatggtgcaatatctctgaaccgagtgaaaggtaacattggagaacaggacaagcttttcggtgagagcaaagcacttgaattttagctgctgcagagggcaaatggctatctatctttggagacttcacctcctgctgtcttaattctgagaaacaacagcatgcatccgacaagaatcacattgtaattttgttgtaatgtacggcaatttgcagaaaaagaatggcagatagcatttctgaatcacacattcgtacaaaggctactctgggaattaacccccttttcttcattacttggggaatttcacagaattttgggggcaatgcataactcaagccacatggcatggaatgtctgccccccttgtcaacaattactggcttaaacaatccaggttgaataaagccaattaactaatgcttctaatcattggcacaaaatggcctcttagctagatgactggcatgtgtgggatttcaaagaagaaaaaaaaaagaaggaaatcccacactgcctcacagcacaagaaatttattctgtagcaatgcctgccatgttgaacaattccaggcatgctagactgctagtgctaggtgtgcagctctggagccaaaagaatgtccttccatgcctcatagaacatccaggtaatgccggaggtcggcatcaccttcagggagcttgcggcccatccgcggtaaagtcccttgatgccctcctcttggaacacctcagctaaggccgcgatcatgtggggcgggcatttcccttgcagggttccaaccataagccgcttcctcgccacttccagagggaagcttattgtacttgcagttagacctagaagatccaacatcaaaattgtgaaaagaggggtatactcaaatcaaatgctaaacttctcgtgaattatcccatttctcaggtttatcagaatttttgggaattaaattgttagctagtgaatttctaatcagcaggtgaagtggcactgaatgctaacctgaaagagctccaataatgagtagctcaggacggctcaaggacttctttttatgtgcacggcaataagaagtcttgatcgtctcatacatgaaatagtagcaggtgctataaggaagcatgccaactagtgttgggcagaggccagcatagagaccaccaataccatcagtttggtatatcttgttgaaggcaaggccgatacttggataagcctcacggttgacagtcaggcggtcctatgatagaacatcagagtatcagactgatgtacatggataaatggcttgccagcagaaagatataaaaaataatcagactcaagctacgtaaaactattttgaagtttgtcagtattttgcactactttgaacatagaactacaaaacctacagtttaattaaaaaggaaatatagcataaaacacatcatgaattccaattttcacagctggaaaagccaacagatagtttagaccattaatacgctgtagattatgaagtaccttaagaacctcaagaggatggcacactaaggtgctaactattccagcagccgcaccaccaacagcaattggagagagcaagtgaagtggtagctcaattttcaaattgccaatttgtatatttgggcacccatcttccttccatttctcttgtgcttctgtcatgctccttttgacacactcaaatgtgccaagctcaagtgcttgagttggaataatccgaagcatatttattgtattacctgcccagagtccttgccagccattttgttcgacgatctccacaaaactaccaaaaatgtgttttgatcctaccccaacaaccattcttgtcctgaaatcagacaccatgtaacataatgcataattcaacagcagtcgattgaaaatatttttttgtaaaacacacacacacacaaaaaaaatgaccactccttttttttattttgtgactaagcttaagcttatatgactatgagtactttgttagtaaatatccgttgttcataataaaagaaacaatcaagcaactactatattttgattctaacatttgaactaaatggtgcatacgactgttcaacaaagccgagaaacataatggtaaagaactgatctcaattatgtttataaggcataattctagaaatctcctcaagtgtaccaacaaaaaataagcaaagcaaaaaagaaaagcagctggtactccaagagcctacttaatcaccaagccaactaaaccatgtaatcagaaaagaagacaatgttacagaagtgagtaaatgaatgcagtgatggatgtaaagtgaatacctgatagtttctagaggagcaagaacagctttagtcatagcaccagctaatgccccactcacgaattctccaacttctctattcctcaggaaattctgcataagatatagtaatggttccaatgttaacaattaataacaacaccatgatttaaaacttacgaacaactttgggtagaatataaatcagtgaaagaactatttctggaagtgttaaccctgaatgcatccaaaaaaacacctacaagcgttttgatgtggtagagctgctatggagatgattgcaacgaacttttcatcacccactgcaaagctataaattcaatattttcccttttgaataggaaagaaagcggaagctatatgtccaattactgactgcacttgtttgtggatttctatgctataaacacctaaatggatctggaaggtacccgaggtattcaagtaattattttgtgttcggtcactacttcttgcctgtcatctgtatctaatccaaactacagcattaactttccaggacacatttccggtttgaaaatttgatcaaaattgtgagttcctaaactacagtgtgctgggtttgcctaattgtcagcacgaaagttcctccacagaggcaacatcactagtagtagggcaaatttgaattgttatttcacatgatccagtccaaattcggtgttggaaattggaaggagaaaaataagggataacaactaaaagaccactcttttctacacatggtagatttgagaagaccaagaaaaatctcaggtaccagatgacaaaattggtgtcttcgttgaaagaaacatctcatcctaccaaattctagaagactattctcaacccgatgaaaactaattgagttaatcagataacacacaaaaaaaagacttgccctactcacactaaaacagagctgatgatcgctgacagccagaagtttattgtcccacaatttccatatatatgaaatatataaaatactgtaaaactgtaaaagggttgttcaccgtgaataatgttttcggacagtttactcgtatttctatatgtggttgtcaagtatttggctcgacgtctatttctgaagaaatatctgcctacgatcaatacaaagaatactagtcagcagtcagcacgtgtcgtctactggcacatggcaatgggaaataggacgaacgcgttgaactaatcctaaataaatagtgccataataagtaacactagttcatcacttaactggataaacaagtagctaaagcaagctaaacaggggggcaaaaacgaggtcacagcttcctataacctgtacacttcagtacttcaccaaaacgagccaacagaaaccatttggaatgcgcctagatcaagaaaatactccaataagcatgaaagaaactttccgacaaaagcagatttttaacagtacattaactaataaaaattgcaacgtgtagctgagcctttatgtctttatcagaagtacacagatcaagattcaagagtacaccatcaacaaaattatccaaatagttaagcaattaaaaagttgaagtacttagacttgaaactggtacatcaaacagttaaaaagaagacttaaaatagagttgaaacgaataatgaaaatcaggagctgaaacttcaagaaagaaatatacggagtacttgacagcctgaaactgaagtactctgaacacagaaaagcatcaagccatcaacgaattagaactgttcgctagataaaacagctacagatcgaacatgaaaaaacccctccatgaatcagaacaaggtgtcccagttgcaaaatcctattccgacatcaacaatcaaagcacagcaaatccagttttaaacaaaacaagcttgcaaatttgccgcccaaacagtctccaaaacgtccaatatcccactacccccagacgccaagatctgtgtccctccccttaccctgacggcggcgccgacgtccgggagcccgacggccacgtccccgacgaccttggcgacatcgaagtcgtcgtccttgggcaggcccacgactaacaagtcctccttgtacccgccgccggcgccggcgccgccgccgccagccacggcgccgacacggacgtccgcgaagccgatgctggcgagcgcgagcttcttgccgccgccgccgcgcgccaccccctcctcctccatgcccatggctactcgagaggaacgcaaatgcgcgaaaccgcagggggcaaaccgcaaaatggtggtggctcctctcctcgccgccgctcgtcgccgcttttggaggaaagggtggagaggagaggaaggaaggaaggaggaggatgctgacgtggcgaagcgcaagaatttttgtatagcggaatggagatcgaattcatactagtacgtatttatatactgtatttatcttgtatttttccctctttttctttcttgagtgaatattgctacgcgtgtttgtattgtgtgagatttttgcatgtttttgttgtgtttgttcatagtgggatgattcgaaatctcctgtattttttgggagtttctgacatcaatttgcacgtttgagaaatttgtgtggttgtatttttttttgtgtatttacaccaaggcttccttcttgaaactttcctgcattttggcattttggccgtttggaatggtggcctttttcttgagagagacctcgatgtcataaaaaaagtgttttttttcccttttcttttttttttgaaatgatttctcactcaccatgattgagagagaaaaaaataagggaaaaagcgagggctaaagtacaaaaaatgggtccttttcccgaggcgatgaccttttgggcccacaaattattattcccctgcaggatctagcttacacaggtgtgtgggcccaccacgcgtgctgggcccaccgtgatactggagtgataggcccatggacctatgttgtatgggccttacgtcagcacggcccagttgctggtttt

SEQ ID NO: 4418 - DNA, 1257 bp, Oryza sativa
atctttccgttttgctcctctgcagctccgagtacattgtgcagaagctctaggcacacccattgtcggagactacaagtacgggtggtttgtgcaccaaaggtggaagcagaatccccaaccagactttgaaccgtttactggggagccatacaagctgaggcgcccagaaggcttggaaatccagaagggcagtgttctctctaaagtccctctgctgcacctgcattgccgggaaatggtcatccccaacatcgcgaaattcctgagcagcaatggagaatggcatgaaaatggtgctccatggtccaaggagaagcccaatctcctcaggttcatcgcaccgatgcctgcacatatgaaaattagctggaatatcatgtcctcatatctggtgtaagagcatctccatgtgccattgttggtaacatcaagtttcattccatgtagttttactgagaagcagctaggcttctagttcattattttctagattctatagctacatcttctcacagtctgggtgagaatctgttctgcactgcttcgggagcctaagattttaggatataagctgccgctgctagaagctcagctcccccgaatagtgccatagctgtttttttcaggaatgccagattgtagcatctgaaccattgcaaaagaaacagttggtgtgaatatagatcaattttctaagagtatacatcctaccaaagttttaaatctttgtttcttttttgtaagcatgatgtaattctgaacaataattactgtacgttgcagcattttactactaatgaaatgccactgctagtctgctactaatctgatgagtaattccattccagtatcagtagttccaaaagatttggtttttcctgtgctgcttcctcaggtagacgccgagcaacttgtaatacgtccaccgccgctcgccgccggtggcctcgagcaacacctcggagctcgcgtggaatccccccttgccgaacgcctcgaacacgacggcgtccgtggccacgacgggctcgccggcgcccaaccgatcgaacgcgaagttgaggttgcgggcgaggcggcgctccaggtaggcgtcgacgaagcacccgtgcgtgacgaggtccggcgcgacgccgtcgcggcgcatgtggtcggcggtgaggtggaggtcccagaacatgcacatcttgaagaaaaacacggcgcggaggttgaaggtggtgaggtccggcgtgaacccggcggcgtccatgt

SEQ ID NO: 4419 - DNA, 609 bp, Oryza sativa
ccacatgttcgacgtcgaggcgcgcgccgccgccgccgagatcttcgccgagcaccgccgcatccgcacgcagcttctcgccaccagccaccgctacagggcattcatcctctcctgcctcgtcaccatcaccgtcagccagctcggcgccctcgtcgtcgccctctcctccaaggacggcaagagcttcgccaactccggcgacctcctggtaacaccacacagccactccgccgccgccgcaggcgtagcaatcacgacacgatgcttataccctcgccgtctcgcaggtcggctcgtcggtgcagctcagcggcttcttcatgtgcctcttcggcgcggcgaggatcacgcacagagcgcaaaggatcgtgtccatcgcgagccagtggcacatgagcatggaggccgtggcgcaccacgccaagtcggcgccattgccggcggcgcccagctcgtcggccagcgacgtggacgcgccgcaccaacccgagctcgggacgacgacgacggcggcgtgcgcctacagaagcagacacgccctcggtaacaccagatgaaccccactcgcgccattttttttctgagaataaattcactcggtcgcgc

SEQ ID NO: 4420 - DNA, 791 bp, Oryza sativa
  unsure (1)..(791): unsure at all n locations
nnnnnnnnnnnnnnnnnnnnnnnnnnnnnnnnnnnnnntcaagtctaacagggctcgcagggttgaactatctgatattgcaggccatatagtagaatacaggttagtctcgaggtgttccttttagttgttctgtcttagacatgtctactcatatacaacttttggtcattaattcctgatgtattttttacctcagcgctgaccaacatggcagccgattcatccaacagaagttagagaactgcactgctgaagagaaggcatctgtgttttcagaagttctccctcatgcttcatcattaatgactgatgtgtttgggaattatgtgatccaaaaggtatgctgctgtaagagttaatatgtcaatgcctattgtctgtggtaaaaatcatgtgttgcatgttgtggtctagtcacttcatcttacataactatgctttgtgaccaataacaactctgagttttatcatatctgaagaaatgacatataatatctgcagttcttcgaacatggaactcctgaacaaaggagggatcttgccactaaggcttgtggtcatgttttacctttgagccttcacatgtatggatgccgagtaattcaaaaggtaatctttaccttttctttttttatctttcctaaaatcaagaatgcttttgaatactttgatggcaactattaaaataatggactgtgggtatgcggtcttttttttatagcagatttttggtttatctgtggaaaactttaacctaaataactggtggacaatacatagaatacatg

SEQ ID NO: 4421 - DNA, 119 bp, Oryza sativa
ccgacgaggttgaggaggaatcctctctcgagcacgtcggcgacgtagtccttggtcaccggcagcccggcgatgtcggcggcgaaggaggaggaggaagagagggtgttgaggaggaa

SEQ ID NO: 4422 - DNA, 737 bp, Oryza sativa
aaatccacacccccccccccccaaaagaaaattagcttcaatgatgaaaaattatagaaaagtaaatgaaacaacttaaaacaataatttacgagtcaaaacttttattatacctaagttatcatttgttggggttgaaaaataggtaaatttgatccatgccattacaaatttaccgtattaaaaatattattaatattctgaaacatgttgtgggggcattgaaattttctaaaactcgaatcatcctcatggcagaaaatttgacggcgatgccatggtttgaaaatttagaaaattctggtggcacgcaacaagttccacgaataataatgttatatttctaatacggtaaatttataatggcattgatccaatctaccaaaaaaaactaggataaaaggaatactccaaaacaaactttaaaaatcaagtttgaaacctggaactctgattgtggcttaaaattaaaatttaaacattaaatttgagtgtggattataataagccaacaaggaagctaataaaaagaaagaaatgtggtgtgtgtggattaccgtggaggaggtgagcaaggctcttgttggggacgtagtcgtggatgaggagcttctcctccttgcggtagtagtaggagatgagcgggaggaggttggggtgggagaggcggccgagccgccgcatgtgctcctcgaagtcctccttccccacgcggttcatctccttgaaccgcttca

SEQ ID NO: 4423 - DNA, 578 bp, Oryza sativa
ctatagggcgaattcgagctcggtacccatatctcatcgtcgtcacgtcgtgtgagttgtgtttggacttaatttctatggtgtggtatataaatattgtcaaattcttttgagaattttttagaaccatttagataatttttaaacaagccagggacatctcctcaaggatcaaaatagttttccgagtaataactgaaataactgtcgctgtgacgtcaggtgaggtacaggagagcggcgaaggcgatgatgcggctgaacccggagtacctcaagtcgtacacgccggaggacgtcgacgccatggagtgggaggcgctcgagtcggccatggcgctgtggggcccgcacttccacgtggccatctccggcgtgctggcggcggagcgctggctctgcgcgcgcgtgctcgcgccccttccgccggcggtctggccggagtgcttcgccaagatcgccgcccgcatcgccgccgcgttcttccgcttcgccgacggcgtcgacgccgccgcggcgcgcgagccgcagcggctgttcaggctgctcgacatgctcgacgcggtggcccgggagag

SEQ ID NO: 4424 - DNA, 11032 bp, Oryza sativa
cgagctcggtaccccgcgctggaggagcgggcgcggcggcacggcgcggagtacaagataccggacggcgacctccgggagcagatcaaggcggcggcggcgaaggcggtgcgcggcgcctacgccgggttcctcagggcgaacgacagcgcggtggcttccggcggcggccggcgggagttcctgccggtggacgccattgaggggatggtgcggcgggtgttcgacgaaatgggcgacggcggcggcgtcgccggcagcgctggccggacgaggagccgacggcagagtggcaatcttgaggggtttgagggctaattgaacccacagtggcgcatttggcgccaatatatcttttaaattttgatggcgttttcatttaagtgtggattagaatacgttcgtcaatttgttctctttgtggattatggttaagaataagaatgcattttattcacaaatatgatcaaccaggtaaatcccaagatttaaacgtgataattaaatttcatgatatcagtttgccaaggcagcatactgagtttctaaccattgataattaaattatgagtgaaatgcactttatgccatattttgttgttaaatttttattttagatcaccctttattcaacctttttactttgaactactccctttatttttattttaggttataagatgttttgactttcgtcaaagtcaaactgttttatccccgcaaaaaaaagtcaaactattttaaatttggccagtttatagacaaatatagtaatatttatattataaaattatttttattaaattgataattaaatatatttttataataaatttatcttgaattaaaaatattactattttttctataagcctaattaaacttgaaacagtttgactttaaccaaagtcaaaacatcttatattgaaatggaatacttttgctatacaatggatcacctcaaatcatatcacaacaacctcgaacacatcaataacaactgccggcgaacttcaccatttatacacatgccgtacctttgccaaaaagacattacgtatggcaagtgaagaattaagaatcttaggatggcccattgtgcaacaaaaatgaaaagattagacataagatgataactttggcaataaaatatggcccaaagtacagttcgttcttgaattatataccttttcttcatagcggatgaacagcttctgcctataaatctagcaaatatatgcatcacaatatcacatgattggacacatcaaattggcgcacagctgcgattcaagccactaagcaagcgattacattaccaagcagtcgataatttatcgcatacaagccactaaatcttcttttgcaaacagctacccaactattacagtaccattattgattctataaataagcaaacccctaacatagatacactgatgcacaccactaaactgtatctagcacctaggctaccacctaatgagagtcacttatgtacaatctgaaggagacaagagttttgttagcccttctggaagcactggaggttgttcatcttgagggctccaggcatacacctccagtgaagaaatatgctaatttttcaagaatctgactcggtgtctcctgaaagtatcaaagcataaatagagtcacttgaatgttgcacttgaaggttgaagaaaaccaaagagaggatgcagttagaagtaaaaagtagaagaggatgatcaccttcaccacaaagttgctcaactcggctcacaatatgcttgccataggtgtacttccttaatgcttgcagatggcccttcacacggctgagcaggagctctctctgttgctcgttgcatgtttcaagtatcttctgaactacatagtttgcatactggtccttcatcatcgcctaaatgtgtaaaaggttgttagcaaatcaattcgtacgaaaaccgcaggaaagaatattgtggaatctaagagatgctatattagatatagtgaatagtatatcggtttttatctaattttttcgtggatgctaaaaacacgggatgctactgcatactggttatcccgctaattcaggctttgctccctgtgcctgagagagggagggagagaactgaatgaaaatatttgatttacagtatcaacttctcaaacataccagcaagttatcattgccctcagtctgcttcacaatctcccggatcagaagatctcgctctgtcatatccccatgttgaaagcacttctctatcacatttgatgcgaatttgttttgactcatggtaacaacctgcccagccaatttactgataatttgggtcctttcatgtccccttcctctttccaaaacatgctacaaaagagaaaggaaaaacaacgagctgacaagtaagaatacaagatgacataaaattgagttcagtcacttcattatagcatcattcactaaaaatatgcatgtagatttcagtgctaactgccaacaaatgagccaacacacttcataacatgcaatgcattctacgtctgttacacacagtctgatcatttactagtcaagaaactgtttgaaattatcatatttcagcaaggcaggattgactgattgacagggtattattccgcagttgtgatgggtactgccaaggaaataggaatttgggcagcaagtattgcatcagcttgtagacaaatttacctgtgtaacatagttgccatactgatcttgtgcgaggacgcaagccgactccagtatctcatctattatgcactggccttgtgaatcaccaccgcagtgctccaaaactctctaccaagtaggataaagattaatgagaaagctggccaccaagctctagcacagaacacatctcaaatattattctgaaattacctgaataacacggcaaccatatgggtgcattgaaaggctggccacctgcccccgaaaagcagatactacaaagccaatatgttctgtaggaacacattcaatgcacttctgtataacatggttcccattttgatcacggacacatcgcataatgtttccatcaagctcacgaactagttctattttttggtcaagttccataacttcaagagcctacatgttttaaaatacaagttaggtaaatatagtactggtaacagatcatagatggtactaagctgcatctcgtattctcgtcgcagtgttgcatgtatgtgcatccatgtcatgccaatgaacattcgccaggtccacacaatacttgcaggaggacataaaatagctatttctaggcatacaaaagtagtttattttgaattccccaggcaaaatttccccaaaatactgtaatgattgcatacacagatatagaacatggatacccttatgtatctcgtgtacaaccgagtacttctaatctcgtgtaccacttgtttctcgtgtacaactgagtacttctactctcttaaagacatttcttaatttctaaaatattttagttctcttcaaagttctcaagttcaaaaggctgaggacctatggaacattcagtagagctagatggttaatgtaaggttgatagtaacctttaatactctgcatataatcgatgttaaaaaaaatctaaataagctacatcagaacttcaaatcaataggcaatagccaataagtaatacacctttcaagatcagaagtatagctagcaaaggcacacagtcatagacaacctgaaaccatctatcgctaacccatgtattctatggtattgtccaaccagttatttaagtttaaagttttccacagataaacccaaaaatctgctataaaaaaaagaaccgcatacccacagtccaatatttttatagttgccatcaaagtattcaaaagcattcttgattttaggaaagataaaataagaaaaaggtaaagattaccttttgaattactcggcatccatacatttgaaggctcaaaggtaaaacatgaccaacaagcttagtggcaagatccctcctttgttcaggagttccatgttcgaagaactgcagatattatatgtcatttcttcagatatgataaaactcagagttgttattggtcacaaagcatagttatgtaagatgaagtgactagaccacaacatgcaacacatgatttttaccacagacaataggcattgacatattaactcttacagcagcataccttttggatcacataattcccaaacacatcagtcattaatgatgaagcatgagggagaacttctgaaaacacagatgccttctcttcagcagtgcagttctctaacttctgttggatgaatcggctgccatgttggtcagcgctgaggtaaaaaatacatcaggaattaatgaccaaaagttgtatatgagtagacatgtctaagacagaacaactaaaaggaacacctcgagactaacctgtattctactatatggcctgcaatatcagatagttcaaccctgcgagccctgttagacttgagttcttccaggaaggaacatgcctttgggtcatcgaatttctccctttctcgctgcccttgaacaccagaataagcggtcatatttcttgagggagtttggaatctcacagaatcatttctcctaccaggagaaaatactccagtgaaagtctgtccctgaaacactgggcttgttgggtaagtcattggtgctccaacatatggtgtcatgccttgataatttggagcggcccctcctcttctggctgcaggagagttataaattccagttcttggaagttgaagcctctgatcagatggatacgcaggctgggataataccttttggggatcaaaactatcagcaggattcccaacaacactaacccttggtcccattgtattgtattgatttataccagcatatgaaagtaaagaaggatgctgaaagaactgaaagaagtttgggtcaggaacggatggctgcatggtaaccccaagttgttgtccatacattttatatggctgaacaaattctgctcctgcactaagattccctggtgaaggaaaaccagatggtctaccactaaagcttggagtaatagggctgtcaacaggtgtagcaacagaaacctggggagcatagctagtcataacaggtggtaaagctgaaccactcaaagcatatccagcagttccaaatggtgttggcaatacactagccggatgcaaattttgatagtaagggcttccaaaagaatttggtgcataaaaaggtgttgtcataccaggcggtggtaaaaattgctgcatgtcaccagttggtaattttaattgagtatgcgacaagttctcaacaaaaggaacatggggaagatgtgttccttgaggaatcatttgaataggatcaccctggactaaaggtgaggggccaaactgctgcaagacattgtccggccactgctgcttaacatgtatggtatcatggctatccaaacttatcctcagattcttcatattggagttcacagtatctagttcagtcagaatagaaccgctgccaggcacatcattcccatgcttgatgtctatgctaggcttctcttgctgagaagtttgcatactggggttgttatcaggacttgatgaactgggaacagatgtagatgaaatactgttgctatgtgtacttctcactgtgttagtcacaggaacaggtgtccatgaattcaacccagatgtcttgacagcatcaattgaaaaattcgttgatgagttaatgtcagaatggtcagatataccatcaccagtattgctatttgatggatgagtagaactgtcatacaaagaagcggctttctgctgaaaactctcctaaaaagatataaaacagatgatgagaatatcaactataatatgcatgaaaataaatcaaagcaatacttcaaacttcatttgcaagtgaagacaggaaagaaatcaataattcattatcaaaagaaacaaccaaatacgatttggtcaaatcccaagctcaacaatttatcatgccattgtacactagtgactttggtagggtgcatatgagaatgactatggattttaataaaatacctccttttatttattttacagtttcatagattaactaattaaacattatgaccttagagatataacagaaaagtagagttgtccatgacatgaaatattcaaccaccaacgatgttctaatacagattagcacaattggtagcatcctgtaacacataacagagttattatactatagatggtaaataactaaagacactacagaactccactccgcaaagaaggaatgccaaattgaactttgatcagttataaggaatcttgacaagctcttgaactatagcaaaatagcaaaggaaattccaaggtttaagtagggctggttaggctagtgactttcagaaaagcaaaatagctgatgaaaatgtcataattatttgctgcctgctgcaaaatttgctgtgagttaacaacttaacactaactggtttggacactccaaacccatgcaacatgtggcagatataaaacactgtatggcagcttagaaatagaacactgcaaacatcttcaacactttttgtatggtatgtacaataatagcagagaaattcatgatcatttttgaactagaagattgaggcaattaactgtagatttacgataattatatagatgtaagtgatttggcaatttggatattgtactttactactgatagtttgactgtcacatcgcctttctcttgttctcaaatactagctaaatacccctgtgttgcaataggatttacaataaagcccaaaaggcaaaataaaagtattcccactctaatcatcatatcatacttggtacaattttgtacatgtatgtgagctacacagttgctcgtagcgaggaacaattgatataaattatccatattgtatttgattcatatagtgaacattggccactaccaatattcaaagtagtatatagatatgcactaagattagagtgatcagttccccataaaatgggaaaccttaatattttctcaccaaaatagtgtcatatcatcctcgaactcaagttgaaagactgggtgacattggtagtggttcattagcaattttggaagatactttgtgaaatcaaaacataggacgataaaatacataaatatttttatgtgagacatcaggggagcaggagaggtttggatcatgaggagcactcaccgatgcaaaatctccaagattcatacaagtataatggctatcaaagttggatccacttttaccagaaccttgggcatcctctgctgaacttgaatccaaccttggtgacctatcgtcctcaggctcttctctgtgtgttgacagagtagatcgaggaataaacaaggaacctttgttgctgtcatcttgagaaaccactctccattctttaactttgccaacccggttcatgaagcgtctgctctccctagacataagtggtggcggaagccttgggttcaaattgaccttggagccataatagtcacagtatgccggatcagcacgtagctgctcctcagatttggaactgtccgctacgtttcccagcttcccccctaaagtggcttccaagttcccactctgctgacctatcatatgaccaagagcagcaagagacccttccatgctaggcggcgcacttccactgcgatttgggacagactccctccagcccccataaacgccactgttattgtccacaaaccccagaccttctcctgaaagactacccagtgatgagtcaaatgcaccgaagtccttgctccagttaccagaccccgttcctccaattaaccggacagcgctctctgtagccatcacactgcaaagagaaactgaatattcagtgttcatccatcgaatacatttgcaatttccattccccactttgctactttccaagtctggctattcagaatttactaggttcgataatgcattaggtaacaatattagattggtgcaagcaaacaagttcccaattatacttcttgaatagggtaaagaaacaactgtggataaataaaaacattaagctacacaacctcaggacctcccaaaaggatacaaatgaggcagtaaggaaaacttgtgatttggtggaactggctaatcgtaaaaatgaagatttttagtagcacaataaaaggttatacataatactaataggctacatgttgcagtccaccagccacaggcgaacgtaacgtgtggaatgagggggttaagctgaacccctagccaacccaaaaaaaaaaaagaaaggaagaaaaaaaaaaggaaacttgcaccgaagtcgttgctcctcagaaaggggattgggacgaaaccggatggggtaaacggagcagtaataaaaatcaatccaagaaggaatttttatccattatatctccaatctacaccgcgccggctcacgaggtggcgcggaggagaagggctagggcttggagagaggaacaaataccttcagcccgattccacccggccgcctcctggctatctcctccgaacctgctcgccggccgacgaggccacaccccaccccaccccaggaggagcagcagcctagagccagaccgtggatgttcgccgccgccggagggggagctcggagcagcagggtgaggcccgtggtctccggcggaggaggaggaggagagagagagagagagaaagagagagagagagagagagagaggcaagggtttggagaagcaaaagcgaaagaggaggaaaagagaagaggagaagagcagaggcgaggggtggcggcgccgctcgagtcgagtcgacttgagacttgagacttgagaggtgagctgcggtggtgtggtggcgtgcagtgcgagtgctacgctctctgctaggctaatcttctggggttttactggagtaatagctcggaagtatattctctctttttttttagtttatttaaattgaaatgagtaaataaattatatctaataaagttgtacttatctatcgtaatccctccgacgtaaggtagaggagctgcgtccgaggggagaggggtggtggcgtcgcttgagtcaagtcgagttgagcgaagccctcgctacagctggtgctggtgtcgtgtactggggtttcacaccttttatttgtagttcataagtacattcttattttttttctttatttacatcaaaatatgtaaataaataggtataattaagttgtacttatctgttttttcaagaatatcaaatgataaaactttaactatatttataaacagttggttctaataatttcgtttggctaactggttttcttttttaatttatgttacaaataataatatcattatgggctgcaatatataacaattgggggaatcatgaaggttggataacatgctttatctaactataattatattggtcaggtcaattttaaaaaacagttgctttttaaccaaggtaaaactgagagccaccgcctaacgatatggacggttgccccaatctcatcggcgaatagtaataattttttggtgttattgtaggaattggaaattgatttttttcaaacaaataaagttatactcgatatagagatatttgttcgtgttcttaaaaaaaataggtagttgttctcattttctttgtgtagtttccgtggttctgttagtaaatcgtctctcctaagcgatgatgttatttaaactgtgttgaccttgtcttgtgttgctgtagttagacgtatacgttttggaagatacgtgaagggaaggtactctactccttttgcatggaaactgcttgactcgttctcaaactgtactgtagacaatcttacgatgtttccacttaaatgttatgaaatgcattcggcagtttcttcattaccacatgttgtcatatttgagtacgtaaatactcgctccgtttcaaaatatttaacgccgttgactttttagcacatgtttgaccgttcgtcttattaaaaaaattaagtaattattaattcttttcctatcattttgattcattgttaaatatatttttatgtaggcatataattttacatatttcacaaaagtttttgaataagacgaacggttaaacatgtgctaaaaagtcaatggtgtcaaatattttgaaacggagggagtaattcacgccttccaatcaatttaagttatatacgaggagtactgaagcaagtctaattataaaacggtgcaaattaatcaacaaagccaacgaagccaccggttatgctgaataaatcaatacatcatccatatagcaccgtgtattgtgatggcactactaatgacattatttgagatagttaaaattgatgagtactttttccgtttcacaatataagagtttctagcattgctcatattcatctagatgttaatgaatctagatatatgtatgtgtttagattcattaacatctaaatatatataggtaatgttagaaagtcttgcattatgaaacagagagaataatcagcttttttttatgatacaatagctatttaagggtatagcaaatgaattaattagttaaaaaagttattctaagatttttttttttaaaaaaacacaccgttcaaaatatcggaaaacatgcaaaccaacatcccaaatctgaaatcagaaaaagaaataaaaagagcctaggtacatgtgatttatgatgtagcatactttgtccatctaaaaaaactcaatttaaacgagaatgtgatatctcccacgtctagatttttataataggaggaatcaacagcctcttcttggttgagtttattttttatttttaggggggagtaggtcttttggcaagaggtgaaggaaacaattagtagtgcagtagcttgctggattaaatcaactaattgatactgctacagtttctgccagatagctcatgagtaatttacattttat

SEQ ID NO: 4425 - DNA, 3728 bp, Oryza sativa
agtatgattaagaatgtcagccttttttgctgcatctgtttatgtttctgtttaattatgtttgtacgatttaatagcatgctgatgggaaaaaaaaagtaactctttcgaattcaacttgtgttgtgttacataactgaagaatttgttgtgttacataactgaagaatttgttgcaaacatgttcttgttgagtttatctgtatgcagtcccccccccccctctctcttgtaaatagtagattgctttacattcatttacaggaacagaacacctccagttgtgcatacctacttctgcatgcctatttcatcacaatgatcacattacctacgcatcctatatctgagatcctaatagctgaaacaattgtaactggttatttactctgttgatcaaattatggatcccatttcaatagttaatatatgcgcattattgtgtttctactctcactatgcaggacaccaaaactgaacaataaactacagaaacgtaccctcggatcaactccataagctgaggttgcatctcctcgtctcttagaacttcaatcctcgctgatattgactgaactgtgtgtattgacaccttcatccgagtatgtaaacttctcaatgctgcacgggtcttatcgacggaggaaggctcgtcgcctttcacatcctggttcctcaaatggttcagccttttctcatagtcaattcttaatcgttcgcctgcctacaagtgacaaaaacaaagcatgattcccactactcacttctattgatcttctggtattagttcctggtggagattgtacctttacttctttgtataatttcttctcccatgtatacagtctatctagagtggagtgatgacttccagacattgtactgcaggattcttcagagtaacagctgtttgtctcattgtcatagaggtcctctattgagcttgtgggagcaagaaggaagcgggaagacgatgaccgggatgatgcagaccgcaataatgcgactgggtttagcatctttgctgcattattaaattcattagtaagtcgagtgagttagatctgaaatagttttaagtaattccagtattggtttgtaaaattagtaccagaaagatcgtttgaggttgagtattgagctctacttgcctccaacatcactgagatttcctttgcagcatcgcagatccccaagaactgactgtcaatatccttcatggcttcagccagacttgctggtctgcggttcagatacactgtgaaaccaggtgtttcttctgcatttgctactttgttcctcatcagttctttcttatgcgccttgatctcaagttctactttgttacgcggttcacactgaactcctttggattcaaagccctttgtttcctgcttgccattgacctcagtcttcacagggcaagcacccccattagaaggcatacatctctcatctgaatgatcacattcatcgtcgccatcatcgtcatcgtcatcgtcatcatcgtcgtcatcatcagaatcatcattgtcatcgtcatccacttgttcctctttctggtgcacctgttcatgttgttgacactcatcatcttcttcttcaagttccgggattccttcctcctctcttacacgctgtaatcgtgccaattcatcgtcggtgaccacattgtcatagctactccgaggtcgcggatacgcaaagctgtccagcgatgagaatgggttccagaagaagtcccactgtgatgattcctgctcctgaggcgacggaggtgggtagcttggcctatcatacgacgcgtaataagaagtccttgttggctcctggggtgatgcagctggatagcttggcctgtcataggacatgtaataagagttcctcactggctcctggggtgatggaggtggataatttggcctgtcataaggtggtgtgtagtaagaagatggcctcattggcgaggattgcgctgcgaagaacctgtccatgccaccaaagttatctgtggggtaatgtgactcaatacggattgtttccacgggtctcggttgctcttcaactgataccgatgggtttggtcctgacctcaggtactttgagacatgaattgtcctcttctcatatgaaccataagggaggccaagcagctctggcttctgttgcttcaagggagaaatgaaggggtcaaatatgagctcatggtgatcatccccagcaacgaaccactggagcgccatcgagacgcgcctcaaggactcaatgtaggcaaagtgagacgacgcgaagcggttccgctgctccagcgcctgcttgatgaagtccctcctgtcccggcacatcttgacagcctcctcatcttctaacctggaagcagcacatcccatgtctccaaagcctttgtgtagtttcaactttcaagaacccgtcatgcttggatcagaacttctgagttcaacatgtggaaaaacattggagaaggaaaatgtaacaggtcagttctgacttgaagaaaccaggtatttgagtcatgtaacattgcagaaattacctaatactgtacaagaatcgacatttggtgatgagcacattccaagcaagaagatgacctgaatcaaccctgctgtctgacaagtttcccaaagttcagaagctgcagaaacaatgcagaatgattatatgcaatcaaatcatgcagcaaaagggagcttaggcataagctaatgaagtgcaacagcagtcatgaatgttgaaactggttgaatacaaccacaaaaactggccactcagaagccacaggcaacaactgcaagctactgaaaaccaaacagagcatgagatgcatctatttatctggaaacctgaaatatctttacaaagaaaggggagtgaaagctacaaggctacagaaagatgctcctttgcaggtgaaataccccactgcaaatacgctacactacacatttgttcggtagcaccagcattctttttctcccaaaagagggctgagaaggcaagagagtgaggaatattaatccttggccctactaccttcaacttgcagtaagtgaacggacttgacaactaaactaaattcagttcagtacacagtatggagtgtgagtgtgtgaggctagtgctatgaacacacaccaggggttgtactgcattggacttccaaagtcacactttttttcagggtaaaacagtacagacagaatcatctttactgtcttcaagttacagaagaaacgaatgatttagttctgaagatttaacagtaaaataagtgcaggattctaaatttcagaacagatggaccatgctagacactcttctgctgtataagcaaggaatcaggcagaagtaaaaaataataatcttgtgatgtaaaaactacaggccaaagacaaagctcaggtgatgattatgggtaataataagtaacagctcttgtctcatagtgcccccaaaagaaaaaaacaagtcttggacttagctccaagcctccaatttaatgtcaaattatcttgctacaacggacaaatcaaatggtagacaaacgcgacccgtgagcttacagacgaattctcactctaaaatattcagaatcgtggttctccttgcagaaaaaaatttaaaaaaacattcagaatccctgatgaaacagatgaccaaaatcttggagcaaatatatgaacaggcaatgtactgaataaaaccaa

SEQ ID NO: 4426 - DNA, 3932 bp, Oryza sativa
gggaagaacaggacacagaacaagagctggccatcaaaaaccaagaaaacaaggctatcactgctcaatttccaatcttgcaacaccagagaaaaaggcaaagccaagcataaagatcaggtggacatgggcagcacaggagcacatcattctgaagtgtggaggaagcaaaggcagagacagacgagtccatgtagaggaggagaaggaaaggaaggccatgggaaccagggacaaagaggcatacatacatgttcttgaagcactcaaaagggagcacacaaaattcgctaaagatcaaccccagcttcgcaagaagaaaccacacaccctcatctttctcactctctctccactttggccccacaaaacctctcatccaaccacatcaattgcgagcattaaacaacacaaagagaaaggtgaaaacaaaagcaaagcaggaggaatgcaaatgcaaacctataagctcacatattaaaataagatgagaggttcagataagcttatacctgacgagagaagttcaggcctccctcctctactctactctatccctttctcctcctttggtatgcgtgtgtacaagtctacaagaacaagaaatggaagaagtctttgtgcagagagagagagagagagagagagaaagagagagagtgtgagtggtggtggcagagaaagagagagatgcaatgcaacaacggtcaaaagacttgaaagaaggagagaaatcactgggaaggaagagagagaaaagtggagcagcagcagcagcagcagccagcagatagtaactgagttgagctatgaccctacacttgtagttatttcacaataataccccactcatttacttcccttgccattttacacaaattgctctctgaacattttgttcaatgttcagtaaatttcaggcaatttatgacattttatgtctctaccgagatgaatggaatttgtgatttgtgggagaaatttcacattgaaattcagagatattttatattgggagtaggaaaaggatcagaggggctttcttgagaaatactaccagtctaccaccactaggaaggatgactgcaagacattcatgccctttggagttatcagttgaataatttatggcattcaccaatacgacaacacttacgttagagaaaagaaactgaagttatgaccgtgacaacagattttggacgtacagctcagacttcagagaaagctacaataaataatttaaaatttgttttttctacatgctttaatagcagcacgttgaatgaaaaatcattacttagaacgtactattcaataatacactattaataccattttatcaacttgataaatgaatgaattatgcacaacatgaaggtctgcatttttgtcagttcacaaaagaggagaaagacgtctttttttcctctcttttttactctgaaacttttgaacaaacttccggttagtcagttgagttcaggcttcatgcatgccgctcttgacgcatcacacttatctcatttcctggacaaatcggttgcatcaagatacacttttaaacaaaccaaaaccttttctttttttctacacgccaaaagaaaaaaaaatctgatcagagtaatctttagcaaagaaagaacaatgggaattcagatctatctatgatatctactagtatcaatcaatcaatcctgtgtgtgtggattgccactgcatgcggcacctggctaccatgcacaaggtgtgggctaccacacaaggcaagtttgtgcaaaaatgcgagctcatcgatccccagaaaaggcccagagagaatagatgctctcatctttctttcttttaaggtgttgatcaattctgatgaaagttcctcagatgcctgcactagtaggtagtggttggggttttcggtcgagtcactctaccgaatccatgtattctatcaaggactagattatttgttgattttatcttgcttttatgtgttttctaagaccaaaaacagtacgaaattcttaaggagatgccgagtgttcggcttttcaaattttaaattctatataacatatgtaaaagcacaaaaaaaagagagaagccttattcaagagaacacgtcattgcggtggtgcgttcagatgtaatgatatagattttagtatattacaacagctaccactgcacagaaaaaaaataccattatactagtcatcaataaacattattttcaaatactacaaagctagattcatacatgctttccgcttcaaaagtccttacaacagagtcaactcggcacaactattgcataggatggtagtctactaggatatgtcctagcaaaaatcctggattatcacggatacatttcctgaacttctaaaagtttgcaaaaaaaaaaaactttgtacatcagcaattttaagaaaaccttttaaaatcaccatttgaacattctaatatttaattctttcatttgagacctcgaataatcgacataagctcatcatccattagaatgttagaacacacccccatgaaattatccaaatagaaccatatatcaccggtgtgctgcatattaggtgctcagtagatatgttcataggccatagcacttgtacaaaatgaaagattatgttgaccaaatgaccatgaagaggaaggcatgcactgcaaaagcaatttgaaaaaagggtctcttgtattggatggatatgagcatgcatgggaattttcaaaaagataaagcacagtttgttagtctgcctcccccctctatcagagatgaaaaaaagcaaaagagatgaaaagattcttccacatgtccatgccccagaatttttttagaggtccttttctcacacctttatcttggcttagctgcctaggcttggtgctgttttttatcagtacagcccttacactatacttctttactgtgggaaccctttccacttggttgaataacatttattatatttagcttctcgggcattccactgtattatcacataaacgtgagcggaaaagaaacaaaaaaaatggtcatactttaaaaaatagcatgatgagaaaatgtaaaaattcagtttgaataatatttactacaatgtttagcttctcttccattccaccgtatatttgtttacttaaacaccgtgggaatgctagaaagttaggggtgccacgtcagatgttacttttgtaaaaaagcccccacagttctattaattacacattggtccccactgatatccaccgtaaaccgtcggatctcgatctagttatcacaaaggcatgagaagaagaaaaaaatacaaaaagtggtgatactttataaattctgaatctgttttgtactcaaaactgttttgtacgtaattctgaaactgaagattagcagtggttaggaggagtaatgcacataaattcagatgttaaaacaagacaaataaggtctttccataggataagtattagtcaagttggaagtttttataatccttgtgcccatctcctgctaggaagagaacaaagtgaggaagactagttgctcataggatgccactctaatctagatcctatggttgcaggcttgcagccttgcaagttactagtacttagcatttgacattatcaaaacaagacaaatgaaacaagcacaacaaggccctgttttttcaatgtctcaccagccaggggttcagaagaagacatgattggcaaacatggccattttgtcttcgtttactgatgcctcagctcccagatccacagtacaggactaaccttaaccaaatgctctactcttaggacacaccaagaatcttaacttgctcttttcatcaatacaatgtgggccaccacaatgaaaaaaaagtagaaaaaaggacagaaattatatagagagcaactacactgaacac

SEQ ID NO: 4427 - DNA, 5013 bp, Oryza sativa
  unsure (1)..(5013): unsure at all n locations
atctgttttgtactcaaaactgttttgtacgtaattctgaaactgaagataagcagtggttagnaggagtaatgcacataaattcagatgttaaaacaagacaaataaggtctttccataggataagtattagtcaagttggaagtttttataatccttgtgcccatctcctgctaggaagagaacaaagtgaggaagactagttgctcataggatgccactctaatctagatcctatggttgcaggcttgcagccttgcaagttactagtacttagcatttgacattatcaaaacaagacaaatgaaacaagcacaacaaggccctgttttttcaatgtctcaccagccaggggttcagaagaagacatgattggcaaacatggccattttgtcttcgtttactgatgcctcagctcccagatccacagtacaggactaaccttaaccaaatgctctactcttaggacacaccaagaatcttaacttgctcttttcatcaatacaatgtgggccaccacaatgaaaaaaaagtagaaaaaaggacagaaattatatagagagcaactacactgaacacagtccaatgagacacatgcatactgtagtagcttcagtctggtcaatttcccatccattggactcactttttttactgcactttttcctgatgaaaacacaaaactgcaaaatactgctacagtgttatacatgtacgtttactctctagatcaaaactgatgacttaattgaactgcgaatgcctgcaataaaagctgacatgaaaattttctttagagaaccagagcttgcatcctgcatgggtttataatagtgtgcttttttgtctgcaacttggaagagtagactgtagaaaaccagcattggatctgttcatgttgatgttattttctaccttctgctgcattgtactactactgtataggataactgaagattgggttgtgtgcacacacagctcactcactgtcagaaggtccaatgcttctggcaatgcagttcatggctgcaagaatcaagatcccaatgcagtttctctgtactctcttgagcccaattttggttgcctgttgatctattccaagcagactacaaacctaccaaaaccaccatcttaaaaccagaattacctcacttggctgaagaacagtagagcaagcaagaaagagttcttgaagaaatacctcacttggcctctacctctttcagtctgcattgaagaaaaatggttagtggttgccttccatcacatgacctgctgccacaagagttaacttctctgcatcttattggcactcctgcatatacacaagaggagtacatttcaagggactctttgcagcaaagagatgacacacatctcactccacacatctgactgcacatgctttgcagggcaatgacaggtgcagaggtaatctcattctgcattacaacaagaaactcccatcaaggttgttgcagccatatgcccggttcttttcgtcttacaaaaggtgtgtttagttcacgccaaaattggaagtttggttgaaattggaacgatgcgacggaaaagtttgaagtttatgtgtgtaggaaagttttgatgtgatggaaaagttgaaagtttgaagaaaaactttggatctaaacatggtgaaattatagattatcacgggcatgcacgctttccaaagcttataaagggtgtgatgttttcagaatcttttcgtatataatttgcttaaaatatattttaaaatgaattttcagctttttagttagttgatttatccgtttgtaccctttaatatcatcacaaatgagatgatctattatctattatctattcagaacaatcaaactgggtaataccaaggctgtgtttagatccaaagtttggatccaaacttcagtccttttccatcacatcaacctgtcatacacacacaacttttcagtcacatcatcttcaattttaaccaaaatccaaactttgcgctgaactaaacacagcccaagatgtgagaaaagtctcctcatcaaagtttccaaataggcagggatgtagcagcagtgtgatagtgccaatgtggcccattggcatttcatttgtcctccatggctggaagagagagagagagagagagagagagatttgcaacagtgcaagttttatggcacataaattgcagggcacagtgaatggccagtttgccttgcattgcttacaaacaagctcacaaccacaacacattgatgacccccaccattgatggctgtggcagcaggaatttagtggcagcagccatttgctgtgctcatggacttggcctgatgctgcatgctgctgatgcagaacattcggactcttcacttgcaaatggggctcaccagtctagattattcaactgagtaactgactttctggggtccacacggcaatgcagtgttggtccataagttcatagatccatttgtggagatcagtagtgcaggcagggtttaccttatcgtttcaaagaaaaaaaccatctctatcagtttgtcaaattgagtaaaacttcaccttttataagaaaccaattaaaaaaacttttataagaaaaccaattaaaaaatcgctcggacttcacaaaccgattctctttcatgacaatcgagcagatcgttaaggtaatggtcataactcataagtgatgcaatttgtaggcttcgaaaatgttaatttttagcttatcagaatttcagtaaaacatttggaaagatttatgcatggcaagaggcacaggccttttcacacacgccgtgtacggaaaggaagacatgtcacttgttctaaagttgcatcatggtgcactatgattttttctgcagagttacatgcgtgcttgcacgagcagcaggtttatccttgcagaagccaagtgctaaaagataagggagaggtacaacacctacctaaaaattcagagaaagcactgcagaaaattgagcagatctcacttcagtttgcaggttgcaatcaaacacactgaagttcctttgcatgtggagattgagtagtttaaagccacctgcttcaatctcattgctccagtagcttcagagttcagacacagcttgcaactatgtccagaagtaggattttactcggtgatttctgattaaccatttgtcttgcttccatatgttgctatgctgcataaaaacctcatgctaaacacaggctccagaaatggggatctagcagcaactcttcttaggtatcgttttagtatgagcatttaaacctaaaggcatttacatataatagggtggtatcagctcatacagcagctaagctataaagtattcaaagtgtagcagatgccacattttgcggtgcctcaggcactcgatgggtcaacaggggaacaggattggggatccatcgcgccgcagcttgttgtcggagagatccagcttgctcatcttctcctcacaccacaggagctgctccttgctgagcttcgccatccttaggacccttgacacaaccttgatgtcgattaaggcaaaaagcagctgaacttcctccattgtggctggccaggtcttgctcttccatcctttcttcttcttgaatagctccttcactttcacttccttctgcaggtttggagggatccattagaaacaaagagtcgtataaagacaaactgtagatatacacggatctgagactgaaagagcgtgtgaacaatcgaatcagctaattgggctcacgttgctaagaatagatgctgcattagtaatatggcatttatttctcgacgtgccacgtttggtaacatatgctgtaaagaaatcttgaaggcatgcagactcaaccaccatgtgcaagtacaaataccatatccatgcaaataactttcagagcttttgtttcatatgagacgaacatcagatctatttgaggaaaaagtgattatactactagcacatttcagaaagagatcatatgaaaaccaagccaataaaagttagcaacaatgaatataaaactaccccgtttcatcaaatataaaactaccccgtgagacactgaataaccagcacccagcagatatgaactaaagaaacctaccaaggagctcgaggttttgttagtcaatcagccacatataagaataagatattaccttatcaagagaggattgaacttgttgaatcgagcttccagtatgactatgaacactcatgagggcactattctttttcttgtcctttttcaggaaaagacggaaagtcatgatagactcctctaataatttgatgaggtcagatgcaaaaattgaaggttccacttgatcttcagcattatatttcccatctgcaactgtatagagaatacaaaaatgaaaagaaatatattaattaaaaacaagaatggcattaattaacagagtcgtgtaaaaattgtgtttaaagaacccagttctcaaatgaatgcaaaaacataaaaaaaaaatcctgtaacaaaagcaaaagtgaagccatggccccacagaagagacaacagtgtttattgcattcagaacttactgccttgctggtagaccaaagtaaaatctgatgcaaggaaatcttttggggagttcagggatttttttgtactaagcatcacattaaacaagatttggttcaaccaaccgattagcttgcatctaggtaatacaatttatacctgtaccaagtcctgctgtgagtctagactgatagaaatctttcaaaatcctatggaataaatgaggaagtttatgggcatggcattctgacacatcttaaatttgcaaagaatgctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4428 - DNA, 872 bp, Oryza sativa
  unsure (1)..(872): unsure at all n locations
tgaaatgcatgaagcatgttaaatataaaatataagcttgaaaactatgtaattaggaagctatagctgaacctggatagtgagagctaacctatttttttctggttgttggtccatctgtgttggcaatggacgttgtgttttcagaagaaattttgtgaaggaaggactgtggtatgagaaattgagcagtgcacatgttgttgtggtgttgtgggtgattcttatagtatttcagtggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaatcgttagcagtgatggtgacagatttggtgcaggtctaatttttttaagaaaatctatatatgttgctgataaaaggccatgttgtaggagaattgtgaaggatttgaagagttgtacctgttccttgtgacccgatggctgttgatcagctatctttggctgctgcagctggttttcctctccattggtggaggtttccgttctgaatttagcagtcaaattagtagcaaaacatacatacatacatacatatatatatgcacgcgcgcgacacacacatatatatgtttataggctgaaacttaaggtgtgcacgtacacttttttatggcacttagaattttgtcctgnnnnnnnnnnnnnnnnnnnnnnnnnnnnnnnnnnnnnnnnnnnnnnnnnnnnnnnn

SEQ ID NO: 4429 - DNA, 467 bp, Oryza sativa
  unsure (1)..(467): unsure at all n locations
nnnnnnnnnnnnnnnnnnnnnnnnnnnnnnnnnnnnnnnnnnnnnnnnnnnnnncattgcatctacatctgctaatgacatcaatagtctgaatacaaaccagaaggaaatattcaattctatttctaactcagtcataaataatgagggaagaacattctttgtgtatggacatggaggaactggaaaaactttcttatggacaactttattaaactttgtgagaactcaagggaaaattgcattagctgttgcataatcaggaattgcagccctcctacttccaggaggtagaacacctcattcccgcttcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4430 - DNA, 4730 bp, Oryza sativa
gaacctcagagaatttttgtggaaaacaaagcaatggaggtctggatttcttaatatttactcaaagacaagctttcaccgtaaatttcttactgttacgaaatcatagtcattaaataggagtttcgaacatgaatccaacaaatatatttttgtatagcaaaacctatatattattttattaccaagggtcaaagcatagaactagacaatcaaaatcctccttatatttttgaatgtagggggctaataaatcatgcagttctgtaggatatattttcaacaaacatcaataaggaatgtaagaattggaactttcatgttaaaggcagcgttcttttctgaaacttcaaacgtcatgttcctcggttttcattagcacatattttaaactactaaacggtgtgattgattctctcgttttacgcactggttggcgaaaagcttataaatgacttgcacattagaacaaagcctaaatttggtactacaagtgatcacaaagaaaagcgaaaaatatgggacaaatgattacagagaaagccagcaacgtttgatcactcgtcttattcaaaattttttgaaattattatttattttatttataacttactttattatctacagtactttaagcacaacttttcgttttttatatttacaaaaaaaatataactaagacgagtggtcaaacgttgcaagcaaaaactcaaaattccttatactgtgggacggagggagtaataatctagtacagtagtaataacactgttattgtcatctctcctagctccggcgagcctcgtctccacggcggccggcggctatccggtcacagattcctgaggatctggacgatctggtcgagcttgtccaggttcttcttccgctcccgctcgcgatcctcctcccggctcaccatctcggcgacctgcttctcccgctcctcgccgcgccgctccagctcgacgaggcgccgccgccgctgctgctcttcgtcgttcgcctggatcgatatgccgatgcacaagccggcgaagaagcagacgaaattcgccgccatggagaacgaacaagagagaaaaattacgaaaccgaaggtatatatgctgcttggccggtcggtgatcgccgccgccgccgataggattattatcgaacgggctgcttggatctccggcgaggttgtgagtacgtcgtggtcgtgatggaggcaggctgcatatataatatgaagattgttagcgaactaccgcaagtttagccgatcaaaacagaacgagcgagaagaaacttggcagcgttttctgttgtattaggaaactttaaatagtaaattacatgcccacaacttcctacttgatcgcgccatcccacgaccgaagctgttgccatgcgttcctaaactcccgccacttcgccatgcctcctgactagaccgcgccatcccacgatcggagaacacacgaagcgcacgcactcactaaaaaactggaaagagctcccgcatgaacgcagcatgcgtcggagcgatacacacgccatgatccccagcaaaaccggattacttcaacaatattaatggagtttaggagtttctgtcgggatccaagttgatccagatgcgcgaaattaacttgtttgatttggactcaatttttgcgttatcaaattgttagtatagagattgaactacgtgaataaaaattggtagcaaaccaaacaggaagtggatttttttaaaaaaattcctcaagggaacattcgtgcatggcatttaaaatgccataaaaaaagtaagatagatcaaagtaagttgaatttgaacatgcatatttctatagtgacatatcacaaattgatctatgttactaaatatttataaattttgacttctaagagacatgcagaaataagacaacatacccttaaaaaatgaacagagttttccaacatactcttagtcacctaacactgtaacacgctgcataaattctggaatcgatatgttacagtcaccggcaacatttcctatttaagctagtgtagatggagctagctagccgaggtggtactaagctagctacagctgccgctactgctcgcttgcttgctgcgttgctgcacgcgtgggccaagggcccaaggcctagctgctgctgggctgcacagctagcgcgcttttttttagcttttttttttagtatccctttttcctataaagttatcccccactacgggcaattaagatcctagagcttaaacctcaatgatcaacgtcatcattaatttatagcccttagatcggtagattagattgcatctgcaccgttggatgcaatctgcctcggggtcgaacacaacacatatactgcagcccaggaggcccaagtcgtgaggcccaggaggcccaagtcagtccaatgagagattttagggttcggtatgtctcatctcctcctgactttctgagcagagcagcagcggcgtagtgcgacggaccctagcgctcgcccaccgcgtcgcgatcgcgcgcaggtggcggtggggacagggcgctcggtcgcagaagcgggcgatggcgcgcaggtggtggtggggaccgcgctcatctcggtcgcagtagaaggtagtgatggggagctgtgtagcgatgcggcgatgggggagaagcgtctggactcggcaaccagcgatacggcgatggggagaagcgtctggactcggaaaccctagcgccatccatccgatgggaagaagcatctggaaccctggcaccatccatggtgaaatcaaccgccccctccccatcttcttggctagcagaaacggtaatcaccatgcttcttcccattccccgcccttaatgatgtgcatttacattagaaacggccaaaatcattatggtactggaggcacgatggttaatacgatttatgtgcctcttgcaatttctcttcgtaagcctcttccaaaccttttgataatcctcttgcaatccccagtgctaccagacgtctcctcaaacctgtgcctctccgtcagacatcatccatccatccgcaagcctcagatccatacctccctcgacatcatcgcttcatcctgcaagcatattctccaattcggacatgattgcgatcacggcaagataggttagttgtggatcaaactttgtcagatcattgtatgtaggcttcgttactaattttgtatgtctgaattgagttggttcttacttctttgccctaagtactgattttagtttctgaaaaaaatatgtctgaattgagttggttctttgccctgagtactgattttaatttctgaaaaaaaatgtgtgaatttattctatttgataagcctgaatttgacatcaattttgtccatattctatttgagcaaacattatgatttcaaccaggcaagatcactatgaaagctttgtaaattggattctctacacctaaagaaataatccctatcctatgcactgattgttgttccagttatttaagaaaaataaactgatatttgcagtggatacttatatgtcctatgtgattttagtttctgaaaaaaaagtgtgagaatttattctatttgataagcctgaatttgacatcaattttctccatattctatttgagcaaacattatgatttcaacactgattgttgttccagttttttaagaaaaaataaactgatatttgcagtggatacttatatgtcctataactttaatgtatttgagcagttggtgaggagccagaggattgctacatagatgtcctgacatagcgagaagctactaacctgctcggtatgtcttctgttgagctcaccccatgctattcatgtttcctgttaaaatgtgaaaaaaaatcatttaaaaaacatacgttaaatgttatcaaaatttttgaaactatgcacatccatagttcatgttatgatgcgtttttgtcacaaaaaaggtgttaaaatgaaagcttttggatgctttagtgagtcagttcagtatgtgtaaatttcacatgatttttctcagaacaatatttgagcatacattgtggattttgcacatgcaggagacctatgcactgggtactgttttagtttcttaaaaaaatagaacctgcagcttatactgtttttcaaactatgcaaatccatagttcatgttatgatgcatttttgtcgcaaaaagtgtgataaaatgaaagcttttggttggtttggtgattcagttcagtatgtgtgaatttcacatgaattttgccaggttatattatattcgagcatacattgtggtttttgcacatgttggagacctatgcattgagtactgttttagtttctttaaaaaaatggtgcttgcagcttatacttctttcacctatcctttattaatagatacaagaacatttgtttcatcacttgaggagaagcctgacaattgtcataaaagcagataaccttgctcggtatgtgtgttgttcaactcatcctatatttttcatatttttttgtacatctcttttctgatttcatattccagttacatcttatgcgtatactcctacattttcaaatataataaacttacatccgatatttgtaaatatatgatcagatgctttgttgattaaaactaaaaaacaaagggttcaacccatggatgctgggcaaagtacttcacgttttccagtaggacgtcgccggtca

SEQ ID NO: 4431 - DNA, 555 bp, Oryza sativa
atattgaatttgtaatccacctccagaacccatattgaatttgttaacttctgcgagctccctttcaaatcatttcttgcagcatattcatcgatacaattccatgtttgctatgacttcaatgggggctaaaatcattgaatccatcaacgacggccatggaccatatgtcttcaaaattagtggatagatctgccacagagtaggctctttaataccttcacaaggtcgtcggccagaatatgctcagctatacatcttcgatacagaaaatgaaatctctaacataatcaacattgcttcttcttctcgcgactccttccatgccaatgaagaaattgttcgctctctaatagaaatgttcgatacacacaatcccattgtgaagttattccgaacagcaagagaaagattaagtgaaaatgaatctgatcattacaagatccgactatttggctcgacagatgcacatggagatatatacagtgcaccagttgcagcagaggttgtaggattagttgttggggatattggggtgactgatattggtcggga

SEQ ID NO: 4432 - DNA, 4365 bp, Oryza sativa
  unsure (1)..(4365): unsure at all n locations
ttttctttttttgtgagtaaaaaaataaaatgaataagtattattaatgaacttggaaattcntagatcaaattccaaaagaataagtccacttctgagggactcaaagtagacttatacgaattccaaacaggcttagtaagcccatggtgagtttacagatgggccataacccgaaagagattgccagctctgctaggtgaggtggagggcccacctagtgggcccaattgttttcgcgggggcatatacagcgnagnacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccgcgggatggtgcgtgcgggagtgggtgggcgtagaattaggttaggttggatttggacctgttgcttgtcgatcagccatgggatctcgccgcaaaagctcacgcttgcggtgtttgtttgtttacaggtcgacaaccgtagccaatctgctggaaagcgtgcccgcaccgacggtaggtcgcttcgccgcggcgattaacctgcggctttcctttactgtttaagctgcatctgaggggaatttcatttttggtatggatgacgactcacaggtgggcggcgtgaggacgactgggtttgccccagctgccagaacgtcaacttcgccttccgcaccacctgcaacatgcgcaattgcaaccaatccaggcccaccgactatacggtacatgtgattgccaccgatgcgcgctcatgtggttgattagttccgctcatcgtgatttttgcatttacctagtcgtgctgttgcctcctctccagaaggatatgcagaaacctatgcagacaccgccgccccatttccccatgtcagggggatacatgagcccagggacgccgccatccatgtacctcgggggtggtgctcccccttatggcacctccctctatggcggacctgctttaccacgttatggtattgctcagttccctgggggttctggatatccatatggctatggtggccgcctggggatcctctagagtcgacctgccaatggggagcccctatgggccgccgatgcatatggcagggcctccatattctgctggatccatgatgggaccaggtaggggtgctacaacaatatagactctactaactgctgagtacttgatttactagatacaatgggcaaaatttttgagaccatttatgtccttttatgcaaaccttagtgtggccagaatgagattttacaggaaatatccttttgcctgacatttattttctatagctacaggatagaaatgctagtatgcgaagtatgtttctttgggaactaatttactcttctacgctctagcatgtaaacttttataggcaaattagttattaccatatattttttttgggtggttgttgcagtttatgaattaaatgcatacgagataaaaattaaaaagttaccaactctttgtgaatatgtgtcctgactcgtgtgagactattcctcacattttttctcttatccattttcctgtcctcaaaataggtggaatgtatgggatgcccatggacagatatagcttgggcttacctgctggtcctggtccaatggtaaacttttctggattattagtatttgctcatgcatattagcatgattcaattgtttttcccttgcataacaaactattgtgggatgttgtcagtggtcactctgtgctctgtgggtctaactgtcgaagggcttcctttaagtgtcctttgatattatagtgtgataaatcacgataggaaatgtttcaactctcatttatacaattctttgatgaagggcgcgagggctggttcatattccgaggaaggatcccagaagaagcctgcaggtatatattttcaaatgaattttgactgttcattgattttgttgtccattggtttatttttcttatgaactttattttaggagctgggcgtgataatgattggaaatgccctaattgcaacaacattaactttgcattccggacagtctgtaacatgagaaagtgcaatacaccaagacctgaaaaccaggtacaattctccacttcttgtacttgtgcaagttcccacctattgtattactactactaaattatgaaatatctttctttctataaatctaaaattggtcaaagtttatgtgcaaattctgataatgaataaatatttttgatttgcttactaaaaggtgtactgcaatatactaacatcgtaatcatgcttaaagttgaccttgttgccacaagattagcaatgtgacagccgtttatattcgatgctatagtaactggtctgaactgttcattaaaacctcatgccatgcaattcaacacaatttgcttgtgccatgtattaagttgcccattgtttgggcaccaggacctaaggtattaagttgcccatttcgtgtgaactgtcattgttttctcctcaaaacaagatgtactaaatttctctccatttggcaaatctggaacctatacttagcaatacatcgtccactcagccttagccattaatcaagtcacagctgacatgcagtaacaaaccggcgattttcagtactgctatattaactgtgttctgggaagtctgtagcgtgtcaaagtattctaaaatagtttgagctgttctcttcgtaatttcactttcatctatcttctgaaattgttcctcatgctttgacttctcttgtttttcctagagttaaaccatcatgcttactttgctgatagcttgtgtgtcaactcttatgcaggggtccaaacctgatggtgcaagaggtccaagtaagtttaacactaactatgcatacatgcggtgccttgtttgtaaaattttttagtgtacctttagtacctcgaaaccagtaaaattctgagatcaatgccatcttatttccacattgcataagttatgcgtgtcacttagcactagttcttgtaatggctttgtcctttttaattctatataatctttacatctaatatttcatggcagaaccaaagatgccagaaggtagttggaagtgcgagaagtgcaataacataaactatccattccgcacaaaatgtaaccgtccaagttgcgaggctgaaaagccatttcagacaaacaatgctaatgagtcatctgctgatcaggacaatcaggtgcataattagaaccttcagtatgatcatcattatatgccatgcctttctttagaacaattcaatataaatggcatatcttatgtttctatcaacaagnttcgttatttggcttgtcttcatcatctcttgtgcatggcttgatatatcatgtccttactgtacagtgagtccttagaacagtatgagggtcaagaaggtcaagcgtcgtcgtcaaggtcagtctgagatgtctgggtctatctgtgtcagtagtcgctgctgtatccccttgagaccttagttgagtcgtcgtcctaatggtaancgttttggagtggcaactgaagtcatggatttctttattgctacagattttggttaagaacatcccttgtgaatttgtcatatacttctgaagcttggttgctttgtcttggttactggtactctgggaaaatggcaatttatgatataaatttcaattagctatctgtgtcttagattgctacctgtgtgctatgaagtactattagactgttcattgcggtctcagttttgtcaattgtgtttgtggtctttgtttcaacgtaagggtttggtatctcagataagttggttcttgctgatgcctatatcttttttacccgttttaaaaattttcgagaggatcttggaaggtagattctcagtttctcactatatgtttgcgtggcatcctcttcacaagtttctctccacattttctttttgtactgaaaattgatttggagagcctctctggtgctattgtttgaagtagcaattgggtctaagaaacaagttagctcggtaaccatggaattgatacctctgtgtcagtatatcactatttcatcaacggtatcagcctttggaataaataaaaaatgaacttgatctaggtt

SEQ ID NO: 4433 - DNA, 6847 bp, Oryza sativa
cccttctgtcctcccacaatgttggtatattggttaggagacctataaaaccattgtctgaggttaatcaggttcatttgaaccatggaccttagcttagtttccatcgttgtcaatggattgactcctacagccaatgtagaaattaattgaaaaactatgattatcccagtgctcagaagttctataagtccctattgtttgcttttacatgtgtacggcaaataggcatgcatgttactttctgccagactcgtagagctcatggaatcctgttatatgttatcatgttatctgtagcttagcattttcaagttaccccattctgatgtgcttgattcaaagagagggcccttgatgaaacaatgaatccatgtgcatcatcacattgtggagtggtagactgggtaccattgcatgcttggttcgactctgactactcgactgactggatgtcattaaaattagttgttgtcatgtaatattgtgaagcttttatcaaagctgcaactttcacatgactttcaagacaataatgagcaaacaaaggtggatcctcccggtggccctgctggagtaccgacaagttcgcacgccctgcgaatggcagctctcagtgagttgcagaacagtgttaagagctgatacccttttcattttccaaacaaggtgagaactttgatccatgtggatgtgcttctatcaggagcagctgacagtattgcatgcagtgatcttgctaaggaagttggagatgggaaacatcgtgtgatggccagccttgatgtaagaatgcaaatcagtcttactccgtaccatatctgtgtggagtgtgcacaccggaagcatagtcattttttgaatggtcgattgcttcttccacagtaaagtctataataccagtgtgcaggtgtttttttccctttctttcagtgtgaaggtgtttttttacccctttctttcgttcattcattctttttctttttccttgttgagacggtatcctggagcactttgtaatactctaatgtgcttcggaaagtagaatataagttgtgcttatgggcgggccaaaatgctttggccgttagttgcatgacagcctttccaacatgctgctgcctagccgtagttctcccaaaaatgaaaccatcttgagatccgtttgcggttgaactgaaattagacggtatctctggtttcaacatcatcctttaaaccctggatgaaagatttgcaatattcctgcggaaatctcaacgttcttgcctatttgtttgcggtttcgagtttcgagtatacgtagaaacggaagccggaacatgcaccacgctactcttcaactctatcaagttcatctgaaagtttacgcggcatgccgccatgttcttcgtgacgaggactcagcggccaacgcaaatcagtattcaggtgcttaggtaaagcttttttatctttgggtgcttcttgcaccgatcgatgagatgtgctaagaaccacatatatttgatggcattttgcggtactatgtttagtatgaacatccatctttcaccaaccgattgatttataaggagtaatagtttgcaaccaacaacatcagtagtagggaggccaaaggtgttgtcatgcaggaaagggaggcggtggagcggcgctcaacaatacacatggtgcagcaatgcgtcatgttgcactcgtgcaatggacacgcactaaaaatgtttcttatggctagtcaaaattctccaggaaaatacatttcaaccataatagaaaggtcctaaatgccacaaccaaaacaaggagtcaatgcatgtagattcaaaagaaaaggacgataaatttcatggccaaagtaggaatacttgttataacattaacaatatatttcaattagctacgatgacagtggattaaattataaaaaataaatctacaatttcgttagaaccctcttattactgacacacgaggcccacgagtcatacataacctacttgcaatgtgacacttctcatcatttcgcttccatctagtagagtttgtatggcatataagccaggtgtttaagtgacaagagggtctggagagttacagttttatgataattttattttgtattatcgtagctatctaaaatatgtcatttatattgcagcaagttgatagtttaatcattaaatatgtagtaatctgaaattttcccaataaataaataaataaaggggccctgtacctaacattgcacatgtggagatataacataggcaaacccataaaattgcataatagatggatgctcattaaataccctaagaaaaaagaataggtaataactaataatatcctcaagatgatatacatgtccagaagatacattgatagagtatgaagtaaccaatcttcaagatatttagtattgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaatttccaacattttctgcgccacctgttctctgacaaaatggtaatccacttctatgtgttttgttctagcatgaaacacaggatttgctgacaaataggtagctccaatattatcacaccataattgagaaggtcctggatgcaacaaaccaatctcttctagcaatttacgaacccacattacctcagcagttgcattagccaaggctttatattcggcttcagtactagagcgtgatacagaagcttgcttcctggcactccaggatatcaaatttgatcccagaaatactgcaaaacccccagtagatctcctgtcatctagacatcctgcccagtctgcatcagagaaagcactaacaatataagaaaaggatttgtcaatctttaatcctagaccaagagtaccttgcagatatctaagtattctctttactgctgcccaatgtacaatagtaggattctgtaagaactgacacactttattaactgagaaagatatgtctggtcttgtaagagttaagtactgtagagccccaacgatactcctgtactgactggcatcatttgcacccaaaaattcaccatcatttaaccacagtttttcagacacacagagaggagtactcacaggcttacaattactcattccagttctcttaataatatcacctgcatacctttcctgtgtcaacagcagacctttctcagttttctttacttcaattcccagaaagtagtgcagatccccaagatctttcagagcaaaatctttctcaagttccttgagtaaaactgtaactgcttgaccagaagagctagcaactataatatcatcaacatatacaagcagaaacataacaagtcccttcttattatagaagaacaaagatgtatcagccttagatgaaacaaaaccaagttcttgtagccttttactcaacctggagtaccaagctctaggtgcctgttttaagccatacagagccttatccaacttacagagatagtgtggcatctttttctcctcgtatcttggtggctgcctcatgtacacatcttcttcaagatagccatgcaagaaggcattctgtacatcaagctgtcgaagactccatccctgtgacacagccagtgacagaacaagtctaatagtagcagccttaactacaggactgaaggtatcctcataagcaataccataacgttgtttaaaaccctttgctactaacctagctttatatctatctatagttccatctgcctttcttttaatcttatagacccacttacaatctattacattcaccccctgctttggtggaactaggtgccaggttttatttctcactaaagcagcaaactcgctatccatagctgacttccaattagtattacttaaagcctcttggagattacctggttctcctgtatgtgtgagtcctgcataccttactgtgccatctgtgtacttctttggtttgtggataccacgctgtgctctggtcactggtcgagtcggctgagcggcaaactgagcactatcatcatcatgcgatgtggaagaagcaggagctgatgcagacgtgtcttgatcctcctgcgacgtgtcttgatcctcctgcgatggcccacgtgaacccggtcccacaatgtctcccgacagagacgaggctgccgcgtgtgacgacgcgattggcgcggttgccgcgtgtggcgcggccgagggactcgctgcgtgtcgcggcgtgaccggttctgcagatcgagatgacgccgagttctcctggtccgcctggttctccgtgccatgcatggtactgtgcgtcagagagtcatgatggccgccggtaggttgcccgccggaactctgcatgaaatcatggccgtgctgcgcccctgattttgctccattgcctgcactgctgcctgcactattctcaataattggattagcaggattagaatcatcaatcagcggttgatcatgcatctgtacacccccgtgatcaagcagcggaagaagatgcgccgggaggagattgatctcagcccggaggcgagcaccggcgttgggatgaagtttttcaaagggatagatttgctcgtcaaagacaacatcacgggaaatatacacacgccctgtagagatgtctaggcacttaaaacctttgtgaagcgtgctataacccagaaaagcacactgtttagaacggaaagctaatttgcgggcgttgtagggacgcagattcggccagcaggcacagccgaaggtgcgaagcagagaataatctgggggcaggttaaacagacgttgtagaggggtctcaaagtttatcactttggttggggtcctgtttatgaggtaagcagcggtggtgaaggcctcatcccagaatttgagaggcatggaggcatgagctaacaacgagagcccgacctcaacgatgtgacggtgtttgcgcttcgcagaaccgttctgctgatgcgcatagggacaggcaacgtagtgttcaatcccatgcgctgaaagaaggattaaaacgttgtattcccccgcccaatccgtctgcacagttttgatttttctattcgtcaagcgtcaaacagggttttgaaaatcctgaacttggcaaaaacctcagatttgtgtttaaggagatagatccaagtgaatttgctaaagtcatcgatgaaactaacataataaactttattgccaacagagtttatagcaggaccccatacatcggaaaacacaagttgcaaaggttcaatagaaacactactggacttagggtagggtagctgatggctcttgcctttctggcaagcatcacacacaaactcttgactagaatccctaacaactgggagattattttggctaatgacgcgattgacaacagaaaaagaagggtgccctaatctactgtgccaccggaaaagagagggcttgacaacaccaaaagcctgcttgttggagatggtttggagcttgtctgttggcagaggatagaggccggatctacacctgcctcgaaggagtggcatcctcgttacctgatccttaaccaaaaagaagaaaggatgaagttcaacaaatgttttattgtcacgagtaaagcgatgggcagaaacaaggcttttgcatgcatcaggaacatggaggacgtttttcaacgttagatcacgagtaggggtacgaattgcagtatgaccaacatgatcgatattcatacctgcgccactagcattgtggacttgatcattgccggtgtatttgtccttcaccatgagcttctccatctctccagtgatgtggtcggtggcgccgctgtcgatgtaccacttcgtgtcgatgccgtaggagttcactgcagcagtgttggcgttcttctcttcaccggtgaaagagggatcaaacctcttccagcacttggcgacgatgtggccgatcttgccgcagagttggcacgtcggcttgggcttgccgtcattacgaccgcgcccgaagctgccgccacgtcaagggttgccgccgccgcgccctctgccatcacgaccgcctccggctcgtcctcctcgcgacgcggtgttggcagaaggattggccgcgttctggagaagttccagccgcgactcaaagccaaccaggagcgcatagacatcgctcacagagattggaccggtgcgtcccgtgactgacgagaccaccgagttgtagtcgaaatccagcccggcaagaatgtaggagatgagctcctcatcatcaactggttttcctgcagaagccatgtcatccgcaagagatttcatcttaccgacatactccgccatgctccggtttcctttcacggtggtggagagcgccatgcgagtgttgaggatgcgggcgcgagattgagatgcgaagaggctctcaattgcctccatctgccgccgttgtgagtgttgccacctgagtgagcacctcacgcgacagagacgacagcaggtagctgagaacctgctgttcctgcgccttccattgcaccagcgccggatttgccaccttctcggtggtcttgccatcgtccttggtgatgatgatcgttgcagccggtgcctgattgctcccgtcgagaagccgg

SEQ ID NO: 4434 - DNA, 2173 bp, Oryza sativa
gattgattggtggagggtggaaggctctgataccatgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacaagtatgatgataaaccaacgataataatggaaatcgatatacatactctggtacaagagtcaaactgcgccgatcgatgggagtgacgcggtagtaggcgtcaatacggagcgttggggttatacgtacgtgtatactacatatctgcaagcacataattaatcctcatatcttcaaacgcgagcaaagacagtactactcccttcatccgattcgatattcttaattttttggagaacgacataatttttgaagtatatctttaactatattgtctattatgacatatacaataaataaatacaaataagtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaatttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccccgcctttaaaacccgcctccgatcccctctcccccaacaccatctcctcctcgtcatcgtcatcgtcttcctcctcgcgtcgccgatcacctcgccatggtgccgccggcggcgcacgcgccgaagaacctggggctgaggggggtgcgccgccg

SEQ ID NO: 4435 - DNA, 14264 bp, Oryza sativa
  unsure (1)..(14264): unsure at all n locations
ggtcgccgctttgatcgccattgttcagcaaggagagtgaccatatctacaacttcttagctagctagttacaccttctatgtagcatgtgtactatgcacttttgtggttgtgttgtgctgtcctaatggtgtaactagccatatcaaggaagacatgcatgatctagagtctagagtactctagccatggaataaattaacttagtctgtacttggtcatgcaccttgtgtatgatccttgtgtaagagaagtgtaataatcggttcttgaaaaggaactgttgttatatatgagatggatgttgtcatgaaatggaaatttgcagttgtttctctttgcaatccggtgtgattttgtagtggaaattaacagaggaagaaaggagaaaaagaggcgcgaaatcgacccatggcgcgaaagtttgaatttgaaaatttttgagtggaatgtttaattttgcggtataactttcttacaattcattctgggggatgacagaagcattctatatgaagatactagctatcatgaacatatgtgaactttggcagggtcgaatgtgaattaatcaattacccttttcatatgctagcttggagtatatatatggggtcaaaatctcatgcatgtaaataagtccaaggattatgaagcacatatataaatgcatgaactgaacatatatgaaaacaaatctagccataatgagttgtaccatcaaagtctatagaatcaagaacttgtgttaaagagcagaagggctttcatgttaaagagcagaagggctttcattagaatgactgatgtcttttttcttcctattttccactctatccggaggaagatagtacaagagatttaggcaagggctgcaagagatttttttaaaacttttttttgaagagattttttaaaactagctagatagaaagtgaaagaaccaaattaataatggaattcccgtttcatcataaacaaaagtaatggactcctctcaccgagcgctcacgtgaacattatagtcataattttgagccgaaaaaccccttcaaaatatgctacgtatagtacaaaaccatatatattgttcagtccgatatttgccatgttttttccttctttttaagcttgtgttaagggaggggactcactcgcgtggtgtacgtgtgtctttgatgtctctgtgtaatcatacttgtaagttcatgtatttcacattttgtttgaaaaacatatatagtgttaacaagtttcaagcagagttgcaattaaagttaccgtttcttttttactagttgagacatgtccaagattgatgcaactacagatgtgggtgaggtcaggaaatgatggcatctacctatcctgaagatgtcatgcacaaataaataagtactctactgatgagtctactcatcaattgcaagcagttttggtttatgctaattttcaaacacatcaatcattcagctatatctctcttttgtactcgtgtgcacgtcattctagctttggggccttggacaccacaccgtgcatgctggtagcgggtagcctcgaatcgaacggcaataatatccctctgtatcattttgtaataataatatttatataatttgtatatgtacttccatcagcaatccgttgtagtctagctggttaggatactcggctctcacccgagagacccgggttcgagtcccggcaacggaatttctttttggtttcataattgttgaaagattatttgttaacttttttgtggttttttttatctccgatgtatgatcaatgaatccaaaattcttgaaagattattggttttcagattcagatgtttgttacttcaccttttcatctcttctccgatgtatgatcatgtagtgcgatcaaaaaattgttgaaagattattcgttttcagatgcttgttacttcaccttttcatttctctctctgtgatatatgatcacgcaagctgaaattcctaaaagattattcattttcagatctttgttacttcaccaaaagttctcagtgcaatgtcccttttcctaattcttgagttcgtctttttttacgagaactagtgctgaagaaaacagagattgtaagctgtgcagtttgatgcctgagtttcactgaagcagtcataatggaactatattacaaactgcaatttttagttacatcggcaaccaatttttctccaaaccatccaacatattttctcagaattctttcgtctcgctaaaaatctctgaattcgatgaagccatccgactatgaagcatcgatttcagcagtttctaatgaggaaatttcaggctgctgctgctgaagctgaacccacgaatggtagtctctcagcagctgctcccccagcaagggcacgagcctgtccaggaggccttgcatcagcctgccaaatgttcagttctaatgttaaaccaaaatgaaactggtaatactgaacagtgattcagtttcagtgtaaaagatgtgcttaaacatcttgatggggtgattggattggaatttagttctcatcagcatctggtgagcacttgtgtgtaatttctttgagatattttgccttttttttttactactgaactttcagaaacttcagtgattaatgtagggccttacaggttgcctggtgtctccactgctgacaatggaagcatgctgaatggcttcgtgtaaacctgtaatccacatatgaagaacttcagtgtacgttaaaaaaaaatcagatcatctcttagttccgtagaatcagtaattcagtgagcaaaacggttgaggtgctctgttcatccagatgctgtatcttctcatgtaatatacctccagagtgacctccaaattgacatcaatgtccaagcatggttcctcaccatcgtctttccaagttatatggttgctcataaaagctgcaaacatcaaacctctaaatcagacacacattttattttgttgccccggaaaggaagttcagagttcagagttcagactaagcagtaatgattcgcatggttacaatggttagcaaaacagatgattgacaacgatgaattgatgaccaatctactaattgcacagataaatcagatgtctccactcaaaactgcaaagaattttcaagaactgcgagccaatcagctaaccgaagaacctgaatttttttacctgaaaagagctcattctgctgctcaactgagcctgaaccctcaaactgccaccaacaaaacgatcaaatcaaaccaagattaaccgtagaatcgatcaattgagcaagtgattgagacatcatgcagagcaattcgcttaattcagtagtaccctgcaggagagcatctcgacggtgcagtcgtggcatgtcggggcgacgcggaggtcgaggacggnggcgacctggaacccgaggaagccgatgctctgcagcgtgcaccggaacgtgttcgcccccggcgcctcgtccaccgcgggaagctctggagcgccctcgtgtccagcagcgactccacgccggcgggctgacgcagaacttcgcngatgccccnaangcngccgccctccaccaccacgatcctctcccgcngcctngcngacagcggcgcccgcntgcccctcgccctcgcngacagcgattggccgtcctcatcgccttcggcttcggcgtgcgcattgccgctcgccgccgcggctcgccatggccggcggcgaccggctgcaacggcggcgacgcttgagattcggaagaggcagcaaggtttggcagccacgagcctcattccatcgtccactcagctgagctcgagctcgcgcatggagtgatgcgaggttggagttggagaggagcagcggcgacggcgagccactgatcagatggcttatcgtgttcgcggtttggccatctctctctgtgcacaagtggagctcgatttgtggtcggctgcgtcgcgttcttgctgtcgcggtcatcgtcttcaacctgttcaccagttcaatctttagttttcgacatttttttcggagggtgcaatatatatcgaatctttagtcttcaacctgttcaccagttcaatctttagttttcgaattttggaaattttgataaattttgttaaatttgaacaaattattaccaaattttaaaaatatttttttggccgaaataatattgtatcgcggatccaatagaaccgaaattttagaaatttcgttccgaaaatttgaaccctgcttaccaccacggattcaccacttccaacctaccaacgccactaccccaactcacacataaaaccacttgtgttttcttatctaaggatgaaaaaggtccgaaaatatggaaaccactttcatagttatatttctttcggaacggaatcgaaaacagtaaagaataaaatgaaaacggtatcgaaaaatattggaaaaaccggaaacgacgtgttggaaaacgataataaatatcaaaaacattgaacggcgaaatcacacatttaactttacatagctatataaaatataataaattcaagattatacaatgtaaattataattgtctctttttttagccatgcacttgatttgggtatggagttgatgggtatcagtcaaataaaaaaaaatgggtcatagatgttgacgtatttacaaatatagggtaatagatggtaattttcatacaattatggtataaaaattcggaaacactcgatataacaataaaatagttttcatttgcatttctatatttttctactatttctatttttaattttgttggcaacaattttcacatagctcagccagtcaaaatcgagaacaagtgtcggtcagtcaggaatttctacgattattttcacccctagtcttatcttctctctcctttcctctttaccatcaaactattctaaattttaattggaacttttaaccatactaattggagtaaaatgctatcctaccaaaatttcaaaagttttctcaatactatcaaaatttaaaaaggcatcaaactaaacacatagtaaaaaactatcaaaattcggtaacactgaatcttgccaaaatttggcaatgttcttgaactgagagcgtattacatcaggccatcaatattcgattctagccacaatcctagccgccggtttccagcccagaattaatttcatttaatttgggcaaaaccctggcttaattctagacacaaacaggctctggtctcttggacccaaattcaacttggataattccgacacaaactctatcgatcgaacgtactcacgtgtacatattccgaggcgatcgatcgatctccacgcgcgacacgacgcgacttgcatacgcagttacgcacgcatgcaggcgagccacctcgccggagattcagcccgttcgacaaccctaccgccggcgagcggcggcgtacgtgcgccggccatgtcgatgtcgaacttcgcgaagatggggtacagcatctgcgggagcttcgcggccggcatctacgtcggcgttaaactgcgcgtgaggcagcaagcggtggagcgctcggaggggaagaagtacatcagcaacatcgagcaaaatctccagagcctcaagaatctgtatgagcgcgtcgagtagccgccgccaccgttcgtcgtcgagacaactgatccggccgccgccgcagctgaggagactcgccggagcaggagagatgccggcgagcattagacgtcatgagaagttcagacatgcatgcaccccgagatgatatatgctataataatattagcaacagatttacacggctgattttcagtctatttaatgattaatcatatatatttgtcccaatttcaatcggcttaattcattcatgatgtgtttttaaatggatgttttttttatgtgttcgattgattgtgttgtttgttacacaccgtacatgcatgatcacattaaagtatgagaatttttactgtacatgcaatttaagccattgatttcgtttgatccaacgggtgagaaagagttgtacctagtagtactgtccacgtgattttacatagcatagagaggtgctaaagaagtaagggtagttaagtaatttcacgtgtatcttcttcatcttcctcctgtcttttctctctccaaaagatgctgcatgcctgcatcgatcgatggctctcaccagggatggataggctagccggagtggaggtggagggggccgacgagcctccgtgcatcacttcccccaagctcgctggtgacatacgcctaccgcggcccttcccctaatctcgctgccggattcgagcacataggcgaccgacgtaggtcctcgtcgcctccgccgccgcgtagcagcctccgatgcaggcgccgccgttcaacaccaccggcgccgaccacccctcctgctcctcgttacctcgccaccatgcagacaccgccggcacccaacgcgccgccgtccaacaccccgccgccgacgcccccggcaccaccggcgccgaccacccctcgtcccgctcccaccacgcccttgctcttggtttggacttgctcagttgctcttggagtcttcgttcacacagtcactcagtcaaagagaaggagcatcacgagctgcttagcgtgagattttcaatcttaccctccgtgaatgaatggccggatttaaattggtacctcaaggtaccggtacctcgaggtacaatatgctggactggagcaatgctcttaaagtatacatgcaagcatggatggaagggcgaagacccaaagacctcctcgtacccctagtctacgcaatttctaagaagaggagagagtccctacaccaaggaaaggagaataatgtctgggtcggagatttagccttggagacaaacccacatatcacagtggccctcgtggagcagcttgtggcctttatggaccgcagtccgtggtgtgtagctagacgaggaagagtctgaccaaatctcatggaagttcacaccccatgactagtacttggcttcgtcggcctataaacacaatgcgttggcgtgctcgacacaacctttgattcattgatctggagggtctgggcgccaggaaaatgcaaactacacgcctggttcatcatcctgaataaagtctggacctctgaccgacttgcgaccaggggatgatagaacaacggacggtgcccactttgtcggggagaggacgaaacggccttgcacctcgtcactaggtgcagatacactaaaaggacggattgggtggccaatcatcagcttgagccttgacactgggagactactcagtcggtcaatgaatggtgggaagtgccagccactttggctggcattcccaagaagggatcccgtaccatgatcctcctcatcgtttgggaaatatgaaaggaatgaaaccagcggatctatgagtacaaggaggccacaacttcgtatcttctcgcgagaataaaggaagaagtcgacatgtggggtttggcgggcgctaagtgccttagtgagcttgttccgcaccttgtatagtgtacagtttttcttggcttttgccttttctttgctcttaggggttgcatttttctcccactttatttaatgaaaaaagcacactctcgtgctggatcgattaaaaataatggagtcgtctttatctgtaactagttgaaaccccgcgcgttgtggcgggcacattagaaaggatgaatatgcatgtaagtatgaataaacatgaataagtgagatataagtgagtagttctgctacctaaccaaacaggaatatagtttagtatagtatacaatttcaaaagtaagcagttctgctatctgatcaattaaagatgatatttgcatcatcaattgctaaaagtgccaagcacaaaaaactcatttcgagtccagggagttggaaatttatagtcacaatgacaacaccattcagatttactggaaacattgcaagcagaatattgttaggaacaccaagatcttcaccagaggataaatataagttgagtgaaacacatgcaaatataaaattaagttttgtttatttgattacagcaaactgtaggtaggtagtaatactatgagctggaaacagtaggaaactgtaaggtctaaatctcattgtttgtgacattttctccatcgagaatgatatgcatgtgaggaagtttatttttcatgtaattcacaacatgagcttgagttggctgcagcttggagaggtcgtcggtggatgatttcccttggagagtgatataaatagctattgatttggatgcagtaatcttggaaactgcttgcaggtagttggtgtggatgagttgcgcctcatggttcctgaagaagagtaatgcgtttgatgatgtatagataggcatatacaatgtacagagcactgaaatgcatgaagcatgttaaatataaaatataagcttgaaaactatgtaattaggaagctatagctgaacctggatagtgagagctaacctatttttttctggttgttggtccatctgtgttggcaatggacgttgtgtttgcagaagaaattttgtgaaggaaggactgtggtatgagaaattgagcagtgcacatgttgttgtggtgttgtgggtgattcttatagtatttcagtggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaatcgttagcagtgatggtgacagatttggtgcaggtctaatttttttaagaaaatctatatatgttgctgataaaaggccatgttgtaggagaattgtgaaggatttgaagagttgtacctgttccttgtgacccgatggctgttgatcagctatctttggctgctgcagctggttttcctctccattggtggaggtttccgttctgaatttagcagtcaaattagtagcaaaacatacatacatacatacatatatatatgcacgcgcgcgacacacacatatatatgtttataggctgaaacttaaggtgtgcacgtacacttttttatggcacttagaattttgtcctggagaaaattctgttgacggttgtttttccttgctgagatctacttgttggggatgataaagttgatttgttgcaacctgaatagtgtttgcaattgctgggctgatgcatatatgaaaggaatttagttgaagaatagtttgtatattctggaaaaagaacttgtatcagtgcagtaccttggttgatcaatgtgtaactccttttcaaattgaagagctctctttgctgaaggtataatttggtttactgtattgttgtctagagttgtttctggaggttgtagggatggtggcgtagtgggatgttggtcttctttgctgctattagttgtagtcataaatatagaaatgttaagcagaatataataagtaaaaaaggcatatgttggttaacctgcaatgttccatggtggttagcccttcatctgttgcaagttgtttggtggctgattcctgaaaaaagttatttttagattatagatggttggtagaagatatggtaaggacaaacatttgtatacctttgctacctttgtattttccagagtaggtagtatcaaacttgtattttcattttcaacgggataactcttcttgaggacataattgatagtgaagtgtgaagagtactttgtattcatggcaatgtgaaacaatcttgttttcccaatggctatatcaagagctatggcatgttctgttgcatcaattttcaagttctgggtagcttgagtagcatttacctcaaccaaatcctcagccacattgtagaatgctactgcgtccaaagttcctgattcatctttaattgttaaaggaagtttgtacctgaaagtttgtttgagtatattagatttgtttatagaaatgtaagacgaattaattaataagaaaaattagtattatagatatgtcacatacattggttttggcatggaatgctgacattgacatcttggagtgtcggagttgctattgtatgatgcagtacatgatttgcatattttgtagtaccaatttgtatatggtactatcgctgatacctttgcaatgcaactgtatgaattccctccctagtgtgtaagaaatattgaaatgattatttaattagattagcaacttatttagtgatgtagtgtgaatgaggtacctcgaaagcagaaatgggcagtcttgatatttcttcaagtttgtatagcttaccagccgcttgaagtggagttaaatgttcaactcgtggcatttgttgttggagagttggaatatcccattggtagcttgaaggaagattgatgcatttttgaagcaaatataaattaaaatcagtatgacaataagctatataagttacctgctttgatattcagcaatctctgttatatcggagtcaaaatatatttgtgttgctgaacttgatgtagcctctgttttgccttttaaaattgtagcacataagtgagtagtgttgtttatgagagggggtattaaaaagttatttgagggactgacctaaataagtccctgctgtaagtccagcaagtatagctactactattttgtggtctgtagatttctgtagaacaaaagcttcatcaaatgaccctccatattcaccccagagaactatttcttgttcttgttcactacaaattggtgaaacaaaaggtataaactactgtgtcatatacatttggaacataaaaatataatgcatatgtgatacatactcttgctacggattttgagccttctgttttactctagacctgatgttttgccagcataatcatatggcccaacatggctgataactcctatcagatctagaggcaaaatgttcgagattagttgtataataattaaataaaagaagatagaaaatgcaagtattacctatcaatggttttgatattccgcttttagatggtatctgatcaaatgggcagaattcaaaaccatagtttgggatggatgaacctcttgattctaggtgatgaacctttgtgctggacttaaactgcaacatgtatttttggtggtggtaaatatattttttgtttttaatgtcaacagtattgacatcaacaaacatgtagacacaacctagagttagtgatggacgaaattcattttcaagtttctttggaatagtaaactgcaccatagtgccctgcaagattagaactggtataagtctaaaactgcatcgttttatcagtaatatttagattggaagttaagcataggataaatcattttttggtgtaggatagtatacctcttcatcaagaattaccccatcgatgttgaatattgttggtgtactggctgaggccatgtttttagcatcccatagtctaataagtcgtccgaaaactttgaggttttgctgtcccaaatttatctgtttgagttttgttgctgatcccatctatggaaatgttcctgaaataagaggtctaaggttagctagtagacaatatcagaaaacatacattgcatataagagataatttgtttacaaaataccttggtaactaattcatatcattgttgaaacggtgaaaaatctcatgatatactacattttgcgtgcaatgttcatttgatgaactattgctgtttataagtatccgcaagccttttggagatgttactcgtgataacgcaacatataattgtccatgagaaaaaactggagatggcaagtatgcaccaactttttgaagtgtttgaccttggcttttgttaattgtcatcgcatatgacaaacgtattggaaattgacgtctttttagcttgaatggccacttagattgggctgatgtcgttataatacgcggtatgtatgcttttgaacctttggcttttccagtcattatttccccttcaatgatgcgggttgtgagctgtgtaacnataagtctagtcccattacagagacctctagaaggatcaaggttacgcaaaagcattatagaaacaccaattttgagatgcaaaacatggtctggaagtccattcaaagatattgtgttgcggaattctgttgggtatagagcctctagagttgaatggtttgcacagctatcatcaatagtatctgagctataatatgaaatttcagcagctgttacttgagcaatgattttgttgtttatttctgaaacaaccttatttgttggtgataaaattgcacgatcacaaaaatatgttgtaatattgcttggttcatatcctaagtcatacacaaaggaaatcaagctatcaagatttctggaatctgagggcaacaaaagagattggggtatctctatgaaagtaccattggtttcattttctattgaaatatgaggctctgtaccatttcctactcttaaaacccaatctgcaaatacccgtagttcttctttatcggatggtgaaaggttttgtgagctaagtctcatattttcagtcagttgaagacctacacattgatgccataagtatgaattaccaatagaagctcgcagaatttggtgccttgttgcattctgaataacaggaagtgtttgccgaaaatctccaccaaatgcaacagttattccaccaaattgcctatgctgtgcattaggtcgaatgtccgataatatatatctaagtgtgtgatctaatgcttcaaaacaatacttgtgattcacaggtgcttcatcccaaacaataagagatgtttgttgaataagttctgctaagtgtgtgttcttctttatactgcacatagaattctcacgtatgtccaaagggattttgaagcgggaatgaggtgttctacctcctggaagtaggagggctgcaattcctgattatgcaacagctaatgcaattttcccttgagttctcacaaagtttaataaagttgtccataagaaagtttttccagttcctccatgtccatacacaaagaatgttcttccctcattatttatgactgagttagaaatagaattgaatatttccttctggtttgtattcagactattgatgtcattagcagatgtagatgcaatgctggtaatatcatagctgagttcatctagtaataatctattatctgcagatgcactaccaatatcatctggaagtggcaaattaaagtgtgataaagaatatccagcatttctcaataatttatccaattcaaataatagggcattgccaacaaaagagtctgcaaatgaactattactttgtgatagattttgatttgttctgtatctaaaatcttcactcatatgctgggcatgttctgtaaaaagcctttgtggatttgtcacctcacaaaacagtaagattgttacaaataactgacgtaactgataaggtaaggcccagtgcactgcatcattgagagcatgggaccactcttggtcatcaccaaggagacctagagcttcacatgcagctcgaaatgttggatgttgctgtccagatatatttctgatttcagagaaggtctttggtcctttaactatatggagtaacatcctcaaataatacttctcccctttggttggatcaacatgagctatacgtccaatcttattgtaacaaccacgacgtatatcccaatatttttcacttgcatgccatgtaaagtattcagggaattcaatatatgtatgctctctagcttgaggaaattgactattagcttctaaccatgcagtaagtttggatttctgatttcctgggttttcaatgacttcttctaggtcatcatcctctgtgtacacaacattattctctaaagggaggtggaccggaaggcgttcaactgatgggtctgtatggtgtatatcaaactgaagtaaacgccaagcaacatcatttggggttacacatcgacattcaagatagttgtctatttcatttatagtttcatttgctgaattacgacgaataccagctctagaacaatcatagacttttgtaacgtacttaaaaagatacttatgcataccatcatg

SEQ ID NO: 4436 - DNA, 606 bp, Oryza sativa
  unsure (1)..(606): unsure at all n locations
aaaacccaaggcgtatatgattctatatgggtagtagtggatcgactaaccaaggtagcacggttcattcccgtaaagaccacctatgaagggaccaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcgtatcacccgcagacagatggacagaccgagcgtctaaatcagatcctggaagatatgcttcgcgcatgtgtcctagatttcgggaagacctgggataagagtctcccctatgctgagttctcctacaataacagctatcaagccagcatacaaatggcaccttatgaagcgttgtatgggcgcaaatgccggacaccgcttttgtgggaccaagttggggaaagccaagtgttcgggactgacatcctgagagaagctgaagctaaagtcagaaccattcgggataatctaaaggtggcacagtnnnnnnnnnnnnnnnnnnnnnnnnnnnnnnnnnnnnnnnnnnnnnnnnnnnnnnnnnnn

SEQ ID NO: 4437 - DNA, 1467 bp, Oryza sativa
cacaaggtaaatttatggttgtgtgatgtattttcattggatgagttgtagcctacataattcatgtagtatgtgcggataaattatgtaggtcttctacctttgtaccattctataccacaacttggacatacagtattatgatatgaattaattaatggctgtttacatattatggtgcttttaaagtatcataagagtgctgttcacagttttattatgtctgtcaattattgaaaaatgtcagcttgacacaatttgagcactctgtttaattacgcagcttggcatgattttagtgtttattttttggagcttactgattttaattttcataattcagagtcataattgtatgcaaaattttgaaattacaggattctgccatacttgtacttaacaagcccccaaaagtgcccatgaagggaaatttgccagtgcataacagcatggatgtgcttgcagcagcagctctgtcatatggaaatgaagaaggtccaaaattggtgagctcaagagtctcttcatcattggtcagcatgtataaccataagcttgcactgaagatttttctcgatggattttgcgttttgaccacaggttcatcgactggacagagaaagtagtggtttgctgttgttcgggagaacaaaagaaagctttactcgattgcattggcttttcactagcgtcaatttagcaaaaacgaattctcaggtaatgaggcaaaatcaattcattgtgcttgtggttaagcaatttttttcatctaaacaacttttatttgctctctgttgttatttgcatgttaattccttaaattgttgacaaatattataggtatggaatgctgcctgtgaagcatacatgcagaggtattgggcattggtgattgggacccctaaagaaagagaagggattatttctgcacctctttcaaaggtgttcccatttacttagtattactctcagtaatgaaccacctaagcatgtaaaagaaaaaagaactgtttcctctctaagtctgagttttttagcttccaatctttttcacttaactttccactatgcagtaatcttagcacttgtgctacgagtaaccatggattggtcaagtcatatgtgccaagttacatgcataataacatatatttttcataaacaggtacttcttgatgatgggaaagccgagcgtgtcattctggcacatccatctggcatagatggtgcacaagaagctgtaacagcatatcgggtgatgggaccaaccattcatgggtgctcatggattgagctacgcccattgacaggccgaaagcatcaggtaccctcaactcaatattatgttctaatgtatcaagataattaagataatatatgttttgatattattagtggcttagtgctactgaatgcctgagttatttcacatgtatacatatgaaatgatgtttctttactgaaaga

SEQ ID NO: 4438 - DNA, 6978 bp, Oryza sativa
cggtgcccgacgccgcgtagtggcacacgaaggcgttgccggtggcggagtcgacggggaggccgtggcgggccatctcccggacggcgtcctccatgagggcgagctcccccgcggcgccgaagcaggtgacggcgagcgggtagagcgcccgcgccgcgccggggtcgcgcgcgcagagctcccgcaccacgaggagcgcctcgtcgcaccggccgagccgcgcgtacgccgggaggagccgcggcgccgcggcgcggaggcgcggcgcggcggagctgtgcaggagctgcgcccacatggaccgcgccgacgcgaagtcgccggcctccgcgtgggcgagcatgagcgccgccgccgcgtcggcgtgcggcggcgcggcccttgggcagtaggcgccgtctcgccgcggcggccgcgcagccgacggcgaggacgggaaggcgagcctcgccggcgagtggagctcgggaaggaggaggcgagcggagggagaggcaggcgagggcagcggccatggtggaagcaggagagaacccatggtgatgatgacgtcacctctttttcttagcttggcttctgctttctgaactgcctcacaaaaagggcagggagaaatggaagcaagatttttgagaggaaaaaaaattcctgggaattggcaattcatgttttcaactttgggttaactgaatccatattattatcaataataatttattcattttcgaaacatgctatattaaaattcgcaatgtttaagttgtgccattacaatttggtttagaagtcttgataaatgcatatacatcgaaggggcaatagtagtggcactgacatgtcccgaatacctgctaaattttaatagcacagcttgaatatcacgaaattataattagcatatttcaaagatggagaaattataatggcggattcaattataatagcgtgccaatcctgtctgcagaatcatcaagatggtgacaaacccagtgtaacaagtttcagtaaaaaaaatgcaggatttggatcatccagcagttcagaattcagagctaacatctcttttcttctgcgctgataatctgatatggcaaaaaatggtcatcttagcctccatattgcaacaaactcaatctgttcatcactgacggcacaaataatcaccaaagataagcagaggatagcagcaggaagctgcaaaacacaaacctttggctacatgataagactagccctctttgcccaaggtgaataatcaatactcagatgggcatcaggagagttacattgatcaatcgcaaattcacattccatcaaatacatctgttactctgttaaggcgagaactacttcgaccaaattagaaaagaaaatggtcaatagtacaacaataataagaagataataacacaattccgcgacaagcagtgaaccggaagaggagcactcactcaaatagtacagaaaccagaaaataggaaccgaaagaggaaggccaggcttgcgccgaacaagccgaacactacaaatgccttcctcctccttaagcacctagttgtagtacataagctgttgcgctgatgactggttcgggtacccgtcgtagagggcctgggagccagcagcaagaagccctgcggatacctgacctgcaaggccatgctggccagcaatctgcccagctgcgacctggcttaaggtaagttgcctctgatatgctacgatatcagctgccgagaaaccttgtggcacacctgccattggtacgggttgatatgaaggaagtggcggtggcaatggcttggaggatgtaccaggtggggtaggtttgttgccccatgagcactaagaaagaacatgggaaattgcataagtaatcatgcaaaaaattgaaagaacagacgaaataatatttatttgaattggacaataccttgatcggcttcccacgcactaccaatccattggccatctgaatagccaatgctgcttcgccatggttactgtatctcacaaacccaaatcctttatcctgttgaacgcgaacttcctcaatagccccaacacctaaattatagaagtggcggtgaagctcatctcggttaacctgacaagttagataagtaaatgatcaatttaaggtgtcctaaaattcgagatgagaagtaattgcagcacactgaggaaagaggaacggtctagcaccaattccagggtaggatatggaataggaaataattagaacataggaagaaagaaaactgggctagcaccagttaatttctacctcatgtccaaggttgccaacatacaccgtagtacaatcagggttgttctctggattctctttacttccggtgtcctgacttgcctccattcctgcagaataaagttgaaaacaattcagaattagcagcgaggactatgtacgtcagtagctcaaattgctattgttaaagagcagctagatatgagtgtatttgctatggatgaaaataatcgtaacaaatgaatgtggttatgcagaaaatacaagttgcagcatcttttcacttcttttgttacaggaagcacttacaagttgcagcagcgtatgcagaaaatacaaatatacatggaaatccggtcatctcagatctttgtgtgttaaatttgatctttctaaggattaacataaaaatacaatgtgggaggtccattgtgtaatattgaagaacatcagggggctcaaaatgcagtgtaagtaaaggtgggataccagattcagaacaataaccaccagcttcggtcttttagaggttgactcaaaagtttatggccatggtgtaccccacatgctatttattcagctgaatataaatataatagtgccttttggtcatgaaactagtaaaacaactaacctggattactagaactaccatttgttagtacaactgcattatggttgtcagtttcttgtttctcttctgcattgttctttgttgcccaattacaccttatttgtctgcttccaagccatttccctattaaagcatattagtttgcaaaagtcaggaagttacaacactggaatgccagtaggttataagaaaaaaaatatattatgagctctgcttgcatgtttaccagtcatttcagttatagcagtctcagcttcctgcattgagaaaaatatcatgagtgataataggacaaaacactaggtgcaactgtaggactggacatcagtttacaaatgaaacttcaggtgataatcaaatttatgttcaagctatgataaatcataaataaaaaagcaaaagaaaaaaaactgacacttggaatttgcataaccttcatacaacagcaaagatcacctatgatacagtttgaatttttggctatggatgaattacataaggaacccgaagagctaaaattagatatacaacaagtaccataaaaaactatttgaatattaaagaatatggaatcataacataaaaagtaatcaaacctaccaataccaaacatgagaacataatattatatctcatctgaaactaacagtaactggtacacaggtggagaatagttcactgaattaaactacaacagcaatagctctaagcctctaacagaacactggttgccaggaaataaaagaaagaacgcaaataggttgtcactcgtcactgtagtatagctaaaacaccagaataataggtagagaataagctgtggaacacacatcacccacgggacaaaaattggtaaacatctgcgaaatggaaaaaggtctgagttgttcatgcctgttgattacggaaggagacaaaaccataacctctggagcgtccggttttgttatcccacatgactcgagcatcactgatcataaatgacacaaatgaaaaactgaaaagctacagcaaaaacaaaaaaaaaaaggtagaaacaaagaaaaagcatgtagtccaaaacgcaacattctaacatgtaatatcatcaattttacaatgggataaagtttatatagaaaattgagccacttgaaatcaagtcagaattacaaggcataagctgcagaatgcagataaaaattatcatatagtttatcatgtcacaaagaactaaggacttacgaacaagaaggatatgctgagaaacaggcataaagagttgcatcattcacttcagaacttaaatcaccaacaaaaatatggaaatgccctggaaatagttcagtgggcacagttaaccaaataagaattaaaattagaaacaaatgaaagacatgtgaggtttttctttaataatatctcaccagatgtatcctccctctgtgtacttgcataagcccagttcaccttgattgcttggccacatctgtgcaaaaaaaagtccataatgaagaaaccctaaaagaaacttgaggctctgaaacctgtgctgttgaagttaatggaacacgggaacttacatgtgacgaccatgaagggtcattattgcaagagccgctgacctccgatcataatagtcaacaaaaccaaaggaagactgtaacgaaaaagtgaattctcatcaaacagatgaatattaacaaaatgcagtaggttctagttattggccctgttcttttcagctacttcattggattgttacggtggattatttgctccaacgactctaaaaatatattttctcaaaaaactttcttctactgtattgcttaaaccacttgctctaagctactacctccatcccaaaatataaggagttttggggttggacatgggtattaagaaagtaggtaaaattcaatgtgtgatggttgtgattggttgagaagagaaggtaggtgaggattttaagaggtggaaggttgtgattggttaagaagggaataaattgttatattttgggacagatgttggaggctagaagttgttatattttgggatggatggagtatttcttaagtttatttctacaaatctttatttgatccctacaatcacgtagataattcactgactaatctgttacaaactgtgccaaaatgtttgatgacatttgaaccaaaatcacaccaagattgttagaaaattaaactaaaattaggtcgggaatgttgtagtgttagaacgtggcgtttctcaaactttcatcaaaccttgggcacagcctttggatgcatgagcaggatgcataaacataccttctccttccggatgagcttgcatctttccacaaggccagaactctggaaaacttcgattagaaggctctcagtaacattagggtgcacattcccaacatacctagttgacacagcatcgttaattagaaaaataaacaaaacttcaaagtagttaactagcaaccatatattatacaaatttctaccaaagaaaaaatcagcatcagccttgatggaagactgtgcataacctaattatgcacgcatgcgtcaccttgtggaattccacattggtcataaaacaaaataagttggcagataagggggaaaatattaaaaaaaaaaggaagttgtataatatatgaaggtgaaagcaggaaaagactgaaagcactcacacactgcgacatgtggatggatcaaaccctggtggaagattgccatttgaaataggctccatctgcaaaacataaaatgtcaaaagaaaaaaaaaacaagactgacgcgaagcaagcacggcaaaacaagatagaaaacaaataagtacaatgaggaaagctaaacttggtaccaaataacataagaagaataggcacccaacattcaaactaaagaggaatcacaccagtagtgcagataagatatacacccacaaagcccatctagcaaaacatagtttctaagtcatctgttatccattaacatcgccatggtgatgtggattgttaagccagccttccaaacctatgttcttcgtgcagcaggtgatgtcgcacaaaaccaggctatttggtgggtcttataagatcgtgccattaggaaccttgaataattggagagtggaagcactagcctaaggagatacggaaagcattttgattaaacagattttagtatgcaccaagaatgtacactgagccaatgaggtaagggggacagcttacaaaaagttaaactctcccagattcataacaaatgcaataattttatacaataattacattcgatgtgaatatgaatagcatataggcaagtaaacatgatatgatcactttccccagaaattgtaaaggaagtgaaaacccaattcttccaagccatgtttcatcacggccaactcaaagtttgtctctcttttttcaccaaactaacctaacaattagcagttagcacgacatttgccatgaataatgacatgcaccttttatgcaactaaagacaacacatcacttgctcaattccaaataacaaagaaactctagttttcaagtgagagcctcctctaactactcaatcaatcaagatgcaacctaaaaaaaaggaggaggaatgcacaaagcaaaacaacaatcctcctggggctcgcgcggcagatcggcgcgcattactgctccccgacacgcgcacgcaatggcacgaacaaacagatcaagaagagagggggggaaacgggagaggggctgacctgggtcatggccgccgcggcggcggcggcgaggacgccggactggtactgctgctgctgctgcagcgcctgctgcatcaggagggcctgctgctgctgctgctgcctgagccgctgctgctgctgctgctgctgctggtggttcccgccggcgccgttcatctcctccccctccgactccgactccgactccggcggcgacggcgacgcggcgaagaccggatcgggaccccgggaaccgagggttcgcaaggaacgatcgacagatcgggggaatggatcgagcggatcgagagattccggggcgaatttcttgcggggatcg

SEQ ID NO: 4439 - DNA, 27604 bp, Oryza sativa
  unsure (1)..(27604): unsure at all n locations
aggaaggtgagatttttctcgttttcttcctctctttttttcttttcttttttttttcgctcgcctctgttttttttctcctcctcgtcgagctccaatggaggttagagagggggagggtaagttggggattttcccctgtgtaggagtctaggagatggcatggaccttacactgacaggtgggcccggtttttttcccctggctctgaagcctgaatctgcatggtcacttgtggtcaggtggtcaggttaagacttaagaatatggatgtggtattgtggataggtttcaaaaattttaaaaggaattcgctatagtaggtaatatttgttttgtccaaatattacatatttggttcatatttatcttaagatttatatacccacggtggatagggtttgatgtttggttagacggatgtgacatacctgtggtagatctcagctcaaattgggccagagaatgagattttacgaaagaaattatattggaatttacttagggaaagataaatttttaagtcccattaaaagatgcttgagatgaaccatggctctggttttcaaacgattcggaaaaatttggtcttttgcttttcacgggaattagagccaaattattacatgatttacagcacattcgtttacattacaaagaaaagagaaagccaacatagttcgaatgataagacgttgttaaaagcaaatgctattgctaaatccccatccataattagcaaaaggttgcataatcatcatatttaggtaacagcacaagtccgatatcatttgtttgtcattttcgcacttttgcaacatggcccaaaaccaaagacaatgtgtgtctcttgtaaagtatctacatataaaatttaatagaaaagttatccgaaatcatctcattgcgacttaaccatatagcctagcatattccagatgtcccggctaatattgtctctaatgatggtgatatctaaggtaggattacagtgtatgattgcttatttttgggaccaacttcataaacataggttaatagattgcattaatgatttaaagaagaatgtcaaattacttaaacatacatttactcacaaatactctatgtctttttcatgtagctatatgtcttttaagtctagcggatgaacgcaacaaaagatgttatcatcccataaatgtgatgcatatgcatacatttttatcagtactaagggcctgtttagatcccctggcaaaattttcaccccgtcacatcgaaatgtttggacacatacatggagtattaaatataaacgaaaaaataactaattacacagattgcgtgtaaattgcgagacgaatcttttaagcctaattgctctatgatttgacaatatggtactacagtaaatatttgctaatgacggattaattaggcttaataaattcatctcacagtttacatgcgaaatctgtaatttgttttgttattagtctacgtttaatatttcaaatgtgtgtccatatattcgatgtgacacgccaaaactttacacccatggatctaaacaccccctaaactttttatatgccatgttataacctcaatacatatttatccaaataataccttaaatattccttaaaaaaattatccaacgtcccaaataacggaactaggtattttaatgtcgaaattttaccatttggttcaaataacaacctccttactagtgtcttgcggcattgtccatgtgatgaatgagtggtttttccataatattagccagtttggagatagggcatcctttggaatggaaaagctcaactggttaggttcattgtggtggaacctgtccacccgtgttcaagttctagatttgctcgcatttatgactatttattcttcagtgatagatgatatactcatcgacaacaagacacccgtagtgacttcgtcaatctcaagatatgtcagcctagtcttccagaggttctcaagatattacggtcttgtttttcggtgatgctcatagcaataggatgtgcgttcgtaggggtgttctcattatatgacgacctagtttttcggagatgctcgtagcgatagggtgtgcgtttattggggtgagtgtgcgagcgttgtgagcgtctacgtatgtaccgtatttcaaaaaaaaaaaggaattttctaagagcaattttatgggaatcaatccagattatgtaaaattcatgcctcccaaataagctctaaaatttgaagtcacacctctcccgcgattcatggatccatccaatatagtcaccaaaaaacgaagtataatcttccaattccaattccactcttgtcattgttggtattaacaagaaaagtacatggcaccaacacgaaaatggcgatcgaatatacctctacaaactttaaatgaacaaacaatgatttagatagctcacaacatgaaaacggcgatccaatatacctctacaaactctaaatgaacagataaataattcatctggatggctcaccaggggcctattttacaacgaaacgctaacaatcagtgcatcctggtgatgatgttctgatcgacaggtgaaacaattgtttccatgattctgggcttacttgcttcacatgcttctccataacatcacagcagataccagtaagccatattatgttttcaatacaaaatattgacactcaaacaataattgctgctgctccacacatgaacaaaagtgaaattacacaacagataaccagagaagaagaatgtactcctgcccagtatgtttgggacaaccagttttcctcttggctgctgatacgccatatttccaccttaagcttaaagtctttttaaaaagaagggaaagcaggtccgttccatatggtgcagataaataatgtagtgaacaagggaaccttaggaaaacaacggcacagtgcttaccccatattaaccttggaaagatatattttgcaggacaatgcatcgacaataccttttcttttctcgaaaacatcagcaggactcatatggaacatgttaagcgaaagatgatctgtagtatatatttttattttgaaggtattaccaccaatgtcaaagaccagtagacgtcataatgtttcagaggcatgaaaacaaaattattggttgaagtggtgtacaacaaaatgtaccgtgaaaagaaattcaatagctaacataagaagtctagcatcaattttgttttttgagaagaattcagacattaaggctaaattgatctaggacatgacaaggtttctagtgtcttcatgagactgtttacgtcgcataatgtttaaaaggacagaaaaatcttcatgcacatatatacctgtaatatgataaatatcaagaggaaaccatatcgttttagctgttattgttgtactcagatgctctcttcttttagatgtcagatgtatcattttgcattgcattgacattaacaagatctgtttggcagaggtgtgctacatatatcacgacaaaatattcatcttgggaagcaagcgattttgtaatgatatctcaattgttgctattacctgttcagttaaataagatctgaaatacagcagtaaatactcaggaagagctgaggaatctggggtatcaaatccagtggctggctcaaatggacttcttcatttgagataagaacagtgaaatactatagccgtctgaatagtatgcaaacaaatccaaacaaaataacttctggacagatgttgtggaggccaattggagcaacaatacagtgacttggaatgtcagattctcgttatgtgttccaaaaaatccccagctaatttcctcaattttgtcagaacgcttcctgaactatcagcaaggatagtttcaactggtgacactgtggcaacaaggacaaaattttcaccattactgacatttatttcatacaactcagagaagacatggcgaagaacatcaatcaaccctttgtagaaggatccatctgcagcaggagggataacattcaatatgaaagccccatcacgatgtaggatcgtgcgtgaagcaagaagaatgctttcctttgtcatctccaacggtggtgcactgactccacatatagcatcagatgaatcaagatccaccataatcgcactgaaattcatatcagggtccccttgatgagcaaaatcctggatcatttgaatagcatcaccaacacggacttgaaggaactcatcctctaccaatccaaaatggctccttgcaacatccagcacaacaccatcagcctctatccctagtacatcacactgaagccccattctgattgacatcagaagagcgccgccaccgataccagcacaaagacacctcggcttgccacccaaccgaaagctctcatccatggaaggggcgatcaccgcaagaccagcggccattgcctgtaggtaaggctggaccagctctccacccacctcaggctgcaatgaaccacctccaacctcatccaatgcatctaacatcaaagaatcacccggcgataattgccgcacaaggcgcacctgcgtctgaacaaggaacggcatccgcttgaaccgcaatcggcggcgcaattcagccgaacgtggcgcgcagtcgacggccacatcctcaacaaccatctcaccaaccacaggaccagcgacaaccttgacaggagcaagccggaggaggtcatcatggaaggagagcaatggcacgtcagggatagcatcgcccccaaacgcggcacgggggcatagagccaggaggagtgggagcagccgcgcgtgagcaggatccgggtccgggcgagcggcggcggcgacgaccaccacccgagaaggagacggcgcggagagctcggggccgacgaggatgaggcgggagaggtggctgcactgggagcgggaggcgaggaggaggtgcaggtggccggcgcgggtggagaagatccagtcgcggtgccgccccgccggcacgagcatcgccgccgtgcgcggcgacgggtggggtgaggagtggtcgagaaccgccacgcggaggaactcatggccgccatgggcgtacgggtcggaggcgtggtcnaggaggaggagagggtttgggaaagagaaggcgatgaagcgggagggctccacgtnctgcaagcccttcagcttcgagctgaccgncattgcagagagagagatctcgagcaaccaagaaacccaagcaggaggagcaatcgcgcgcgtncaaatttctcgacgagggtttcgtttctcctccgattgggggagtatcgcgaagattctaatggcggggagagagggttgacctgagattccgtcccgtgcagccgccgccggcgagggagtcgacggggctcgcggcggcgccggcgccggcggcgacgaaaaatcgcctggagctgtgagctgagggtttcctctgtcactgtgttgtgggaccactaggtcagtgagaaacaaatatcatatgatatatttaccgttcttaaattaggtgtatttgaccccatgttttgagtattttctatgttcagtttaaaattatgttcccgttgatggaattggtacagtatcttccaaaatccattcttcggaagaagattgtaagcagtaatgcttattaacaacaacaaaggaaaattatgtaaaacttagtgtatgtgatcttagcgatttaaaaattaatgctggaaaatgaactacgataaaagaaacaaacaaatctaaaattaagttttaaacttcaaatattggttgtggctcataagatgaagagcaaatgataaagctgttggtcatctcatataacgaatgaagtcaggcagcatatgatagaaagaatttagagaaatgacatgatgaaaagtcccttagcaatatttgcaataagaatttggtactaatttattgaaatatttcgtatccccaaatgtacaactcaacactagctcccaaagactgtagaaaactctcatacaaatacatgatcagcgattcctcatgtataaaatgttgttttttttacccatttagatctgtaacagcttacagatggtgatatctgacaatctccattctgcagcttatacagcagcaatatatacactgtagtatagacatatggacgggctatacaagagggtaacaaggccataaaaacatacagagaattagcacatctacaagactgcaacagagacaatagtctgaataatggagtaaacttataaatggaggcttctgggcactccaacacagccttcctcttgtatccatatttattgagttttcttgtcgataaatttactgtaagctcaaagtttcgaagccaaaattatcattgcctactaccatcctttgcactgtcatgagactaacagtcaaaaaaaagtcggtcttgaggcgacagcaactacagtatgtatgtaaagtgggttttgatcagtttctacattctagtcgccggttatcctccagggatgacccccatcagagctgctgcaagcttggttgggtagaaagctgtctccaaagtcgccgactaatctcatctgcatttcttcctgtggagaaagaatcctgatacatcgtacacatttcacaaagtccctgcacatgcaaagccatcggttcttagttatcaccgtgatacaattagaaatagctatactttgataggtgaataagtatgatcagttgaaaaaaatggagcctcgttatatttcccaatcaggtaagtggtgagatcactgcagaaaatatgcttgattggttttacgtaacacagagttgcttttagagtctctctacatgttttaacaggtaaagtaaatattcagctggagttagaaaacattctatggcatgtgaaactaacaagcagggatgtacagatctttgcgtgttagtgaaactaagctcacaaacaataaatccagaatctatatgaagttgctccaagatcatgttcactcaaatcagctaaccccatccatgggtttatcttcggtaaaaaaaaagatccacgcctccagaaagatattattgttagttttgtatgtgcagatgaaaaataagtttatgggatttgacttactcccatggatcatcaccaactagtagaacatccttctcgtgatcttcatatactagcttccagccaactctattttgatcaccaagctgcccctcaataccaaacatccgagcaacgtcatgtttcagctcatcatatccagaatatcgattgatgtcaattgatcttcccaccgcaccacgcttgtgtacctgtagataattattttggtcagcacaggtgtccactgcaataatcatcaacatgtgcaattatttcatgaatcttagttaagagtcatcctaagattgtaacttaactcgaaatttttttctaaaaaagatggtgtaaagtaacaagttgaggctaagctagataacaaaccttggtgtaggttctcatccgttgatgtgcaggacctgctgcagaccgggaatttctatttaagaatggggtatcattgattgcagaatctatagaattgaatgccatatcagcaactccaaatgaatgtgaaatcattgaagatgataactcttgttgagaatcctttgatgaaatgaagttagaaatgccatttcctggcaactgatccatgtatttatcggttccaatgtcattcgcaagcaggtctgcattaagtggtaaacccagttgaccatcaatattcaccccaaatagaaggttatttcttggatctgtaacctcaaactcgctatctggaactgtgtcttttagcaagtgatgctggtggaaggatgaaggtggaaagttttgttgcaatgatccatcagcctgggaaaggcaaaccgaagtagctgaagaggatgtgtccaagtaatccatttgaggattgttatttatgcagtcttgtccagtagctggcctttgttctgtcgtcttgggaatcataactgtttgctttacattttgatatggctttgtgtcctgttcgatcgtaggacccaacacaacagatgattgagatgtctttcctgctgtagttaaactttggttcttggagctacttgggatggattgcagaagaacaggattgctgttagtggatggtgatgttgaagtagacggaacatcatctgtcttcaataattggcgtccaccagctacatgcaaagaactagcacccatggaagtagcgatgtctgattttgaattaggaatgacattcccagttaagtcttgaacttggtgagactgaaccttttgctgtgtcgggtattgaatagtgttactgttatgtaaactaatagcttggtttgttacctgtacacactgctgaggagctgactgtgaatttatcacttgctgctgcaaatccaaaagcatcttctgctgctctgagatcagaggctgctgtggctgtaaagccttgagtagttgtagtttcatttgatgatctgccacctgcgtattcatacttgcatccatggaaacatgaacaggttgtatctttatttgctgatgttcctgtactgactgctgaacctgctggacaggttgcaactgttgtgtttgctgctgctgatgatgtaactgttgcggtatctgctggtgctgcacatgtggctgttgctgctggagaagctggatttgttgaagacctccttgtaagacagtgtgactttggaccgaaggttgcgtttgctggagttgggcctggacaacaacttgaggttgctgcagttgcgcctggagaatgacttgcggttgctgaagctgagcctgaacaacaagctgaggctgtggaatgtttatgtttggctggctgccttgcactggttgagtaaccacatgctgcctttgttcagagttgcaatcctgaaccaccttctgcggtattataacacttcccaattggtttggtgtagggataactttcgctaattgttctgtctgttggttttgttgaggtaccaacgcagtgttgaactggatgttgttttgttgcaagaactgcgggtgaaaactgatttgccttgataaatcagctgcagccaaattttgtacaggttttccacttaatgagtttagtaactctggttgcacaaccgtgccaggaagcgaggagctgtgctgcatgttcatccactgagctagatttagaccaggcactacactgttctgaatattcagatctttcttgcaaatctcctcaccaacccatggcatggccctcttgagaagaccgtccatttcagtctcgtcatctacagatgtgattaaattattataagataatgaaatcataattttctgttagaactgatattcagtcgaaaactttggttacacaataatcatagtctgatatgagtactaatcatccatagagtgaccttttatcagatcagtaactgtttacctgtcatcccaggtagccttggacgttttgcggtgaataatggtgaggggtagatgaagaatggagcaatgataggctctatctcccagagggaaaccctggtgcgtctctcagttggtgccgcttcatcccatgcaacctgcatatagttctacttattccagcaaaaacaaaggagatatagctttgtaaggaatcagaccaaacctgaatattgcgccaatgagatgttttccaccttactggatccagatcacttataccagttattgtacccatgtacctgcaaggaagatgtcacaaatacgattcagaaaagaatcttataaaacatcacacattcacaagtgcatgaacatgaacacagtcaacacagagagctgaatgtgactcaatgcagaaaaatgatgctcccaaaatatcctaagtgtgcacaacacacaccaaggatctttttaggtccagtctgtagcagggtccctgtgggagtcaaggtagctcgatatccaccccttagaggggggtttaggataaaaaattttcaactaaaaggaatttgaagtaatgagaacaagtatatgttacacaaataagataaagttcagaaactataccttcttgttcctgactcttcagtttcaaacatcattctgaaccgcatgccaagagataattggttaccatacactgccttctggtatttggcaaaaggaatcacaaattcggaagtactggccctgaataaacaaaaaaaagttcaaacaaaactaataacatatcatctcttcatacgttaaacctagccaaagatgtttaccttgggttataatatattgtaaattggctgttattcgctgcagcatgggctgctgcagcaagaattccaatatgcatactatcactagataagacagatgatgagaggttcgtaggttgcctatttgctcgtctgatccccaagaggagctgctgttttgcatccctatggtcggaatgaagaaagtttagtactccctcaagattgatttgttacagcaacattttcaagcgatagcgaggcagaaaaaacagtttattggcataatcagtgtacctaataaacaagactgaatcaccagcaagtaatctctttccactgacaaataggctccagcccgtagtcagtaaatgccttttaggctgacctggtgaagagaaagagaactcataaactttgagacattaaagcatgaagtaacaccagagtttcctgaaccttttagtaaccaaaggccaaagctgacatacggcagttgaatacgggtttcgtttacaagagtaaggcctttactaagttgcattagcttttatcatgcatcaaagggaacaacggaatattagtatttttctactgtaccccggtatatatgacgaaatgtccaaacattatcatgcaaatcccgggcctgcagttcctgggcaggaggctgcatggagaagtcctaaacataatacagtgcgcataagttagtagaagaaaccaagaaagaatcaacactttgttttccataaggttaaagtatgctcacaagacgaggaaaaatcctctcagcggcacggcgtggcacagagaaacctccatgagtgcttgtatcactggcggtcagtgttttgcaaaagaattctgtttgtggcctggtttgcttcagcgcaagctctgatgctagcaatgtctccttgtcacactgggtcacctaataatcccaattccaaaatcatgtcggtactgctacatcacataatccagaagatctaactgaatttgggaaattgcaacctacattgctaactggctggagagtcattcgagcataaacctcatctgtgtcaggatcagcctgtcatgttttgtcaagaaatgtgtcagtacagaagttcaaattattggcataatagagcactaataaagcgtggagctctttttctgtttactgatgctcaaagtggcagagattacaagcatggtgacactgtggaggatgcatatcagctttgatggaagatttggatagcttggaatttgcgcatctgcgtcctttcgcatagatgctgcaacctgaaatcgggtatccaggaatgagaattgttctccatgaaaccccaaaaccacttgcacaaaacttgcacatttacaaacggtgtgctagtaactctcaaagcttttgttaactctcatcatagaacttgtgtacagaaacacacatgttttctatatcaaactccatggtaaaacagaagcaaccaagtaacatgagcacttttcgtttgggttgattcaaattacagtgccgtataactgaatttgctaagaactgaaagaagattaacaaaagttgtatgttcgtagttgaaagttgcaaaaagattaaagttatctgcagataagattaaacaacatgtaaaggagcatcagaaaaggaagacagattgggggatccccactccatgctcctccagcattgcatcaaatggcaccaaacctccatgacgcgacgacttaatctcacaaagaacaaaagcaaagggaagtaaacaacacgagcaattagacagtgaattaattcctctctgaaacctcttcctttatgaccaaaaaaatcgattcccaaatcttcctcttatgagaacaagaacaccgagaaaaccggaatctttttttccctatttctcgagaacaaagggaaagaaaccatttggatatatggccaagatcaaacgctcaagaaccaattgacaccggacacggaaccaatcaaccaaaccacacaaccgcaaagagagagagaaaaaaattctccgccgcacgcggacatgacgcgacaactaagagaagaaagatgaaaacgaaaaattcacgaaaaccacaatgaaaaaacaacaagaaccaaagaaagggagaaatctcccttcatccgaaatgggggaaaaaagaagaacaaagcaaagcaatcagcagcagcagctttgatcaaagacgacttcaacaacttcacaagtcgtcgtcgtcggaagcagagagctcggcggcggcggcggcggcggccgtacctgctcgctgtgaccctgggggaagtagacgatgaggctcccctgcggcggcagcgagacgagcggccccgcgcacgcgtaccacagctcctggttcaccttggtgggccccctggccttcccctcttccccaccaccaccccctccgccggagctcgccatcgccgccgccgtgtctcccgagctcagtcaccgccgcctcagcctaccgcccgccggaatccatcgccggatggatcgccgccggcgaggaggaggcgaatttgaggagagaacagaagagactcggtagcagcgaagagaaaaaaaaaagtagtagtaatataatagtgcagccgagctaagcttactggccactgtactgtttaagcatcagagttaatttaatcgcaggctataattaattaattactctcgctaattaatcaaccagaacacatctggggaatggggatttgcagctgcaggctgcatcacgtgtggagagggattctatacgcgaaattcacacgcgcgagcgtgcgggtgcgttcgttgcgtgtgtgactcctatgaattctgacgaaagtctgaatacactgctccctccatcacaatgattccgttcttttctccaacaaaagttagacgaagattaatatttttatggcacgattttcaaactgctaaacggtgcaattcgtgcgaaaatttttatatgaaagttgctctaaaatatcatactaatctatttttcaaatttgtaataattaaaactcaatcaatcatacgttaataccacctcattttacgtaaaaaaaacttaatcttcatcttcatatttatcttcagaagaaaaaaaagccacctatacaaaactaacttctgactatacgtccagattcgtactcagaatttgattttttatgggacaaagagagcatctctgaataaacatatgggagcagccattcgttttgccttttcttcgtaaagattactaattaatgatgggattttaatttattttgtatactatccaccttttgacaactttgtttcttttctactacctcttttgatgtttgattttgagaagagagggaaaggtaatttgcagtgtatagcatttggggcaattttatctttctctttctctatttctttttgcctactttagttgtgcttctttttgaactcggcttttcagaagttttggatgcttttcagaagttgccaagggagacttcagaatattatttggagtttaactaggtgcatgcatgttggcatgtactgttggtaatatagtgccaattccttttctttttaccataaaaaatggatgataatatgctataatatgataatgtggataatatggatgataatggtgtattacttacaatttggagtttttttttatggaactcttcaagtgacccaaccatagtttcttcttttttttcttttttttaaaccacatgtgttaggcaaagctaaaggatgaagagaacgcttaactactgctactaataggactccaccttacgtgatactagtttcatagtgttaggcccagttgatagttgattgaattagatgtgtatatatagatattattcctttgggataagaaaaaaaaatcagcaatatactcttttcatgcgagtggggtttataaaagatcaaaataaatcgggacactagagttaatattattttgaggaaacttaaaactccattgctaaattgcttttggctctgattgttagagttatggctaataagctgtgaaaaaaatgagcaaagtaaccttatgagtaaaatttttatatgtgtagttatcattgtctattccaaggagtctctacttggccagcttccttagttcgtaagacaagccatcaaaaccgtgcgacttgtgggccaacccctgtttagcttagaccaagtctatggtctcatggggaggtccatgtgtccatcctctgtctagaaatatccttatgaaggttgaacattcgattatggttggttcagttgatgtgggtcgagatcgtgcccctagagctgtttagagacaaacacactttcactatgctagcgcgtaagatatgatagctggctgcatggtggccaggtcatggcgtttttctatgctagagtccatgactctgcattgtccgggactgccaggtatatcttgcccattgaggtcgagtagagtaggcatgtcatcccttctcggagtccaccatgtaatcgtacatgggaaggaggatgaagaccctagactctaggtgttgtatcacgagcaccccttggcgtctcatgacaggccaaatagtgttcatgagtgccgaagatgggtgggtgtgtgtccaaatgggcactacatcgcctttgggaggaatgcataggccacatagtccatccatcatattaactacatattctctcaagttgcctcttagcattaatgatgagggataatgtgtattgaagactcaatatctcttgggagtagctttttaggctcacatgagagaataaggagactacaagttagtccagtgtggattcctaggggagattgactgctacattaaatatagcgaggagttcaaggaattagttcggacttatgattatgtacagtcttttttgtttgtctttcatcaaggagaaaaagagagagcagggtagttgtagggtataaaaacccatcctaaaccctgtagaaaaggttagacgttaggaattggtaagaacaccagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgccttcttcaccgactatacctgaactggccctcatttaactttttacccaattaattttaccttaaaccccaatcccactcgaattgaatgacaaagggagtaactaatactacataatcgaaggtctcccataaaacgagccacagagatattatatcaaaatcattaccatgactaagcatatactgaacatgattgcatatatatactccatatatggaattaattgaacattagtgttattcatgcgcgattagatagaacttagggccatgctaattggctgctagctagctaaatagagctagagttagctactaattacctactagctgtttgcagcaagctgatagtgcaaccttagctactagagctagtggccttgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcagatgcatgctctggttggccacatgatcgtcgcgaaacgtgtgatggacgtacggcgatcgggtgagatgggatccccacatgcatatcatcaccgcttcatccgcctccttctttgtcctcatcttaagctaagctaaactgagaccatagagcttaataattgatcaactatatatacatctatccagtgattagtagttcttgttgttgccagttgccttctcttcagatagatagcgagatttgatcgatagatcgagataatgattaacttgtacatgcaggtgatcgatgcgtcctactactagtagttaatttctccaagctattttcaattcaaagaaatagtttcagcctctgaataatggaagcaagcggatcaacctgatcaagacgattaattgcatcataatcaacagagagttatttaagagctagctatttttaggccttatccgtaggctgccttcacatatatctctacacatcgagataacaatttttacagacaactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttctccactgaccagcgccatatgaaaaacaatttccaactacgatcggcttaatgccatctcgagcgaaaaccatctccacatgtgggcccttatgccagccgttgccacatatatttctttcatcccataaaaaatcaaaatagaatacaaaagcacatccaaattcactatattaagatatgttatatccaatcctatgcttcttttatagagggagtacataagaccacatgagttgcttgtttacactgataccttgtaagttgtaatgtaagttcatgcagcttagttgcaagatatatttgatagcgcagtgaaaaggggtgtgtggttttaaccttgagatcacgtgtttaatatttaacacgcttataatttttttagaaaaaaaaatatttggagagacgattctccctcgtttttatgcagctcagctgccagctcgatcgactcgaccagcttatgcattcagagatggacgatggctggccgtcatggggtcctcctgcagctgggcatggtggttgcgtcgttgcgagcattcgatccgatggggacgacacattgcgccgctagggcccccggatcgatcactgttcatcgacgtctcgtcggcacctaccaatcatcatcatcatccatcacacattcattttcgcagcaaatctctgaataattcagcagcagctcgatccatccatcagatcgcaggatgaagcatgtcatcgatcctgaatttagcctgacgagactgcatttctgtttcatccatactactatatgcaccggcgaaaactatgcaccgtgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgcgtggcgctgaatttagacacctcagcgccaaatagcatggcgctgaatgtacgttggcacgctgacttagactgccatccgcgtgggacggcattcagcgccagctgacgaggcgctgaggtgtctaagttcaacgccacatgatttggcgttgagcaaaagggtcagatttgaaataagttttggcagcggttcatttgtaaaaatagtttttgcagagggtcaaattgtcaaaatttgtgcctcccacaggatgttaaccgaagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagattttcgtcgctggaattgaatctccgggcactttgatcagcaaaacctgatgtgatgccaaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaaggaaagaagagtctaagtagtatacaatttaaaaatagctgaaattcggagttaaaaataagaaatattaaaagaagagtccatataagaacccaatacgagattaattaaaattcagaataaaaataaaaataaatctgaaattagcaaaagaaaataaaagacgagttcaagtaggaatacaatttaaaattagctaaaattcggaattaaaaataagcaatattaaaagaagaatccatataagaacccaatacgagattaattaaaatttcgaataaaaataaaataatatctaaaattagaaaaattaaaagagagttcaagtaggaatacaattagaaaaggaaataaaatccaaaattagaaaaggaaaggagagtcaagtagaaatacaatttaaaaatagctgaaattcggaattaaaaataaggaatattaaaagaagagtccatataagaaccctatacgagattaattaaattaggaataaaaataaataaatccgaaattagcaaaagaaaataaaagaagagtttaagtaggaatacaatttaaaattagctgaaattcggaattaaaaataagcaatattaaaagaagaatctatataagaacccaatacgagattaattaaaatttagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggaggcagcgggcgagccgcagaggagtacgatggtaaagctgctgacggtttggcgagacttctagaaagtaaaaaaatgaacccaaacgataattatgttcgatttttaaaatctcaatgacaacaaagagaagagatagtggacggcccgtagaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagttgaaaactgatttctacagtacagcaacagagtacacggggtgaaaagatttcccaatttcaccaccacatcaccgggctcgcctgcccgatcgccggcagctgctgctgcggcggcggcatgcagtgctgcggccaccgccggaacaggtacccctcgccgcagccggccgcggcaccggcgccggcgagatgcgcgccctcttcctcgacctccatcgcctccgctgagccctcgccgtcctcctcctcctcctcctccgacgacgacgagacgcccacagtatcctccgccatcgaatcccccgccgctgccggcgcggagccccacgggacaagggccatgccggcgccatcctcttcttcttcttcggcgccggacaacagccgccgcaccgtccggctgtccgcctcccgcagcatgtcccggatccactcggcgccagcgcggaggctggcccacggccggagccgccgccgcagctggccgaggaggccgacgcctcccacagattcgaccggctcgtacaccaccatagccccttcacctaccgccgccacctccgccgccgacggcgcctcgcccatcgccacgtcgtccgccgccgccgcgtcgtcatcgcgcaccagccgcctcatcttggtcgcgcggcaagcgagcgggagcccgccgtcgacgtcgccggggcaaatgaacagctcaggctcctccccgcccttcctcttcagcgtcacgccgccgccgggggactccacgagcaccaccatatcctgctccactaatcaatcaccacgtcgctaatctcgccacttaatcccggtgcactcgaaggttaattctcgcatcgcagcgaaggggggaagcgaaatggcgggagatttatacggggctcgtcgagagaggagtggacgagtggagaagaagaaggcgaggaagaccggagaagcttcggttccatctccggaagcctctagaatgcgcctcgcttctcgagacagcgacagcgcgtcacctgggcggcccacaaggccaccattctgggccggatgggtgatgggccgaattggtggtgggccgaatggcggaagccgaggaggggtgtcgcgcgcggtttggccgtgtgaggtgggggtttgagtttagtaccacctcggcgagcgaggcgggtggtggagggggaggtggctatataaggggggttgggtgtgagggtggaaggcacgcagctgcgtggtgagcacaaagcgaactattnnnnnnnnnnnnnnnnnnnnnnnnnnnnnnnnnnntgtgcgcgccacaattagcagcatacgctaaatttaaatttaaagctttgttttactaaatcttgaaatgttttggcggaaattcaaagctttcagccgtgagatgtgccaaatgtttttaagtaattgtataactctgaaatgctcaacgaaagactacgggattaacttgatgatttcgagtttgaattgattttaccaatgcctgggattaacttgatgatttggggtttgaaactttgaattaattttaccaatgctgatttggggtttgaattgattttacgcctgaattatcagatatctacaatcgctctctgtaaatttggtttctatagaacatactacaatttatactccactactgttttaaacctggatttcctctgaattaaatttaccaatatctgcaagttttcagaatttacagtgataatcagggaagactcatcgtgtcagagctactcctggtcacaccggacgaggcggccgcgtttgctgcacagcgcctgctcgccgccggccgccgccaccaccttcccgtagctgtaccggagcggcatccttcccagcagccggtggaactccgtgatgcaatcccctctcttctcccagtgcgccgcgccccccgtcgagctcaggccgacggccttcatctcctcgccaccggcgccggcgccggcgtcggcatcgtcgttcctcgggtcgccccagtctctgatgctgccggcctccaccagcaccggcccctcgccggactcctcggcggcgacgaagttcatcaggatgtcctcgcagttgcgctcccggtccaccacggcgcgcgccgcggcgagctccggcgagcaggagtactcgcggaggaggcccgcgccgaggacgaggagcttggtgagcaccatggagtagcgcgcctgctgccgcgccgccgcgccgtacgcccacctcccgcgggccaggtcgaggtggtgggacctcgggaagaacccgacgagggtgcccgggcgggcgcgctgctgccaggcggcgaacgcgaaggagagcgcggcggcgtccgggagcacgtcgtcgtcggcgacggccacggcggcggtgcggatggacgggtgcgggaggaagcgggagttgagggaggcggaggcggtgcggtggagggtgacggccggcgggaagcttgacaggaggctgtccggtgtggaggggttggaccagagcacgacgacggcgaggacgagcgggtgggcggcgtacgctccggcgatggcgcggagcagcgggagccgccgctccgagtagccgctcaggagcaccgtgagccggtccggcctcagcgtggccgcgtccggcatggactccactccgcagaacgcctcttcttcttccacaccggctacggcagcggcggcggcggcgagcgtcgccgcgagcaaaaggaggcggaggcggcgatgcgacgccatggacgcggtggcgagatctggttcaagtgttcaacgctggagccgttgacttgtgagttaaaaatgtctcgagttggattctgtgtgggccccagtgtcagcctcggtggtgagtggtcgtgtacgatccgacgtggactcgcgtgggcccggggcgtcaggcgcgggagccgttcgttttccccgcggctttatccacacgaggagggagagaagaggtggagagggagaggcgaggtgtaaagaggcggaacaatggcggcggcggcggcggcggcgcattggtgcggcgcggctgggctagacaggtgggtgggccggtggcggtgtaccttgtcgccggcggctctgccggtgccgtcgcggcggacgaggaggaagggcggggtcgtcggctgcgtgtccgttccaagggaggtcgccgcggccgcggcggtggagccggcggcgccgccggaggctgaggccgagacagaggttagttatcttgcatgctccctgagctcgccggcgctttgccggagcagtgtgtggtgcaaccgtgcaatcctcacaccgacaggacgggcccacgggtcagcgagacagcagtggtgccctgtggtagttctctctaggaagtccaaccgcttaccatttgtaactgtcctaaccttgacctccctccgccgtccgatctaccataggcggttcagatcactaggggcacgtttggatcctgggcaagggtcaccctagccttgcctggcaaggctatccgtttggaactagtaaaatagcttggcttttaagggcgagttagttgtacagggcgagaaaaaccttgccggctagggagagccaatttggctcgctttcgacgtcaaacttcactcgcgtgaaaatattgtctgcgggcgacgcggacttctccggaatcgctgatattctctccccgatcaggagacgaactcattagcagcagctcaatccggaggcgatctcatccgcgtagactcctagatttgatttcttctttatcgtcagctcctaacctcttctttctgagatacatggtgtgctgtcttgttcaatcgctctgtcaggaagttggtagagttagaaaagagcgtctttgagatcgtttgctttgtgctagatgcagcctttgcgttgccaagatcatttattatgatggtacttgattaaggaattctcttgatttctcatttgtgaatcctaaaatattatgggccattttggtttgatatcaaaatgttgccataccaattttttggtaggttaaatagtaaatgtgatgatttggtttgaagccaaatattttgtaatgactatattcaatttggcacaattctagaatgttcttcaccacaattcaaaatt

SEQ ID NO: 4440 - DNA, 2455 bp, Oryza sativa
cttcactcgcgtgaaaatattgtctgcgggcgacgcgaatttctccgaaatcgctgatattctctccccgatcaggagacgaactcattagcagcagctcaatccggaggcgatctcatccgcgtagactcctagatttgatttcttctttatcgtcagctcctaacctcttctttctgagatacatggtgtgctgtcttgttcaatcgctctgtcaggaagttggtagagttagaaaagagcgtctttgagatcgtttgctttgtgctagatgcagcctttgcgttgccaagatcatttattatgatggtacttgattaaggaattctcttgatttctcatttgtgaatcctaaaatattatgggccattttggtttgatatcaaaatgttgccataccaattttttggtagtttaaatagtaaatgtgatgatttggtttgaagccaaatattttgtaatgactatattcaatttggcacaattctagaatgttcttcaccacaattcaaaatttggctctcaattgacattgatctaaagacactcatttacaattctaccctaccaaaatattggtagtgccaaaacttgcgtagagtttggcactaccaatatattggtagggtactaaaccaaacaagccatataactttaaggtagtaataaactactagcaaaagaatggctatgggaaaaaaaacaatgcaagattattaacatgaccagtgccttttaatttttggacaaaaaaaggaagcaaaataaacttgggcaaagcaataatttttgaaggattcaaacagctagccactattccttgccctcggaagcaaaccaaccaaacacaggggtacggcaaggctagcaagctggcaatgagatgttttagccttgctgagccaggctagcggagcgaaggatccaaacataccctagatcaacaccattggtagccttcgccctctcttctgatgctgagaatctgactgtgtgtggtttcgatgcaaaaaccattcgaatctgatgctgttgaactaccttggctgtgatgattcttcttgtcctaaggaagaaggtgtagagtgcgaaggttgcaacggcgcagggtggctgctctgcgacttctgcaaggggaagaagaacaacgtcaagtcggagagcagccggatctaccgccgctgcccgacctgcaaagccgtgagtttcgctcctctcttcaattttgcacattgccatcacctttttctgcttcgttccaacactttgaactggtgctgctgttgcaggcagggtacatcctttgcccaagatgcagggtctacaaatgcatcacttatccagagagcaatgactcatgaacagaagtgaaactgatcgagctggaaaatctggatgaagatctgatccttttgatgagcatgcttgagttgagtggatagactgcaccgatgaatatagaacaaccgcacagctctgaatctgattgtactgcgcattgaagcaaaatgactatgtacacaagtgcattctgcatagcaacatatgctgtttattgtaccttgctcttccaaacatcaggcataccctgatgttccgcctttcttgttgagtgaaatgaggatcatctttcgtccactcaacatgtcagcataccctgcactagtatatacatcaatccgttcttgccagagaatgctttttctgctagctcgtcccggaggagcttatctggccgctcaggacatgcatgaatatacagattacaccatccatcaaaaatgaaggaccgcacaacttcaacatatacgcaaaaagggctataaacatatgtttttactctgctatactatgctatactttgttctttcaatcatcaggctgcaattcaaggatgatggaggagtagctgagcatggggtagagattgcagttgaggaaatgagagaacaggtggacggcgtgagcacgatcaggcaggtcgtcggtgaggaagtcataaggcgctggcttgcctgtgtccaccagcggctcccagcggtagcctgggcgctctgggagtccaacaaccgccggcaaatggctggcgttgaaggccacgtagatctcgcctttcgtttcatctttctgtgatagacatggataaaagaaattatcatctagcttcaacttgattgttgtgaaaaagacggtgcttttattttttgggggaaatggctgtgttgtgtgagagcattatgtaggtaccgtgaagaaggccacgaaacggcttgtctcagaccagtcaggtttcccaggctgatggccatgccaatgcaaccgttgagctgttgggaagtctgcgaggccaagggactcgcattgtctgcaatgtaaaagaaaacaaagcatgaggtcgatgtaggctatggagacggtctcacttgtttagcatgtggaagtgttccagagtagt

SEQ ID NO: 4441 - DNA, 15631 bp, Oryza sativa
  unsure (1)..(15631): unsure at all n locations
nnnnnnnnnnnnnnnnnnnnnnnnnnnnnnnnnnnnnnnnnnnnnnnnnnnnnnnnnnnnnnnnnnnntggaagtgttccagagtagttacttgcggaatttggtcataagagagcagaaccgttgcaagtcagaggattcttctttcttgtcccagcggaaataattgacctatagaagaaccaaagatggattaagggaggggtttaatgacagctgattcgaaaaatacaccatcacattggactgacataatggtcatggcagtatgtgttgttgttgcctccttttgtatggccatattcatcgcccatgtagaacatcggaacaccctaaagaattaagagaaagtaatagtttaaaatgttaaatactgcagaagatgtgactaatgaaagtggcaagtacagaactagcatcttaacgtcatcctacattttggcaaacggtctaagataattaaagaggtcagataataaatcttacttgagaaaccatgagagaaacaaagaaattgcgcatttgcctcttcctcaatcttttgaccgacaaacctgcaaattctccttcctacattgttgacatgaaattgtaaatgcgcattctatataagattctcaactgcaaattgaaagaaaactaattactttgaaattgctaatgtatatcaggtctgcgcctctggtgaggcaaacggagcgcaaatcctagtcactgagctcacatggttttcccaccagcatcaaatcctagtgactggactcatggtttacctaccaccagtagtaaccttcatccataagtcccataactcatctcatttacaaaatacaacacacattttcatctttaagaaatacaggaagtttacagaccatgatatttggtaggggaaaccttcatcacactaatggtttagctatcgagtaaagccattgtaagattatcgggcattttgaatagaagtaaaacaagaactatgcataaacattatagtgcagtattacctccccacagttccagctgaggttatgattttctccatctctattatcctcaccatttgaagagttgtacttcttgttatatgtcaccaaatcagccagcgtaaatccatcatgcgcacacacaaagttgatactgtgccaaggtttcctcccccctgcctgattaataaaggaatatttgtaatggcaaatacaagtgacagctttgattcttatgcaaacctaaaggaaatgtgaagtaaaaaacaaattacatagactagaatgaagctactttgcattggtacttctctgtgtatttttaagtgtcagaaatgtactagtccaattggctatcagtatctaacataacctcttttcacaaagagaaatggacaaaagaaaataaaaatggcatggaggttattttttcagaggttaggccaaatagaagcctcaccagacacaagagcaccccaaaaaatgaatgaaaagaaaacaagaccattttctttactcgcaagtcgtgtgttaaaggctatgcgtggatctagaattataactgtaagcttcatgcactattatcaccagttcatcgtgtggcatttccaaagaccccatccaatttgcattgtacccgatccatctaaaggtatttcactatgtacctggtatagatgtggacttccacacaaacattcagcgaaaccaccagcaaatccatctgtgcctttaatgaattgacgaacaatgtcccggtactggagaaacaagcacataatataagtcagtgctatgataaaacaacaattacacatataaagtgggaactatgttagatgttggtttaactttagatggatgcagatcatatgttataactccaaagttcagtgtctagctcaaatataagcttagtatactgttgtttcttactttttcataacccatgccctgctaaagaacaaaaggcgtatttatgtattgttagcagtagccctgagaaatagctcaccgttcagttcatgtattatcttctgtgtacatttatgggcagaataatttatgtgtttgcctttgaagtttagtaaaataatgttatgttaaattagacatgtctcatatataacctctatttagtgtatgcaaggaaacatttgtttccttagaaaatcgaatagatcaagatatgcagttgttacctttccattccattctgaccaaattttccagtgaggaaattgacctacttgatagaggcctcccgcatcccatgcttcagcaatgagctataaatgcaaccggatatacgaataagaggatttcacaaggatacaacaacgtgctaattatatcatactccctccatttgatattataagtcccttttgacttttttgtctataaatttgatcaaacctaaagaaatttgacatataaaaaagtcaaaacgacttataatatgaaacagaggtagtacatactattatgatatttggtgtagatattttctttatatcagaacaaaagaattacttgtgtagaaaaataaattcattgccaaaaatatgaatggtaacattactggtatgaatgtactagaaattgtagatgcgcaacaaaagtcagaaaaagtagtaaccttgacatctccaagaattggatcattgctgatcatgtcaataagtggtggagtagcaagaggtgtccctgtcgtagtcatgtcaccttctactggacttccatacacattaactggatcccaaagacttgtaaaagtaacaggaaaaaaataagactcttctggaaagacaaaacacggccaaaataaaataaaataaatgaactgccgtttacctgcatcctctggtcattatggatgcaagatcaaaacgaaaaccatcaacatgcatttctgtcacccagtatctgcaatgtcaaagctattttgtttagaataaagcaaacaaaaataagcacaccaaagatatcatgaaaaatggcctaacaggagattcaagcatattacaacaaacatggcagttctttgatttatttattattaatgagcataaaaaaatgataagatgatgggatatagtttccctgctttattagaatatagaagaatatccaagtgtacatatactcaagcactgaaacatcatcagtatgtgttttgaaaacagaaaaaagcaatttgctggagattaaaagaataaaacccttacaggcttgcaattgaagttcttgacaaaatgataagcagtgagaagagatcaataactgttttactgtgcagtatatatatatatttataactgtaccttaaacaatctacaataaattcacggaccacaggatgattacagttgaaggtattcccacaaccagaataattgtaaaactctccctgtaggcacaaacacccttcaaattcttagatagaattacataataaaactgcattatatacatctctgaagaaaaaaaaagaaatgtttccacaatgagcaatataacgcaccttaggggcaagcatatagtatgtgctattatctatccccctaaatgataatattggtcctttctcattaccctcggctgtatgattgaagacaacatccatgatcacctaatagagtatccccacgtaaaaaaatatgttgagaaagcagcaattactaaacaagaattagctatatcaacttggttacctcaattccccgtttgtgagcctctctaacaaaagttttgaattcatttatggcatcacggccacagtttcttatcccacctgatgaatatcttatcattggtgaaaaaaagtttatcgtggagtatccccagaagttcatcctggtaagatagtgagcagtttatatgaaataatataaaaaatgattgaatttctatgaaaatatgaaaaatcataataatgtaaaaacatgtatggatgtacacagtacacatgttacaagaaagtaagtgcgtaactgcaacattccatgcaaatgaagggaaaaaggtaaactgagtttagagatggaaaaaaaaatcacattcaagaatctagacaaagaaaaggctgttatgctgcaactatgcaaaatctatgcatgtggaacctcttataagagtgggagatttgggctatcaattattcaaatgtaatacgatattgatgtgaccaacattaattattgtttacatctcacaaagaaaaactagtttattttatcaacttataaaagtcaagatggtagcgttagcagtaggtcatatctatcatgtctacacaaacaccttatgcaaaatagttgactggatgttaaccaatgcacagtttagaagggggaaatcagttttgcgagagtaagattcgttaggccccattcaaacactgcttatagctcaattctggatgtaagtctgcatacttggaagagcagctgaagtactccagctcattgaattcatggcagggcatcaactctacacagttaactccaagctcctgtagaggggttattccagatttaaattaagaataaacacacaactaaaaatataaacaggctattattacagctattcacttaatggaccactcatgaacaaaataagaaaaaaaatgctgggacactaagtaaatttgtcaatgcatagaccaaattttaagtgttctatcacaaagtacagcataggtcttagaaatactttttttcgccgggaaggtcttagaaatacttgattatggttaagttgtagaataggatatcttcagcaaaagccatgcaaaatctagatgtacgtgaagatcttataaaaaatgaatatgtaacagtcttataaattgctctgtggcccaatagcttcttgaccgaactaggtaattagtaaaatgcaccttcagatagtcaagctttgatatagccccaatgtaagtccctggatgttctacattgcttgaactgtgctttgtaaacccacgtaaatgcatctcatagattacaagatccttctgaggatatctcagaggtaggtcaccttgccaatcaaactgcaaatgcaaacattttactgtgagatttaatatcatagacagtaacaacaacaaattaatgcaattcatttttttacaaggcacataaatgcaattccacttcatagcagcaacgaataaatggaattccttcggaaaaaaaaaaatcatgttcttttccacttgcaaacaaatattattattattattatcaaaattacaatattagaaaaaaagatgcaaatcttagttgtacattcagcaaccagataatcggataatgactgcctcgggtagtcgggtatcagatcaaaagaggataaatggaaacaagtgggagttaaaaaaaaaaggaaactgattcgttggcataccgtactgtacggaagagggatcatgccagccatttgaggccagcaatcgccaccaggaccggggacaccatactctcctcggcttatcactgcctacagtaatagaaaaaaactgcagataagcgcctcccaaaactagtacaatcacaaacataggagaagaacaccaagaaggcaaaatgaagctaatgcatcaccttggcataaggatccaccacgacattggagacatcgaagtactggccgcagtgaggggcgaacataccatcgaacctgtacccgtacagcatgttgtgcagctcgccttcgatgaagacgtgccacacattccccgtccgattgaacagaggatcaagcggaacctcctcagtcacctcatcctgcaccatcccacacaatgcaaaaccacctcaactaatcatcggattaaaaaaaaaacagagccactgaaaacgaaaggagaacttcgcgaggaacgcgtgacaccgttgtggtggtctgaagcgagctcaccgcctcgagatcgtcgggggtgaagaggcagagcgacgcggcggatgcgccggcggagtagacggcgaaattgaccccgccgtcgagcgcggtggccccgagcggcgcgggcattccggcgagcaccctgcacgcgccacccagcgcgtaccttttcggcatcaccaccgacttcaccttcttcttctactcctacacacccttcttctcattctccccgaccccgacctccaccgccgaggccaccgaccttctcaaccccacccgcctccccgcgttccccgccgaaaacgccgcattccgccgcctcgccccgccgagcagccacggccccggccccggcccaggccggcccggggccgccgcgacgaccagcgggcgcgcggagaggcagtgcgggaggctccccatggcggagaaaattgcgaaatctccgatcgagagaggcgatcgaattgtgaattttccggtggattatttatagttggggattcgagttcgtggggagtgtgaggactgaggagtccgcgcgactgagatgaaggggaagcgtgtgcgttgcgcgccgcgcgaggaggcgggggaggaggtatcactgtcttgctgacatgtggggccggaggggtgggtcccactgtatagctgacgtgtgggnccgttggttntnnnantnnnnnananagggggcgtcgcgttgcggcgcgcagccgcgcaccgtccacttgcacatgcaggtaggcggtgaggctgttgctcttttttcgggatggggcccacgtgcatgggcttttcgtgggggccgcgtgcagtcgcttctagatattttccctttctagattcagaatgtttttttttgtacttttttaatacagattcagatgctctttgtaataataaagtactatttaagagaacattttgtgagcaatgttgaacattcaactgaaacaatttaaactaagggctttgctttttttattaacatttttaacctaccaatttttggtaatgtttaaccttcaactaaaacaatttaaactaaggaatatttactttgttgttatttttaaccctactaaattttggcattaccaaattttaataggacaacaaaccaaactcattattgttattgctatcttaccaaattttgaaaaaacaggaagcttccactctcaaaaactctaccaatttatcccgttacactgacataagtaatgatattgcacggttctgatgtacgagaggtaaatttcatcagtagatagcacgaaaacgcctcatatgacataacttcaattggtataggcacaaccgtagatatagatatttatttgcctttaataaaaattgaacaaaacacagcattagctgtagacatatggccagatgtcacaggtgtgacgtcggtgctgccacatcacattagcatctatcccgcacgtgcaagacagggagattaaaaaaaatatcaacaactgggtcaggcttggaccattatctatatgattctgtttacttacggattactacaactaatcaagttcttttttctattggaattacatgttgattccaacaaccacctctctcctttgttaaaacttctcttagtgtgaaccattccttctaggtgtcgtgtgcttgttttgttttcagtagcaggatcagatgtaggcatgtggtgtggccgtctttttcttctcctaactagtctctcaatgctatagatttgtattttttttcctgctatatcaatagaaacgtcgcactaccgtatggcttgattcgaaaaaaaaaacctgctcttcgtgtgggttgtgctgatggcttgcgtggctgcttgtccatatatgctttcggctgttggtacgtattgcagattgtcgctacgtataactgcactttcggcggatttctttggagtgcagtgcagcgtgtacactgtcgtgtacgcgaagcacgggcaccagccgcaccacgaaaaaacgtgacgccgtagaaggccgtagcaatctgggccgtccacctcgcgcagcccatcttgaaatccagtgcgcggcctgcgtatgcacgtgggccgtgtggccttctccacgctgttcaacagacggcttgggccgagaaaaactagcccatctttgagccttgctaatgggcttggctgtaaagcggcacaggcacaagtaacggcccatgcccatgcaaaagtaacggcacagtgtacagctcctgtgtacaaaatttttctagcaaagggttacgaaagttactacatccttttcaagttaaaaaacattttgactttagtcaaagtcaaattgttttaattataactaagtttatagaaaaaaataatattttcaactcaagacaaattttttgtgaaaatatattcaactattgatttaataaaactaatttgatattataaatattaattactatatttatctataaacttagtcaaaacgtcttatcaccttaaacggaggaagtatttatttagcacttttagatatttgttaaacgctaataggctaaatatacaatgaaatttccaagccatatacatgacacacaagtttctaaaatctatttagtccatctcgagatccgtatatcacttcattgatacttttatacttggttcttaaaaaaatatcaactcgaaattttatgattggatatgagcgcctacatcgtaccgtaagcttttattccgccaacaccacaccatcaccatggatcgtatgtacggatcttttactttttaaggtaaaaagaaagagctttattaattataattataaaaatagcgattatatctctgatacaatagtctaggccggattcctacgggaacacacaatctcatctgtgcaagctcttaagcctcttttgcttcagcaatccttgcttcaattcccaggcatctctcaaagtctcaatggacaacttaaggggcttagacaacttcagtgatatccatatccaatattgttggaatatggatcaattccatcgccactaaaagaccttttagggtgtgttggataatgaaaaatgtggcatggaattaggattgggaaataaatgaagagttaggattaaatggaagagggataatgaattgttagaatttaaagatgtcttttagtgggtgggaaatcattttcctatcccattagccaaacactcccttaaaccatgatagtgcgttggcctaaactacaacgccacacaaatataaggttctatgtgccgctaatgggcatgttcggctgcaaggtgcagcagctgtaccacagtgttactgctacaactacttacataaagtactgttctggccggctgcaccacagccgtatgagtgcagccgaacaggcccaataacacaaggcctttgcaaactacagtctccattaataattcatgaaccaaggggcagatctagaatattccaagcctagtgctcaataagtttgcttttatcctttttttttagttttgaagtgcaaatttcaatgcgtatttaagctcaggagtacgattgcagccctggctatctctcgccctacctgcccctgcttcacttgcttcttcactactccctccgtttcacaatgtaagactttctagcattacccacatacatatagatgttaatgaatctaaacacatacgtatgtctagattcattagcatctaaatgaatgtgagcaatgctagaaagtcttacattgtgaaacggaggaagtatcttcttaaatgcatcgtcgacatattgttcaagtggattatatgaatttctagaatcttgaaaactattggcggaactccatctcaccacgtgttatattttgaactactaattttggttttccctatggaacttgaaatccctgggcccttgggcaaccctgatggacaaagtacattagggaataggaattgtctaattttcatatgtatattatcttatatagtgaaagcagcaatctttcttacacgagaatacgccacatcgtaaaaaaacatatatcaaccattgaataaagaatttagataaataatagccatgggatcaaaaaggttacatatgcattaaaaaaataacaatgggataaacatataggaatttctggaggtttctagtgccccctcttagacacatggtacaaaaagagggcaaagataacgaagaaaacaaaaactagggggttatagtgatttctataactaaatctatagttagctagaccaatatatactttgtaaataaattaactcgtgctaaaaccttctgtaaactaatagaccgtatacaagttcttatacggaattaaaaatcacgcatcgcgtgactaagtggcttgtttattgaaatctttacaactttttatcgcttttcttgtccttgatggcagccacccctctcatagtctcattttccatgcgaacaaaatattttctctatcgaatgaaaggttgaataatgtaaatgtcctaactcaggcataattaactagacacaaacttaatgcatgtgcttcatatgtgcaccgtcccacaacattttcattagatattctctaatgcatgagagccgcacaatctggtggtacggttttgtacaaacaggctacaagcttcatagagtaccatttctgttaattaactgtataaagtaccagtggtcaacatcttttaaagtttaggccatacatcgattaattgcatggtcaatcacttgaagtccttagtcttacacatatagtactcgatcgttgatccaaatacggtgtacggaccaaggtcggcaacatttcttgatttgcatatggatgtatgtacaagtacacaaaacctgatctaagtaatcaacataaacgaggtcataatctgatcatttcttgcatggaagtatgcacagtggtattctttttttcattatgaccgtttttttcctcgattttcattagcacgctatccaaatcgttaaacggtgtccctgtgtaaaaaacttctatatataagttgctttaaaatatcaaataaacctatttttttaagtctgtaataattaaaagttaataagttatgcactaacatctttctcattttgagtgctttaattttatcttcatcttatcaatctcaaacataactaaactccatctaattaaggaagacgagtgaggtcagaatttgatcagacgataaagtgaggccaaattaaactcaaattaaactcatgggtatatgtcaagtagcaggtatacggccgtggcggccggcacagcctcagttttattggatgagatatacgttgataaggcaacagtggttggatggtactactccctcagcctctcaaacttataggtactagctgtagtagacggcgggtaaatacgtaatcgatgactttcaaaatattaactatagctaatacatagaaaagatatttttaggaaaaagtgactccaatagatttgtcatttaaaatgatttattttttatatgcatgattaaattaaatgtagaaatgaactgagcgtaccttaactggtaaggtatcttacggggaaatctgtccacccggattcaagtcctcaacttgacatgggtaccgcatgcgtgttcatagagtcgcgcatgtgtatataagcgacgtctgtattgttttctataaaaataaagtatcatatatatgtacatagtacgttgctagaatgctaaagtacttcctggttataaatatttgacattaattagaataagatttaattaaaacttttaattatcaactttatgtaagatttagaagcctcttctactcattttgttgttgtttttatatcagattaagtttataagtctagtaacaaactttatggtactacgatggtattttaaagaaaaatctagctcataccattatttttgttttaaattaataattctcaagtaattaattacggattgtcacggttttaaaagtttaaccaaatcatannnnnnnnnnnnnnnnnnnnnnnnnnnnnnnnnnnntagttttcacatatcctaattaatcaccttttttgttttcaactataccaaaaatacatatatacgcacacgccacatgcgcacacacacccatgagtatatatccacacacacccatgagtatatcacataacacactcttaaaaagttaaatttggaaaccagtgacaaattccttttcttcactaaattcccatactcatgtcaatgcaatatttatgggcacaagtatttcaaccttggtggaggctcctgcacttatgaattcaccatcacactaccggtgcttcttcccagatcaacgcaggagaactttgttgcatctttcactataaccatatatatcttagaagcctgtgatagaaaatgcatatattcatgctgcactccaaaacagattgatctttccaggaagtgctaggttgacatatgtccactaaaacatgtcaatctgccctgacctaaaagatcaagtatatatatggtatataccgaagatatggaaactctccgtgtaaaaaaattccatgcatatgccattcttatcttctagatatataacactttctgagtaactttgacactcatcaaatgagtgcaacacaccaacaatcaaaatgcaacccatgcacgcgactaacaatatatataggagtacttcatatgttccattttatttgacaccggatactatatataaattaaactttcactgctcgtcttttttaaaatatatatagttatgaacatcgagaaagatatcatgctaaatataatcatactactgttgcattcatcacagcatctcgtaataaaaatcgtgattcaaaatttttttattggtgtaaaaggtaaaaaatcaaattggtcaacgtgtcaaataaaaaagaaacgaagagagtacgagtaacttccacgcactgccggccgttattctaccacgctagctaccaccatttctccattatttttgtgcgtgcatccggcggcggcggccactgcctccctcgtgccaatccaacgaggagatgcaatgcaaattatattgggacaggagatagagagggaaaaaaaggttaagatcaggaggagaagacgaagacgatggcaaagaagaatactacgtacactagctagtttctatcgtgcgctgtgacgaagactaacccaacatatggccggccggccgacatacacagaggcgtggctaaatggctaatggcattttcaggtagacagcgagctcgcttttgttgaggggtttatccagctcatacaacccactatatagaattttttctttttacaatgaaaaaaggcgttacaattcaaccccactaagaattgctagcctgctcggtgaatatattatatactacacgtacccctttatttgatgttggtaagtttaattttgagctaaccacgagtatattgtaacgagagcattccactaatctgatatgaatgcatatgtgttacatataaagaatactactttgtaaggccgagggtcgatatggtaatatgtattgtcctattctatgcatgtcgatcactttttgaaatctttctaattaaatgtaatttaaaaatcgataataaattacatgtatactttatttcatatctaaacttttttaatatctaaataatactccctttatctatttttaatagtcatatttcatcatggcacacagaccaaggataagtgattctaattatcatccatttaaacatgctactagtcattcctcgtaaacaggcgatttattaatatttatatttctcgatgtccatgcagctaatcttgtgtggaagaatggagagtcacgcattaaattcaagaaaaccattaagatgataagttgttggattgaaatatgcctatcaaaaataaatttttcagatttgaaaatatgtctatcaaaaatagatggagagagtattatggtacagtgggacaacactaaatgcgagtgatttttacaatggaaacatatataattcctgatccctagactaactagaaatacacacagcggaatttatggatattgagatttgaacattgatgagtgtaatcatgcatctacgatttcactaccacaccgaactatgttttcccgaataggtaacaacagattgttatgagtttttgcccattgtggtggcatcgatcagcatggcaattaattaactcatacagtttacctgtcactcgctagctagctcttgaaacattcttcacaacactcggtggggaaccgaatggacatttctgctgcctcagcctgcacgtatgaacccatgatccgcacatgtatatcctgcagcttaatttacaattaaaggggtaggagaatgttggccaaaaggcaaaattttccctttccagggcacttaacagttaacaccttatcagttaacacaagattaattaattaagatttgcatgcaccttacaatacatttcaagcaaaaaggctgacttgtaaagtgatcttgttttattttattttttgggcgtgatagatttatattagaccaaaagcactaatactccctccgttttttttatatatgacgacgtttactttttgggatacgtttgaacattcgccttattcaaaagtttatgtaattatcatttattttattgtgactttatttatatcaaatattttttaagaatgacttaaatatttcatatttttcaaaaaaaatcgaataaaacgaatgatcaaacatcgataaaaagtcaacggcgtcatatattaaaaatggaggtagtatcacactaaacaaatccagatagactcgaaatcttttcctttaccagtaaaaagcttttctgaataaagaaaaccaagaacagaaaaggaaaaaggggaaattgaactaaaatattataacagcactagggagctatctccttcgtcacaactgggcggcaagatgaggtttggtcatctcatcagctgacccctctttttcagttttttcttgaccatttttttaggtcacaattgctttttccctatttctcgtctcgccttcgtggaatttgaatatgtttccaccaaccaaccaaccaaccgtatgtgcagtgtggtgcacattttgtcatctcctaccttttgctctagcttgctagctcatcactatataatctccacatgggagagaaaattaagacagtgcagacgccgaccacctcctcctctctagcttctccgacgacgcactccggcgatcgagcggccggcaaggaagaagaagaagagagagcaggttggagaggtcgtccatggcgtggaaggacagctacttggacctcgtgctgatcccggcggggatcgtgttcccgatcgtctaccacgtctggctgtggcacgttgtccgccgccgtccgctcttcttcaccgtcggcattaacaccgccacccgccgcctctgggtcttgggcatgatgaaggtaccaaccacgtcgatcatggtgttcgatcatggcccggaaatcgattggattaatggattttggaaacgcaagacaacgagaagaaggcggtgctggtggtgcaatcgatgaggaacgtgataatggggtcgacgctgatggcgacgacggccattctcttctgcaccggcgt

SEQ ID NO: 4442 - DNA, 3313 bp, Oryza sativa
  unsure (1)..(3313): unsure at all n locations
catgtntgtgaatatatacatgtaaaatattgatatatctnaccantgtattttctcattctaaatagcttttaggtgatnatgtataaaagnagnagatgtcaagcggaaaaaaatgcctccancaagtacaaatgatctaagtatcatactccctccattttttaatagatgacgccgttgactttttctcacatgtttgaccattcgtcttattaaaaaattatgcaaatgtataagatataaatcacacttaaaatactatgagtgataaaacaactcataacaaaataaattataattacataaattttttgaataagacgaatggtcaaacatgtgaaaaaaaattaacggtgtccattttcatgtttgtgaataatatacatgtaaaatattgatatatcttaccattgtattttctcattctaaatagctttttaggtgatatgtataaaaggaggagatgtcaagcggaaaaaaaatgcctccaacaagtacaaatgatctaagtatcatactccctccattttttaatagataacaccgttgactttttctcacgtgtttgaccattcgtcttattaaaaaaattatgcaaatgtataagatataaatcacacttaaagtactatgagtgataaaacaactcataacaaaataaattataattacgtaaatttttttgaataagacgaatggtcaaacatgtaaaaaaaaattaacggtgtcttctattaaaaaacagaggtagtatatgtctggttggaagatgcgttcctctccaccagtaaccagctgacacagaggccctatatgtctgtacttcctccaccagtaatttgcattgaaaaagggatattgtagtacaaaattacaggaccttgtaccctaaatcctaccggacacggcagaaaaattggaactgcaaaaaagaggggggaaaaaatcccaaaacagacagaagattgccatggaattgaataaagaagaaccatataggccaaaattctggctaggaaaaacagaacagaactttacagccacagtggcacagcccagggccaaatatgtgggactgcataatatgaaaaaaaaaacaatgtgtgctttataaaattcaaagttgtaaacccctttgcgtttttatgagatttgggcagtactaaatgggttaacgtgaccgttggtgaaaaattaacaacaaagtgataccatctgttcttgattttgttatagtaaatggaagatatctaacattataattttatagagaattgtctgttatatgactcgctataaaagtagaagtttgcccttgcaatttcaagacggatatatttacatctccagaaggacactcttataattacagcttgatgtgctcacgtacgtgtaacacatgtctccttatatgagtcttttatgttcataaaatagttgcaccctaaaaaggtgacctttgaagttaaagacatgaccaggggctctgttcacaacaacaataacacagatcctgttccctccaatgacgaaagctctcaaaaacagaaagccaagttgtggcaatgtgcaaacaaaaatgcagggttttctcaaatgaaaaaccgtgtgccttgccaagttgccatgttgatctttgcatccttcgtgcaggtttgtgtagcctgcaacacacaagttgtatttttggtggatgctcgctacttccactcagtggtagtcaacatctaaaagatcacaatatgtagcaatcccaaccacggaaaggtgtggacaatgttaaccacctaggtagttaggtcgttgattttagataatttttacggtactcaagtcggtacaggaaagtaacaacactttatggtactcgcgagtttagaatccactctttttttcacacttcacggtactcgcgagtttagaatccactctttttttctgaactccttatatcatctctagagtacaatctaaccattcagcgaaacatgggaccgagggtacatggttcaattaattgagtactccatccgtcccataaaaacaaacttagaattagatgtgacttaatctagattcattgtactagattaagtcacatccagttttatgtttaatttttaggacaggggaagtatgcttgtagtgtgtaaatctatcgtgagacccactagtagaaaaaagaaagctaaaccatctccatttcctattcagatgaagtggtgtccaaccgataggcaaaaaaaaaagtaatttggatgttttttgcaagcatgttgagaccctctttgtttaggcttataaaccaatttataagtcgaaaagtttaagcctaaacaaacaaacaattttttcgtttggcttttttaaagccataagccactctaacactattaactcaaaagctaggttggagaagcttttttacttatgtgaggtatatgtatgaaccaccaataaatttaggacattaaatcatcccacttataaatcatataagccaataacctaagtcaataagcttaagcctaaacaaagaggacctgagagagaagagaaatggctcagctcgcgcacaattggtgcaaactaatttcaattaaatagacctagctagtgaataaccgtgaaagtttatagataatggggatcagttgggtctatttaattgaaattagcccgcaccaattgtgcataagttgagccattccttttctctctcaatacgcttgcatggtataagagcttttcatgtcgaggacaacagacacatgcgtcttgacgcttggaacgctgaggcggaggtagtgctggtgtcacgttggttggcactgcgtcttgggcacgaggcgttggtgccgtggtggcaagcaccacatcgcgcacgcccggctggacaaccacggtagaaggagaaggtgtcgtggtgattgtgttgtctgacagcgtgatggcgtcttgggccgcctgtgcttgagtgagggtggcgggaagatcatcggtcttgccagtggctgttgcggcatgggcagtagcaagcgccgtgacgaggttggcaatagcgtcttggggcggagggaggggtgataggagcgacgccatcgatgggctgtggagaagccatggatgcagcggaaggagagagggagagggagggggcagacgggatcaatcttgctttgacaccatgtgtcggtgacatgggaccaggaatatcgtgactagaggcttgggcagccgcgttcacccacgtggcctgaccccctcgggggggtcgggcccgagggtgacgtggccaccccttcctctg

SEQ ID NO: 4443 - DNA, 6449 bp, Oryza sativa
ccgaccccctatggtgttggcgccacgtgtgtgggttaggtgagcacagcggcgctcacctaaccgcacttattgcgggttggacgagcgcgccacgccgcatttaatgcaagcgcagcgcgctcgcttatccggtccgtgaccggtcgcagtatgtgaccggtcacagaccggtcagatcgcgggttaggtggcaacaggcggcctgacactcgtctcgccccgtcccgtcggaatgatgagagcctccaggcactcgtccctagccggagccggcgtggtaactcctggagttggcacgtcagtcccggccagattcatgccaggcttcatcgcaaccattgcaaggaagtcattgtatgaagaaggacagatgtgcggcatgctaaactgacgcgtggtggacaagaatgaccggtctgtgactggtctgacgccggtcacgtcatcggcagacaaaccgtgctcccatgttgtatttgcttccagcgaagtggaggtaggtatgacccatcccatcggagggtcattcggagcagccattgtaaatcctcacccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgccccaagcttctcctgttcagcccaatggccgaacgggcagtggcacacaacctctctccgagcactagcggtgacgacggggagcaaaacccgcgccgtcgagctcgtactccaccgcccccctctcgctgaagtcttgggctggaggaggcgctcgagggggtcgaaagatccgcgacttcgccacctacgggcgatggagaaggacggctagacggggagcgtcgcctcctcgtctacggcgatggcagcacgccccagggcgcgctccaggctgcgggcgcgctcctgcgtcacccgcccgtcgtccccgatccagagactccagcccgacgttggctggatgacgtggccgacttggtcatgacggcgcagcagcgcctagacgccggcgggcggtcctccgccaccaaggcctctggcgctgctaccgccggctccgtgtcgtcgaggcggagggcgcggcgagcggcggccgtcaactgccgtttgtccgccattccctcgtcaacgcctccgacccaagaagatgtgcgtggggggctggatgcccgcctcaatatcgagcgccggcgcaatggtcgtcgtgctgcccatgcaacggagggcgcttcctcgtccggagcgccacttcggcccgggcacgggggccacccccccgtgtccccggttggcggtgtcggctgtcgagcctttgtggcgagtcttcggaacatccgttggcccccaaggttccggcctaccatcaccgaaaaatacgacgggagcgtcaaccccgccatgtttctccaggtctacacgaccgggatcgaggccgccgggggtgacgacagggtcatggcgaatttcttccccatggccctgaaaggtcaggcgcggggttggctaatgaacttgccacccgcgtcggtccactcttgggaggatttgtgccagcagttcactatgaacttccagggcacatatccacgcccgggtgaagaagccgacttgcatgcggtacagcgaagggacgatgagtctcttcgctcgtacattcagcggttctgtcaagtccgcaacaccataccatgcatcctcgcacacacggtgatctacgcgttcagggggggtgtgcggcataaccgcatgctcgagaagattgcctccaaggagccccagaccaccgcggagctttttcagctcgcggaccgtgtggctcgcaaggaggagggcctggacctggaactcctccggttccggtgtggcagctccggccgcccccggatccgccgctcggtcagggcgacgggacaggaggaggaagaagaggtcggcccattccgacgacgagggtcacgtcctcgccgttgagggcgcttcgcgggccacccgaaaggggaggcctgcgagcgacaaaaagaaggaggccggcgctcccagcagggagcgcccgaccggcaagtggtgttccgtgcacaacacctccctccatgacctcgcggattgccgcgcggtcaaaagtttggctgagcggacgaggaagtgggaggaggagaggaggcaggagcgccgtgagggcaaggccccggcggctcccgccggcaaccggcgaggtgaggccaagcagaaggccaccgccgaggacgtcgacgatggtgacgatgacctggggttccaggagcctagggccaccgtcgccaccgtcgatgggggagcgtgcgctcacgcttctcgccggagcctcaaggccttgaagcgagagcttctggccgcggcccccacccatgaggcgacgtggcgggcgcgatggtcggaggtggccctcaccttcgaccagaccgaccacccgccgtgcgttgcccggggaggacagatcgcgatggtggtttcccccaccgtttccaatgtgaagttggggcgtgtcctcatagatgggggtgcagccctcaacatcctttcccctgcagcctttgacgccatcaaggccccggggatggtgctccggccatcccagccgatcatcggtgtgacgccggggcacacttggccgctgggtcatatcgaccttccggtcactttcggtggttccgccaacttctgcacggagcgggtgaacttcgatgtggcggacctcagtctgccctacaacgtggtcctggggaggcccgcgttggtgaagttcatggcggcggtccactacgcctatcttcagatgaagatgccgggccccggtggccccatcaccgtccatggcgacctcaaagtcgcgcttgcttgtatggagcagcgcgcggaccacctcgccgcagcgtccaagcccgcgggtggcgacgagaggctcagcccctccgtcccagccaccccgaggcagcggatgatcacatgcgacgaggtcccggtcaaggaggttgccttaggcgacggcccgtccaagaccacacgaatcagtggtcttctggacgacaaataggaagacgcgctcgtctctttcctgtgggcaaacgcagacgtcttcgcctggagaccggcggacatgcccggggtccccagggaggtgattgagcaccgtctcgccgtgcggccgggcgcaaggccggtccggcagaaagtgcggcggcaggccccggaacgacaagccttcatccgcgaggaggtggcgcgacttctggaggccggattcatccgcgaggtcatccatccggagtggctggcgaacccggtcgtcgtccccaaggcgaacggcaagcttcggatgtgcatcgactacaccgacctcaacaagtcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagttaggacgcaatgttgaggcctatgttgatgacttggttgtgaagacgcacaaccaagagaccttactctcagacctagcggaaactttcgaaagtctccgctccgcccgcataaagttgaaccccgataagtgcgtgttcggtgtgcccgcgggcaagcttctcgggttcttggtctctgcccgaggcatcgaggccaaccccgagaagatacgagctatagagcggatgcgcccccccagtaagcttagggatgtgcagtgcatcaccggctgcatggccgccctaagtcggttcatatcgaggctgggagagaaggcgctacccctatttaagctcctcaaatgctccgggccgtttacctggacggaggaggctgagcgggccctcactcagttgaaggcgtacctcagttctcccccggtcctagtcgccccgaagccagatgagccgttgctactttacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcccgcttgtccaacggtaccaggcgcccccgacccccaggaaggccccggggccactgcgggaaggccgcgcctgtcgccctctgaccccgaggtcatcggcacagaagccgagtgcgccccgcgtggcctctcgggcgaagagcgccctcgagatgcggcccctagcgacgaggatcggccccgccgaaaggtgcagcggcccgtctacttcgttagcgaggccctccaggacgccaagacccgataccctcaggcccagaagatgctttacgctattttgatggcttcgaggaagttgcgccattatttccaggcgcatcgggtcacggtggttacgtcttacccctcggccaaatcttgcataaccgagaaggtactggacgagtggtgaaatgagcaatcgaactctctgagttcgatttgcactttgaaccacgccacacgatcaagagccaggccctcgccgactttgtggcagagtggaccccagctcccgagcccgtctccgtccccgaggctagctctggccccgcacagctgcctcacaccacctactgggtgatgcagttcgacggctccctgtctcttcagggcgccggtgcgggggtcacgttgacctcgccgagcggagacgtcctcagatacctggttcgcctcgactttcgggcaaccaataatatggcggagtacgagggactccttgcaggactcagggtggcagctggactggggatccgccgcctcctggtgttaggcgactcccagctggtcgttaaccaggtctgtaaggagtaccggtgctctgacccgcagatggatgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgctttcctcggaaacaaggcgtcgagcttctcgccgatatccatgaaggcgagtgcggagcccattccgcctcacgcaccttggttggcaaggcctttcgccagggtttctattggtcgacggctctcaatgatgcggtcgacctggtccggcgatgcagggcgtgccagttccacgccaggcaaacccatcagccggcctaggccctgcagaccatacctctttcgtggccgtttgctgtctgggggctcgatatcctgggtccgtttaggcgggccccgggcgggttcgagtatctgtatgtcgctatcgacaagttcactaagtggcccgaggcttatccggtcatcaagatcgataagcactccgcgctttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctg

SEQ ID NO: 4444 - DNA, 1932 bp, Oryza sativa
ccaaccattcgacattttagttattgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccacaataatccaacaattccctactgtccaaatgatatgagatttcccaaagtctaaagttataaaaccacctaatgttgcctaattaaccagcgaagcttctacctaagttcatactagtggaaccataaatagagtacccactagttggggttttattttcctggggtgaacaaggtaataataacaatagcaataataatgtcttaacaatgataaataggcatggctaaataaaacagtgataacgcgggaatttagataaagcggtaatgcattaatttaaatcaaaataattttataaactgggattcaatatgctcaaggatgatgtgacttgccttgctcgctttcccaaacttcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagctcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctctcggtccacggtggaccgggtgcacgcggcttacgccgggcggcgccgtgggtcccacgcgtcagccgcacccgagggcgcgggcggctgacggccgggccccacatggcagccgcggggcgcgcccgaaggcggcctcgccggcacagccgacgggaggcgacgcgcccgcgccccgatggtcgccgctggcgaccaccggcgcgacggagcggcgccccgagagaggggagggaagggggaagcgaaatgggcggtccacggctcaccccgggtcaacggcgacgacggaaacggcgaccgaagcggagagaggcggcggcgcggttcgggtcgacgaggacagatgtgttccggcggtcggcgggcgaaacgaaggggtggactaggtcggcgaggacgcggcgaagccgaaggaggcgatgccgaagcgggaggaggtccgaggcgacgacggcggcggaccgaagctcggcggctacggcgcagagagaggacgacggcgcgagctcgattccgacggggagagagagcggcgagcggcggcaacggaggaggaaggcacggggagcgtttatatagtgttggcagggggagagagcgaccg

SEQ ID NO: 4445 - DNA, 5841 bp, Oryza sativa
  unsure (1)..(5841): unsure at all n locations
cacccatcagcgagggtggcgggcgggcccgcccgtcagcggtgcgcgcgaggggagaggccggatgggccgcgggggagaggagggagagggagagagatgggccgagccggcccaagagggggaggcaggggggaaaaagactttttagtgtttttctttttataaaattattttaactttgtttatttcttaataattattatttgtgctctgaaaattccactaaaatttgagggctcctttttgaccaaggagaatttaacaaaaattctccgggccacatttgaatttttcttgcacgtattttaatgtttgccaatttcttttcgaattttaattaattctattattccttttagagaatgatttttatttcgggatgaatttatcaggacgtgacacgcttaaattgatcaggggcatcactgctccgtttggggtgcctaaccgtatcattacggataacggcacccagttcactagtgaactcttcggtgactactgcgaagacatgggcatcaagctctgcttcacctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctaaggtcccctcgggccaccatgtattgcgagactgatcaagatcagcttcgcagagacgacctcgactacttggaggagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgacgcttctacccctagtcggagtcgggtgtcaggtctcgggctcgggccaaccccgcactcccccgaacgtgcagggttggccgggggctaccacatgcatatatacttaccttttttctcttccatatttcaataaaagcattttcgatttcctaaggaatgtgtctgtgccattgtttccttttgaagaatcttggcttgaattagcacgctcgtgctcgatcctgccctcggtggcccgggccggctaaaatcgccaaaaggggcccagaaccgagccgtgccccggggcgtggtgaactccgggggggaatcggcaaaggcccacaatcgggtcacccataaccctcggtcaccacgttcccggcctggccagtctcgacacgtggatcttcccaggcactagccccgacccgcgccatttgaggctgggacctgggcacgagcccttgttcaagccaagatgcagaaggaccgcggcacagaccatcctcgtctcatacacgcaacaaatagaattgacacagaaatttcatctttatttgattgcagattaaattagtctatacaagaagggagcccgaaggcctcagaagaaaaaggaaaaagctattaagattggcgggggccctaggggctcacttcgacgcacccgggtcgccagcctcgtcgtcgctgtcatccgcaccaccgtcaccgccctcctcgtcggagtcgagggcgaacgcgagccgaggggccgtaccctcgaagctgtggacgatgtagtcggcggcgtcccggacctgcgcgcgcgcgccgtcctcggttccgggagggaactcgtccagcgctgcccacggggagaagtcggggtccctggcctggtagcttgccagtacgagctccactgccccccgggcgaggtctctcgaggatgacttgatcgtcttctcgagctcctcgaggagccgctggagggtcccagccatctctgagaggcgctgggcgaggcccccctggttggcggcgtacttcgcggtccgctcgccccagaggcccgccttgccgccggcgtggtctaaacgggagacggcgtcccgaagcatgccgggccctacctcgcccgcaagcggagggcctcgacctccccggcggacgagtccagcgcgccctgcagctcggcgatggtgtgttcggcagctgcgaggcgggcggctaagtcgcttgtcgccgcgagccgcccaccgntgcgcgctctcgcgtccagctncttagcccgcgcctcgagctcagcggcccgccgagccagtgcggccctctcggcgcgggcgccttccagattgcggcgcgcctgctcctnnctgcgctgctcgcggaagaacaggttgtccgccagccgttgcgccgcggcctcggccttctcgagagctcgctcccgctcggtgagcgtatcctcgcagaggcagagtgcggactcctcttcggcgcagcggcctcgtgcgccgccagtgtggcctcccagatgcgaggcggccctcgcggtccgccaggtccctctcctttgcgcgggcacgctcttccagcgccgtggagcgagcttcaagggcctcttcgcgccgccgggacgccgcctcgttctccgccgcccgccgttcccgggcagcggcggcgtcaaggactccccgggcggcgtcgagcttcttctctagctccaccgcccggctcccgtattggagacggaggtcgtcccgcacctcgtcgagcacggcggtggcgatgagggcagtctcccgctcctcctccacctccctggcgatctccgccagctccctccgacgggcctcgagctctgaggcgtgccggcggtgtgccttgcggcccgcctccaccatggcctccaccgagcgtcgcccctcttcgacgcgtgcccacgccgcgtcgagctccacccgctccgcctgcaggacctccatctgggcgcttaacccgtccaacaccgtggtgttcgcggcggctaaggcctgcaggaggggctccgcgctcggtagggcagcagaaggcagaggagagagccgcctcggtgtgggcgccgcgcggctcggcccgccgatcgacgtgccggactcgggggcgtcccccgaagttggctcgttccgaacgtcgtccgaggggtcggacccgagcggtgcgcccgcggcctcgtcgtgggtggcctcggaagtcgccgtcgcctcgggcggagtcgggtcgggggattggcagaccgcctggtgtgcgcgtgccgcctncaccttccggacggactctctcggccggcggagtctggcctcctcccgagcgacttcctcagcctggcgaaccgggacggcctcctgggcagcttcctcggcttcccggagacggtctgcggcttctcgccggtcagcttcccgcctccgggcctccgcggtcgccgcctcctcggcctcagatcggccggacttggaatggcgaggggggcgcgacgggatctcgctgaagcagaagaaaaaccagaagacaaaaagaaacgggtaagtgaaaactcgccttgggagataggagaatgagtacggccgcggtgggcgcggggacgaacctgcggggaggtcggctaaacgaccaccttgggggtgagatgaggtttccccggcatgtttcggtctcccccatcttgcggagccgcttcttctttcgctccccctcgggccgcggcgtcggcacggcactctccgggcgcctgctgctggcacgcaccgccccgccccctcggggaggagatggggaaggggtaccctcctgcttcctcttcccccgggcgtcggcagggcggctgcccctcgggcccccgtcgcggggcccagaagcacgaccccctcccggggtagattgttcccccctgcggctcccacccgcgccatcgtggcctcgaggagcccgctcctccgacgccccgaccgcctgcatgatggtcaggatgttggcgcgatctggatcgctgcagagggggaggactccttgggggatgagggatgcctccacggagctgagattcaacacccgttggaccaccatcttgaagtcctcaggggcccagtcccatctgcccccctggtgggtcctcatgtaatcctcggacccggtgtactcccaggcgccccgggcacgccgctggagcggcgcgatccggcgacgaaggtagtcgccgtacaccatggcccctctgagcccctgggatcgcagacccgccaggcggtcaagaacgacgtcgtagccgtctcccagatctaccggcgcccgccagctggaggcctgcgccaggggctggctcggaagtcggaggcgcgcttcgtcggcgagggggtgtagaaccagtcgctcttccagtcgtcccacttcttgcggaggacgcagggaatgtagcggctcagcaccggcccccgcggctggaagtagcagccaccgactaccgacggcggcgacaccggctgtgcggtgaagaaccaccggaacagccgaagagatgggcgcaccccgataaacatctcgcacaggtgcgcgaagatggccaacatcattaccacgttgggggtgaggtgcgccatctggagattataaaactccataacatccatgaagaaagaagagaatggcggggacagccctgccattgcgaaagagagaaagaagacggaccgccccgggtagtgtggcgccgggcgtccctcgcccagctcgaccacctcccggccggtggcagattccggcatgaatcggcgcagcagcccggcctgcctctcgctcacgatgcgagaaggcggcagcatgcttccgtcgagcagtgcggagccccgtgccatgacgccggcggaggaaaaagcttgagagcgagcgagagcggcaagggtagggcacaggaaatgaagagttagagcgcaagcggcgaaagcaaggggaatagtggcgagaggaaggaaacaaatctcttcctcggcgcctttatacccttgccaacgctatgcccggctcctcgtttcccgcgcccactatctcgccccctcgtttctcgcgcccacgccttcactaatcccactcgcccgtttgcggcgcacgaggcggatgtgcggccgtggcagtcgagatgggacagatcgagcacgcgttaactacactcgccgaccgaagcgccatcatcatgtctccaggcgaaacgaatcagcacgattcgcacgctgctcgactaatgtagcggtcgcgaagagaccgctcattattgtcagtcggttttcccttaccgatgcgcacgatttgcgatcgctggctttctgcccgccagtagagaccggccccacctgtcaccaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggggtggggccgctcccgtttcagcccnaagggtaggggcgccccgaccccctatggtgttggcgccacgtgtgtgggttaggtgagcacagcggcgctcacctaaccgcacttattgnnnnnnnnnnnnnnnnnnnnnnnnnnnnnnnnnnnnnnnnnnnnnnnnnnnnnnnn

SEQ ID NO: 4446 - DNA, 1738 bp, Oryza sativa
gtatgacccatcccatcggagggtcattcggagcagccattgtaaatcctcacccaaaagaaggggaggtagaagtggtgcatgtggtatccccttgagatataaaaggagaaccttacccaccgaagaaagggatccgggatccgggatccgggaggaggagaacttagagaatacctgagctgatagagagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccatgctccgtcaccatgcaagtgtatcgagagagaagaggaatggcttaactcatgcacaattggtacgggctaatttcagtgaaatagacctagctagtgaataatcggaaaatattacagagaacggaaggtaatagtggggcttactatgcattccccgttcaccaaatatggaagatacgatgccaaaaataggagggacgacaagctatctttgacaggtttgaacgaagaacatggttccattttgccttgtaccgatttggtttgctacctgtagtgttgtgtgcttgttggtacaattttaagtgcgatggttcgatttatttcatacaccgatgatgccctaattagtagtgaggcataacaaatttaaactaaaatatacgaccttctggaccgtaaaatcgctcatattgtacacgacatgaacatactgtgccctggcctttgtgccactagcaaaaaaaaaaaagagaaatgaaatgagtcaaatgctaacgaaaaaaaaatcgaaaaagacgtacatgaagtacagaatgctagttcagatttagtgtgttaggcatcatttctgtatactttacataatgagctttttaacatatcatttgatgctgcttaattacaaccgatgcgcgcgctaatgtgggttgatttccgagttagttgatggcgacgctggcgaattcgtcgccgtcgatcgaggagtagaaggagtgctcgtcgttggcgtcctcctccttcccccccttgagctcctcgatgctctccaccgccgtcttgagctcccaccggctgtccacggcggcctcgcagcacgccatcccgatcttgatcagcttcaccatctcccccttgctctcctcgtcctcccacttcctgatcatgtccgcgtccaccaccttctccagccactccccctccggcgtcgacgccaccgctccgacgaggtcgccgttcgccgtcgccgcctccggctgcggcggcgggtcgtaggacggcggccggccggtgaggatctcgaggatgaggatgccgaggcaccagacgtcgctcttcttggaggagcggccgaactgcctccgctccggcgacttgaaggccaccatgagctgcgccgagtgcgactggttcatcaccgggaccagcgagtagtcggtgagcagcggttcgaagcggtcgttgaggaggatgttggacgacttgaggtggccgtgcggcaccgtcagcatcggcagctcgtcgtacaggtattggagcgctcgcgccacccccttcaccagctt

SEQ ID NO: 4447 - DNA, 2476 bp, Oryza sativa
cgaccaccgcgaagccgatgatggccagcgtgccgaggaacgcggcgaggacgccgaacgacgtcgatcccttggtgggcttcgtcgcgccctgcgtcccctcctcggctggcactgtgcccgttgtggttgtctcggcggcggccgtgggagacggcgaggtcccgatcttgccggatgtcgccgccggcggcgacgtcgttgccgctggggatggcgcctcgcatttcgcgtcgactggcgcgccgcagagcttcttgttgccctcgaacatctgtggatcgattgatttgaggctcgccgggatctccccatccagctcgttgttggagacgtcgaacaccttgagatccttctgggggaagtcggggatcttgcccgtgaacttgttgtcgttgagctggaggtcgaggagcctcggcacggcggcgagcgaggccgggatggcgccggtgaagccgttccgcgacagggacaccttcttgagccagcccatcccggcgaacgcgtcggcggggatctcgccggagaacttgttcccggacaggaagatggcgcggagcccgccgaggcccttcacgtcgggcatggcgccggcgaactcgttgtccatgaagctgagcgtgcggaggccggtgaggctcttgagcggggcgaggtcgagctcgccggacaggccctccttctccagctgcaggccgagcacgctgcccttgctgcacaccacgccggcccacgccgaggtgccgccatcgcaggggctcgtgccggcggcccaggtgtccagcgcgccgccgccgtccacgatgccggccttgagcttgagcagcgcgtcggcttcctccgccggcgccgccgccaggaggcgcgcggcgtcggcgaggaggcagaggcaggaggagacggctagcacgcgcaggaggcacggcgctccggccatgtccagcccgccggcgccagcgcctcgacgacggcggggcggggtggtgggggtggcgcacgtagctttctccggagaggaaaagtaggagagatcgcggggaagagagctgattcaggagagagctctctttcgcgcgcgcgcgcgttggagagagagagagagagagagagagagagagagagagagagagagagagagagagagagagagagagatggggcgtcgagctagctggccgcatggccatggccatggctgtggccgttgctgttgctgcctaactatagcaaattcaaccatctctctctctcagctacgactaacctggacttactacctcaattagcaaattcaacctgtcaatttcagaattgccacattactaatccaaccacatgatctgaatctttttttttacatttatacaccagaagttcagaatgatactccctccgttttagattataagtcgttttgactttggttaaaatcaaactaatttaaatttatagataaatatattaatatttacaacaccaaattagatcaattaaatgataatggaacatattttcataatatatttatcttggattaaaaatattattactttttctatacaaacttgatcaaatttgaaataatttgattttgaccgaagtcaaacgacctataatatgaaacggagggagtagacgattatatgtacatcgtccaattgctgaaacataccacactcataaacatttactgacacattgcataattgcgttcttgcaaactggtgaggaaattttaacaattaacacgagctaataattaattaagagaggactttgcttagaatccatagcacgagagtcatctcgaaggcgaagatggtgtggagcaatcccctgtccagcgtgaacccgaacagtgtgatcccgccgctgttgtggcacaggtacgtcactgcaacgacaaaaaatggcgcgagcgagtgaatttaaatctcagaaaaaaaatggcgcgagtgggggttcatctggtgttaccgagggcgtgtctgcttctgtaggcgcacgccgccgtcgtcgtcgtcccgagctccggttggtgcggcgcgtccacgtcgctggccgacgagctgggcgccgccggcaatggcgccgacttggcgtggtgcgccacggcctccatgctcatgtgccactggctcgcgatggacacgatcctttgcgctctgtgcgtgatcctcgccgcgccgaagaggcacatgaagaagccgctgagctgcaccgacgagccgacctgcgagacggcgagggtataagcatcgtgtcgtgattgctacgcctgcggcggcggcggagtggctgtgtggtgttaccaggaggtcgccggagttggcgaagctcttgccgtccttggaggagagggcgacgacgagggcgccgagctggctgacggtgatggtgacgaggcaggagaggatgaatgccctgtagcggtggctggtggcgagaagctgcgtgcggatgcggcggtgct

SEQ ID NO: 4448 - DNA, 1478 bp, Oryza sativa
cacgcccgtgcggtacacccacgacgccaccgtggccaccagcgccaccgcgcgccactgcacgccgacgccggggagggggcgcgctggctctacgcgtacggtggctaagaagaatacggccttgtgcgcgacctcgacgcaagagcgacggaaggaatcagcgcagcgaggaggcagaacgcgcggtccagctcccgcgcgtacccgcgccgcacgaacgcggtgtcgtcgcgtagcccgccgtcgaggaacatcagatgccggagcccgccgccgcggcggaagaaggacgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctccgaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctct

SEQ ID NO: 4449 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnncatgaaaggacccaaattatcagtaaattggctgggcaggttgttaccatgagtcaaaacaaattcgcatcaaatgtgatagagaagtgctttcaacatggggatatgacagagcgagatcttctgatccgggagattgtgaagcagactgagggcaatgataacttgctggtatgtttgagaagttgatactgtaaatcaaatattttcattcagttctctccctccctctctcaggcacagggagcaaagcctgaattagcgggataaccagtatgcagtagcatcccgtgtttttagcatccacgaaaaaattagataaaaaccgatatactattcactatatctaatatagcatctcttagattccacaatattctttcctgcggttttcgtacgaattgatttgctaacaaccttttacacatttaggcgatgatgaaggaccagtatgcaaactatgtagttcagaatatacttgaaacatgcaacgagcaacagagagagctcctgctcagccgtgtgaagggccatctgcaagcattaagtaagtacacctatggcaagcatattgtgagccgagtgagcaactttgtggtgaaggggatcatnnctcttctacttttntacttctaactgcatcctctctttggtttcctttcacccttcaagtgcacattcaag

SEQ ID NO: 4450 - DNA, 1175 bp, Oryza sativa
cttttatacatatcacctaaaaagctatttagaatgagaaaatacaatggccagatatatcaatattttacatgtatattattcacaaacatgaaaatgaaagtggtttcatcactcgagtgggcatacactcaattcgtgcatgccaactaaaaacttatatgagtagaaataaaaataacaaatctcatccatagatgatacacacttttgatcatcatatttgtgtctgttttttttttagaatttgaacttgtatgtttgtaaaattgtatgtttgtaaaatgatatatatcatattgatatatcttactttttaaaaaaattttcatggtagctttttagttgaatgcacaaaacaagtgtatgtccacttaggtgaaaaataagtttcccagtaaaaaaaatgatatactccctccgtttctaaatatttgacgctgttgacttttttaaacatgtttgatcattcgtcttattcgaaaaatttaagtattattaattcttttcctataatttgattcattgaacaatatacttttatatatacatatagtttatatgtttcataaaagtttttgaattagacgaatggtcaaacatgtgctaaaaagtcaacagtgtaaaatatttagaaacggagggggtatatacaagttatctgttatttttatttatacttatataagatgaatttgaatttatatatttatattgtgatatatcatatattagtatatcttgtgacttttttaaattttataagtgaaatgaaaatcgatgggagttcctctcgaggaggaaaaagactttgcgatagtacgtacaaatagtgaatcaatgggggagaacatcttattctgacagattacagcagttgtaaccagtacattgctgtgcgttaacagttgaccgatcagtgagtctctgttacagcaccaagtactctcccgcccgtgccatgctaaacatgtcttgaataagaatactcaaaacaatccaagccacaaacatgacacacacaacacaggtgcagtcactgttggatcaagaattgcccgcatttttcttcaagatcgagtttgaaggacgagacgagagcaccaccacatattctccgtgagggtaggcaggttatagagtccgactcgtgtccgaaatggtcaaacttgcat

SEQ ID NO: 4451 - DNA, 905 bp, Oryza sativa
  unsure (1)..(905): unsure at all n locations
nnnnnnnnnnnnnnnnnnnnnnnnnnnnnnnnnnnnnnnnnnnnnnnnnnnnnnnnnnnnnnncacggcactgcagatagcgtcaagagccatccggtcctcatgcagagggacgtccacgccgtcgggctcgatcgccgcccacaggcagtgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaaaacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacaaattataccctaattttaactacatatattgggatatacgatcccaaatcaaattaataattagcccaaat

SEQ ID NO: 4452 - DNA, 791 bp, Oryza sativa
  unsure (1)..(791): unsure at all n locations
nnnnnnnnnnnnnnnnnnnnnnnnnnnnnnnnnnnnnnnnnnnnnnnnnnnnnnnnncatgttactaattctcctgtttggaaaaaaatgcgtatatataagtgaattagtgagctaattaattgtactatatatgcattgcaacttctgcatatatgtggattgaccatctatatctaccattcaatgttaaaattgcagagtcatttcttgcgaggattaaaatatttttaattatatatgtataatatgtcatatcgatcgatctgtatatatattttttgagggaaagatctgtatatatatgtacaaggtagttaactgtctacggctatatgtaatgtgttatatcgatctgtcatgtgtatatatgtacctgcttgtacgcattaacgatattaatcagccattgttgtccaaaattattgaaaccataagtttttgagctagatgtaactgatcattattaacacggacgaacactagcttaattgatcgatctattcgatcattccctcactaactaattaatctaattctgcctgctaataaatataattaattgtccactcccctgatcaaaatgatctttttccgattaattttcctcaggtcgaccaaaacggataatagtttttattttatgatacccaattgtgcctatatatagatataggtatacgcattatatatacttacccggccgtacacgcgactgtgtactatcaagcactacgttcctgagcaaaatgaagcgtgcatgcatgtgtaagcaaagatttcgtgccaat

SEQ ID NO: 4453 - DNA, 1732 bp, Oryza sativa
atactcaagcttcgctcactcacttgcagtgtcagtgttgctgattaagctatccaagggtatatatattattagattgttaattgattaagaaatggaagggctgataccattggtgtacaaggccatagtggagtacaggaacaaggcaagcagcaggcaggtcactctgagaagcttcttcttcgtcaccgtcgtcgacgaccagctgcacggcggcgactccggccggtggtgctacgcgccgtcgccgccggcgagtgccgcccaccagctggtgtcgccgctgctgcgatcggcgccgcgtcgccaccgtgcaggttgattaaatttaggtggtcaaatgctcaatcaacaagaggttagttagcctgcatatcatatcatatcatatcatgatcatcatagtgcgtataaataagatcaataacatggaagattgaacttagaatcattcttcctgatatatattcaatgaaatttcgtactgtctaagtgccggtttgtttcgtttttttttttaaaaaaaaagaaataacatggaagaatgcatgtgaggtgtgcatggtccagatctccaaagggagtagtagcaccagccacctgcaggagcaaagcaagcttcagaatctgcatgatccagtgtgtgtttgtgtgtgctggaacagcactagctagcttaattagagtgatggaatgaacatgatgctttggtggtatattgcacatatgtacaaaggaataaggatgtgcttgtactgtgtaaattgatctagcaaatttgtgcatgatgtcatatatactgtgaataaatgaaatgtttatgtatctggactctgggattcttccatttcttaaaagagcatttcaagatcctctgttcttttgaaagaaaaaaaatgattatattacatttttattatgcagaggacgaggtttaattaatccttcgttatactacctctatttttaaatatatagtgttgtgttgacattttgatacgatgtttggttattcatatagcttattttattattaaaagcactttaagcattcagtttttcatgcttgtactaaatttttaagtaagataaatgatcaaacatcgtgttcaaagaatctcatatattttaaaaaaggaaggagtatactccatccaggtaaaaataactctttttgaattttttatttgaggcgaaactttcaaagtttgactatcaacatatccttttatatccttttagtttgaaaacataaaagatatagacttacaagtattttcgtaatctcataagattattagattttatgagtttattccaaaaaagtcatgattaaatttgcacctaaaaatagtaaaagaaaactaacgtcatttaattatttttgaacgcagagaatatactttatatggagagcaataggttgtgttgagctaaataattaatgataaagctaacttttttacagaaaatgatcgagctaagttgattagaagggtaattttatcatcctttagaaagtgcagggaaataccatattttaaagtataaaatttcatacctttacgtgctaggtatctcgaggtaccaaatcttttagtgtaaaatttaggtatctcatgtattttcttaagtactgtaaaatttctaattagaaagtctgatttgtgattcaaatggacctctgcaaaactctggagtattttcttaaggagcgatatcaaaacgg

SEQ ID NO: 4454 - DNA, 20916 bp, Oryza sativa
caataaatcaaatgataggaaaataattaataatcacttaaatttttctgaataagatgaacggtcaaacatgtttaattataaaagtcaacggcgtcaaatatttagggacggagggagtatataagaagacaaaataaaatctgtccttcttcgatcacttttggtgcaaattgggcccctgtcgaaatcaaatcaacctatatggagaaccaaataaatttgtctacaaggcatcgcatatcttcgctgtctagccatttgcagctataaaacagctcgatatcagctgaacagatatctgcattcattcactgaatttcgtagggtttcagtattctcatgtgcaaaaacgcatagtacagatatcatcgtatcgaatgtaccaaacaaaacgtgtcgccacatttttggaagacgacgatgcagcgtagttcgtcacgcaaaggtttgcagattaaggtggtgattgaatatcctgaagatgaacattaagcatttcacgtaaaacgtggagttaataacgtgtgattaattaagttttaattattacaaacttgaaaaatggattaatatgatattttagaacaactttcatatagaaagttttcgcacggaacacactgtttagcagtttgaaaagcgtgccattttatttcaaaagtttatcacctactttcatcacatatctgtgcagacaccttgtcaccatgtgcagatacaaatagatacatccctcccaaatgcatgtgccatgttaggtagtagctgctgctagccatgtctctatgatcaattaatctgatcgatcgatctctgcgacgtcacaaaataattatgttgccggccgggactgaaattttgatcaagatcttgaagattaattagatgttgctcatggacgagatcaatttacattacttactgattaatttgtgtaatagcaccatttaaacggagcatgtgatctcttaagccatccatatatgaaaatgaattttcacatatgggcccacttggcattttgtataggcagatcgtccacctgcttaaacctaaggatcggagggcatttcaaataataaccgatcggagggaattaaaaaatactaatagctttttaagctgtgcttctaagcttccctagttttattgtagttgaactgctatgagcagtgattttttttcgaacgcgcaaaagtcttgcatgtcaataaggaatagcatacatcggaaatacgccgaggaggttaccagggtaggggtactacagtatgaaaggcatcatgaaattttctagaagtccccacaaaaaattttctagaagtccccacaattaaaaacacatgcatataagagcaaatataataaaagaagtagtttttagtttctacctgattatctctaattttacccatatcaactagtgctcatcaacgcagaggatagtatgtacaacacactctatactgctagtacactggtctggccccagcaataatctgctgtagttttttttgttttattttgctaccttaatatacccttcatttctgtcactttgatcttgaagctcaagtacagatatattacatcttacacgaggggtgccggccctacgtggtgttttatggctagcgtaaggtttttattatacttgttctaattaagtactccctccattccaaattgatctacatatagttttttttgaggttattcctaaatgatctacatatttatgtttatttattaggtttattcgttatttgtgcattggagtaaatggacattgatgcatgcatccatacacacatgtatttataacccacatgcaatatcttgatttgctattggctaggaaatagtggggatgatgcatacattgagtttgttgctagagtaaatatagtatgagagagttattagcttttcttgatcttggtgtacctatgaaatatgtagatcaatttggaatggagggagtagttaccatgagacgtttataccgtaataattcacaccttctgtaatattcttaattattatgacatatcgacaggtatacctcaattactataaaaaacataattaattattgcaatgtaaacgagaccaaacaaatatgtattttacatattaactcgattacaactacaaaggatatcccctcgtattatccggcccctagctagctagctagctagattcagtcatacaaagccatgcatgcatgttgtataggcaattattataaaaaaaaagcccaattaatgatttgcaatttttttatgggcacaagaaggcccttccaagaagtaattaataagcatcatacccgaccagtcgatgcctgcgttgcaacaagcaacatctagggcaggtcagtactgaaccctagtgacgacaaattgacaataataattcactaatttaatgtaacagtgatgagatcattcatggatggattaattaattggcaatgtcgagatgcacgtttatatacttaagagaagggggagggtgggggggttacattttcagttatttcaagcttcacacgtatagctgcttgctcgcagcagatgcggttaataaactaattaatctctgtactaggataattaagaagttattaacagcttgtgtccatgttgatcacctcaataaaatgacctcagtcgcatggattgttgaccagctgcctcaatctcatttgctgatatttttactgtatcgatcatactctacgtatgcacttgaattcttgacatttttcttattgcgccaaattgcattaattaataaattgacagcatgtgactatttcgagttcgtggaaaaggtaacagcttgatcttttcaaatttatctcggtgcagtgcatatattttctgagtaaattaattaaagcatggtgcggctagaattttcaattttagaataaatttactgcatttttttcatctttttcgccatccaactttgacttttagaccactaaaaataatatcacaaaggtctatcaaaaggttcttttttgttgcctctgtcacatgccttgcatgtatttataatcagaacagggaaaaaaaaaccttccaattaagctgcaggccctatttgctgacatgtgatgatgtcatcaccatgttacaaagagccatctggaggctgcagctgaactcatccaatcagtctctgttaatctactactagtattaatttgcaacattatcttgtgaacgatgctaaacaattaattagttaattaatttggatcggatagggcgcaaagatgttccccatttcaaagtacactactgacgagtattaggagcttagtgtgacgcccccacactcttccgaggcctcctacatctggcagctttcctaggatatagactattcctcacagaccaacactagtcttttctgcacactttgtcctcactcgtgcgcacccggaaagaatttcccgatcggtcacccatcccgacattgctctagggcaagcacgcttaaccttagagttttttcgagatcggctttcggaaaagaagttgcaacttgttgatagcttaaccttagagttttttcgagatcggctttcggaaaagaagttgcaacttgttgatagcttaacgcttccggaaaagaagttgcaacttgttgatatgagtattttattaatcatattaggatatcacattctcaccccccttaagataccgacgtcctcgtcggtcaacccaggccaggaacgtcccctattagcaccacgtatatacaagacaattttcggcgcacatacgtcatgccatacgaccacttcgtggatcatcccgtatgcaccgtatgcccgcgtacatgttcatatatatacgtatagctgcaagggtcgcgtacatgttcatatatacgtatagctgcaagggtcggctctgataccaacactagtcttttctgcacactttttcctcactcgtgcgcacctgtgaagaatttcccaatcggtcacccatcccgaaattgctccagggcaagcacgcttaaccttagagttcgagatcggcttccgaaaaagaagttacaacttgttgatatgagtattctattaattctattaagccctgagccaggatatcacacttagctagtataaactcatcgacaacagacaatgttctatatatatatataactaattaattaacaggatcatgttagagctcataataatactagtaatcaaagcaaaggactaactaatcaatcatatactccatccataggcacaaccacccttaacaacctaaagatcaagaaataattattactagttaatgacatgcatgtatgcacgccttatattataaataacttaaaaattagttgtgcctagtatgttatggaatggagagagtataagcatgagcatatgcgcttgtggttagatcccaagagacatgtgaaatgggatacgatcacatgggtggtctcttgatcatgcatagatctcaggtgagttcattggtgtcacaaagtgctcactgcacaaactgaactttttttgtgtgtgtactacacgtacgtactaatccaatttacatgttagtgggttcaataataaataaaatcaaagctcgacatgcataaacataagtacaatgatatcttgctaggaccacttgtgttgatgaagatgtggcttccaccaagcacaaagttaattaactttaattatgtctaattatttctgatctcaaactcaatcttctcatctcatttgtcatgcaattttttttgttttacatgcactaaccaaacagcaaaagcagttggacagtgagataaatgaggatttgtgctctcttatggagacaataggtcatctcaactttctagccagtagatctcaaaggattagtgcttgcatgcatatgtatgagagctagtaataaccagatgattctggaaattggcagtggatatagaggctgggtttttatccacaattaaaaaatgttggttctggagataatatatactccctccatttctaaatatttaacgccattttgattgttttaaatatgtttgactgttcgtcttattcaaaaatttaagtaactattattttttttctatcatttgatttattgttaaatatacttatatgtatacgtatagttttacatatttcacaaaagtttttgaataagacgaacggtgctaaaaaatcaatagtgtcaaatattttgaaacagacgagtatattagtatacgtcatctgattagcttataatactactgcattattttgttttatatgtgtataatactacagagcatgctccagctctgtagggtttagatcactaatcaacaaaccctaattattaacctatcttatgtccctttcttggcatgtggttgcaaatgatctggtggtctcctatgggtgaaatattttagtacaatgattgctgcaaattgacgagacaaacaaggtgaatagaacaagaacgaggacggtgactggctagattctcttgatcctgaatattatgctaattaactcgatcttatctaaaaaaattatttcgccaagtaggttctgtcttcttctcgccaaacaggatcttgggaaagttacatgcattattttctcgccaaactactgtactagctaccgctccaaaaataaataaatatatagatttttattttgatatgaccattgcgtgcaagtggaattatattgtgtttataattttaattagtttcttgacaacaacctgatctttgtaaaactattattggtcttagttttagtttaagttattaattaggaagagatgcttacaatgtgtgcttagtttgagctgattaattaattatttacttgacaaagtgttttatgatctctaggtatgttgttatggtaatatggtgtacacgttttgttaaaatcagaaatatacaaaaacaataattggcacaaaatctttgcttacacatgcatgcacgcttcattttgctcaggaacgtagtgcctgctagtacacagtcgcgtgtacggccgggtaagtatatataatgcgtatacctatatctatatataggcacaattgggtatcataaaataaaaactattatccgttttggtcgacctgaggaaaattaatcggaaaaagatcattttgatcaggggagtggacaattaattatatttattagcaggcagaattagattaattagttagtgagggaatgatcgaatagatcgatcaattaagctagtgttcgtccgtgttaataatgatcagttacatctagctcaaaaacttatggtttcaataattttggacaacaatggctgattaatatcgttaatgcgtacaagcaggtacatatatacacatgacagatcgatataacacattacatatagccgtagacagttaactaccttgtacatatatatacagatctttccctcaaaaaatatatatacagatcgatcgatatgacatattatacatatataattaaaaatattttaatcctcgcaagaaatgactctgcaattttaacattgaatggtagatatagatggtcaatccacatatatgcagaagttgcaatgcatatatagtacaattaattagctcactaattcacttatatatacgcatttttttccaaacaggagaattagtaacatgtaaaaatgtcaatcaaatagttggccaacttgcatccatacgcataatttggggctccttttgttttcctcaaaactaattaatttggggctcatggacgactttttaatcatgcttggtctaaaaatgctcctggatccataataattaaatccacccgagagataatctcgatatcctcatatacatgacatattattaatatacgaagtacacgtacgtactctttgaaagtctccatttattaatatgtgcatatgttagaataaattaccttgcaaggataaccggataagttatgcataactaatcaacaaataattgcacatatatattagtaagagatattattttggggatctttgatgatcgtcgatcacaccatcatgttagcttttatatatacatggactggaggtagctgcatatatagatcgtgtatgaataattaagatgaataatatttgttttagaagactagaagtagcagctaattaagatgactaattaattgctgatcgagattttgcagctgcagttcttgacttgctcttcttttttttttctctgaaacaaaaattaaaagcaggcagtcaggtcaggtctttgccgtgcttggacaggttacgagtgtacaaacacgtctagattcagacgaatgtttggatcgatggcatgcaagagaatattccatattccccaacccctgttcatcggatgcatgtagctgcacagtccgtgtatgtacgccgcctagctttgacctagctcgatggacccccttacaatgatgacatttatagataatagtaaagtgtccttgcgtttttacaatggagttttaagaaatagtaatgataaatttcaggagttctcggatatgttaaagttgatagttgatatatactatatcggactgttttagtttgacattgtgcactcgtcatagcggggaaaattcatattaatggaataaaaaaagaaccgtgtactatttgaaacccattgagaagtatagtgatattgacgaactctgaagttgctcaagtttttttttgcatggttgttacatggataacaaggactctccggccacgtgaatgatagtgagtaggtggtggtggtagatcgctaccaccactattagagtcttttatgtatatacgagttaggaccttcatgtggattataatacatatgaagatgtttttaaatttaagaaattgatttttggattcatttacatgtttgctttgtcacttttattgcatagatatctttttatgattgctaacaagataatatttttttaaaaaaaatctaccaaaaattattttttaaaactttttaactttaaaattactctgttttataaatcggttgaaggagaacaagcagggcctaattaatacattttttacggatggttatttttggagaaacacatcaaatggtatgcaaataaattgagattaatgcttgctccagaaggttaattatttcaaccatttcatcctagaccaaaattcgattttcttaaacgatttctatggtcaaaagacttaaaaattttgtctgagtgacataacaaaatagtggatataatttcgtggtatttgaatcttctgaagataaagattaagtgttttacacaaaacgatgtggtaataacttgtgattaattgagttctaattattacaaacttgaaaaatggattaatctgatattttagaacaactttcatatagaaaattttcacacaaaacacatcgtttagcagtttgaaaaacgtgctatttttatctaaaagtttatccaacttttgttagagaaaagataggatctaaagtctgttcttttcagtagaaaaggaatcaaggtttggtccaaattaacaccaaccgtttagctcttgcacagttagaaaaaccttaattagtcggtttgccggatagatacattttcctcagaaaatgactgtggttactttaattcttgagaggtactgagacgaggtaagtgcatgcgtcttctaatgttaattttaattttttaactgtaatatctccaccattcgattggtacgtaggttatgttaataccaattatcacggcacttgagatataaaataactctaataataatagagctctgcttcttttgtataaagaactcagcggacacgccatcgttgtccgtagacttgtcacatttgcattgggaacaaattaaagactaaagagcaatcatctcatgtcatctaactgatataccggatcttaaaaaatgtcatgatgggaagaaaaatattgactaatatccaataagaactcatccattgaaatgttaatataacccgaacattgtataatccgaaaggtaacgacatttagaaaccttttcattttacacataaaaccttctaatcctaacttttttttcctaaacacttgcgcgtcgatatattagacgaaggaaacaatatagtttacatgcatctggcctcttactagcagcaaagacaaaaacgaaaaatataaaccaagctaaacacaaaagcaaggagggatacttagtgaaaatgaactccaaagcagaaagaggccaagtagggtccaccaggagctagggccaagaggacgccgaggtgtcgagccctagcttcgatccaaaaagatgagagcctctcttgaaggatagtgctgatcgagtgggcttgaaatgacacgaaaataccgtcgaatacgtgggcatttccgcttctttaagaggttccaggcaacaagagataacaagtgaatcgaagccttgcctcgcagattcggacatgctcttcctcatggttgtgttggagatctaaattacatctcaatgatttagcctatacataatcagttaatcacctctgcttcaatgcggaaacttaatctactacttgagatgccatcagtgtttttcctctttcttcttcttcgattttttttctccttttcttcttgatacgccaattctttcaccgtcatcacctcacgaaccccttccaacgctaagctgatcaggcgatttagggtttaggtagagagctcggcgtccctcctctgcccttcatctctttatataggcgcattggtgggggctcgggggttatctcgaaattttgttagaaattagtttttaccaatcacaaaaactaactctatctctttaggaatcggacaagtggaatttattctttccttagctaattggtatttagccgataaaatcaaccaacaggtcggtcaccaatttggtgggggaacgaagatcggttgcttggagatgaaaggtgaaaccggttgtaagcgtatgacgttgtattaaaaaaaagaggagggagtataaaaatatctgcgcgcacacacagaaactaaagaaaaaaaaagaagagataaacttaaaaacaacatagcgtgaatatatatgcagagattgtcatgtgcagagagaattcggagcgaggtagatctatctagagaccccacatttcacatgatgatatgtatatatatttttagatcgatgcatatggaataaattcgatcaagattggctggctactatcgctctaactaccccccaatcgaaacaaaatcagatcagatgctcgagatcgatccatcgcggttactgataataacaacaccaaagcaaattgccaaggtagatgctttgctctaaattaataatctgattaacccatgcatatatgcgtttgcaactatatattatgcaagtcgtagtcaccaatatgcttaacaaacaagagtaatataattgatgccgttatatcaattaagtaatgaacataaaccaaagtaatataattaatggcattataccaattaagttatgcacatggaagaaattaaaacacaagctagactgctggacaaaacaatactgtatttagctactgtgcatagtacggaatactagtattttatacttcatccgtgttttaatataacgctgttattcgtcttattaaaaaaatatattattatcatttatttattgtgacttgatttattatccaatgttctttaagcataacataaatatttttatatttacacaaaaattttaaataagatgaatggttaaacgttggttaaaaagtcaattgcgtcctaccctaaatacgaagggagtacttaatttgtacacatacgtacatgaggtgtcggtaggagtagtggtgcaaaaaaaaaaagtttagcatctagaaggtgcacgtggcagccgattagacactctgagatctcaagtctgaatgcatgaccacctcatatgaaaatgctatggatactaacatctcaaatctgatcttaagatagctcagtgtatctgttgccaatgtgacttttatagcagtcgtataacgttggcatatagctattatgatctttcatatttcaatgaaaagtcaaggattaagcatcgttattgattagaaatatgtaaggacaatgtagaaaaatgaaggcactattattggctatattaggtgcatgaaacatttttcaacgaataatatacaaccacacatgaaaataacattgtgtggtggtttatgatgtgcgaagaagaaatagtaggacttttataattgtaattaattgagcacatagctcatgctgatgctatatttttttagtgtaggattttaatgttttcactaaaaatttttttaaaaaatattaatgtaggattttagtgtagtattttttaaaaaatatattaatgttttttaagtgtatgattttaattttttttcatttatatattacaaaattatcacaatcaaaatatgcatatatatatatatacatatatatatagatatatatacacacatatatatatatatacatatatacacatatatatatacacacatatatatatatacatatatacatatagtatatatatatatatatatataattgtctctagcccagcagagaagtactccctatgtctttttatatgatattggctagttcaaattttaactagccagtgtcatatatatatatatatatatatatatatatatatatatatatatatatatatatatatatatatatataatgaaggggagagtaatatataacaagaacctcaagacaaaattgctgggatcaatatatcacctacgctggtacatatcctgatgttcatgaaaaaaaaaggaggtctggctctagatagaatccaaaaggttgacacttggctccattccaaacaatgatgcatcatttttggataaactgccaagtaataaagtaatgtgattgatttgaaataaattattagaggagtgctaatgacaattatatattatcctacaatcaatcatatcttttagaaaagtgaaaatagtaatgaaataacgtcatccatcatgtgaaagacaatccacgcaagcggataagactaaatacacattattgtgcgttacggtcgatccaatgagagtgatctatttattcaaaatataaaatttctagcgtttaaatcttattctaaaatacaaagatttctagcgacagtattacatgtcccttttcattcaaattttcttccttcttacccccacctatccttccacctccacttgtcccttatttaccaaggccaataaatcttttcttctcaacattaattagtctatgctaaataaattaggaatccttatgttttaaatagaggtagtacttttcaagtgacaaaaaaaaaacaaaaatcaaccgagaactgtccacatacagggagcgacataagctcatgacacctagctacagcatcgatcatctcattttcaaaacgaagtcaaagcagagcacatcaaccctagcaaaaagccccacgagctcaaatttcagacgaatcagctaagttacacacgtatctccatctcgatgtcgcgaaaacaacgtcaaacagtcaacacaaggtggggaagaaattaaccgaagaaagaatcgccggctgctagcttccaagttccaacccctctctctctctcactggcagctgggccccacaagtcccatcctcctgggtccacccctaacgcggtgctagactgatcaatattatctccattccacgaagaattcgtttcatttctatcgtttaaaatctatcccactaaaactttaattgtaaaggtaatatcatattagtataagacatatgcattaaagtgtagtagaaaaatactccctccattccaaattgatctacatatttcataggtacactaagaccaagaaaagctaataactctctcatactacatttactctagcaacaaactcaatgcatgcaccatccccactatttcctatccaatagcaaatcaagatattgcatgtgggttatagatacttgtgtgcatggatgcatgcatcaatgtccatttactccaatgcacaaataacgaatagacttaataaatgaacacaaatatgtagatcatttaggaataatcttaaaatatatatatatagatcaatttggaatggagggagtaataagagtgtcattaccatgaggtattatttttatgtttccaaggatatcatataagcaacaaaatatttaattgatgactgaaaataacttatatagctcgataggttagattacttgtgatggaaatagcccatacccaagtccaaattctagatttaacacgagcgctcgtatttatgactaattattctttcgctagacgttcgtggtgacttcgtcaatctaaaaatgtacaattatgggcatctatgtatgtactatcttcattccaatttaagtgtagtcatgagttttcgtgttcaacgtttgactgtccgtcttatttaaaaacttatgaaataattttaaaaaagtcacaaataatatactattcatattttatcatctaataataataataataacaattatatttgttttaaataagacagaagatcaaatattatatataaacagtagaactacactctttttggacggaggtaggactgtgtttctcagaaaaacttgtacaatccttagttttaccacgttattacaaatgctgatgtgacagccttcccaatgacaatgaaacacccattaaaagtaacctaatatatgaaccaacatggttattattcccattctattttttttcttctaggtcgctcaaaattaaatgaaatcttctagacgtagagagcactaaattactagtaattaccgctagtaatcacgataatagtatggcctaggagtagtaaaatatttccttagctgagaagaagggagaagcgtcgacgaaaacgccttcttcttcttcctcctccttcgccgccgcccaccgcgccatcgcctatacatacccaccccccacccacctccttgtaagttgcaacctcccgcctcacccgccgccattgacgaccaccgcgctcgtcccatcccatgcctgcggccgtgaccgcgaggttgtgaggagaagagagtcccaagagaggaggatcgatgcggcagcggcaggccggcgagcaggaggcggagctgttcgtccagtggaggccctgcgacaagaagcggtcctagtcgcccgccgccgctcgcccactcgccggggtcgtcgatctgagagggacaggggaagaggaagaagcagaggaggaggaggatgagcgtgtcgggcgggaggacccgggtggggaggtacgagctcgggaggacgctcggcgagggcaccttcgccaaggtcaagttcgcccgcaacgcggactccggcgagaatgtcgccatcaagatcctcgacaaggacaaggtcctcaagcacaagatgatcgcccaggtcagctcacccatactattttctatccccccaatcgattctcgatttggagaggtctccatggatttcttcccatgatgatagtactgttcgaatttctcgccttcttgtttttttttaatcatatcatacgctgttcttgagtgaatttcgtggacaatttcaattcctatacgtacgagtcccaaatcatgaacagtttgtactactgctgttttgtttcctctcacgacaagacgtgatgattttgttttaaccagaaacagtaaacattactaattactactagcgttcttgctgcaaaaaaaaaaaggtttggtatcgttccaaaattgcgttcttacttccaaaattgcaacagcctagactttgacgtgaggttagcacgggcgcctcgtgcagtgttcgttggaacttgtgctgagttagttattattaatgtgcatcaactttggcttagcttctgactttttgtgggggagttctgactttgatgtgtgtttgtggtttgtgtggtggtgtttgcagataaagcgcgagatctccaccatgaagctcatcaggcaccccaacgtcatccggatgcatgaggtttactaatctccaatcattaatctcagctcatcttgcccatggaaaaattttgtaactgatgataagtccaccaatgaaatcgactaatcataagcagagctcgtgattttggttcgaaattttcgaaatttcgggtctaccagtgggtcctggttggatgtgattcccagtcttgaattgtggattttttttttaattttgtaaaatttgttcgaattcagctagagcctgttcaaaattcattttttttctggtttgaaacttctgaaaaattttggtcccccccagattttttttttctaggccgagattgtgaaccctgctaattaagttaagatatggttctcaaggctttgagcaatctgaaattatgaaaaaccagggtaaattaaattggtcaaggatgacataatgaacaagttgttccttcacatgaaaagttgcaattagagatcgttctggaaggaaattcctgtgacactaaactatgtgttatctgaaactttcctagctcttgctttctgatattttccttttgttgtcttggctttatgtcgatctccacttagtggttttgttttcttctctgaaggtgatggccagcaagaccaaaatatacatagtgatggagcttgtcaccggtggtgaacttttcgacaagattgtgagtgcttggccttttctatcgacatctgaattactctttatgctatgcacacatgttcaatttgtcataattcctgttataggcttcgcgtgggaggctgaaagaggatgatgcaaggaagtattttcagcagctgatcaacgctgtcgattactgtcatagcagaggagtctatcaccgggatctcaaggttagcggcgtttaactgtttgcggtgtttactactgctatgcaagagagccgagaagcagtgaattgatacacaaattcaatttcagcccgaaaatcttctgcttgatgctagtggcactctcaaagtatcagattttgggctgagtgcactgtctcaacaagtcagagtaagtaatttgactcttcctatttattcttttattatctttttgtggagagtttccttttattcaaagtgatgaaaagccgagagttgttagtcgtaaaaaaattagcatttcaattgctttctgtagattccatttgttttctacatcttttcacatggtaatacagatagtttcagatccatctgaataaagttcttacattagtgctgcatatctttctgtttactctgcaggaggatggtctgttgcacactacctgtggaactcctaattatgttgctcccgaggtaccttcttacactcatacattaaactagtatatagttattatcatcgttggattgaatatttgttttcatgttacttatctaaaaaaatatttgttctcatgtttcaataatattgtctgtgcaggttatcaacaacaaaggatatgatggagccaaggctgatctgtggtcatgtggagtgattctctttgtcctcatggcaggctaccttccatttgaagactcaaacctcatgtcactttacaagaaggttggtccctcttaaccatgtcaaaggattgttggtttatgaaccctaaacaaagtttttgtttggaagattaatgtgattattgctcatccagatcttcaaagcagacttcagttgcccgtcttggttctctacaagtgcgaagaagctcatcaagaaaatactagatcctaatcctagcaccgtatgttttgcagcattttaaccttcatttctttggagcattcttatacataagtagcttatcccatcgttatctccttgtgcagaggattaccatcgcagagcttatcaacaatgagtggttcaagaagggatatcagcctccaaggtttgagacagcagatgttaacctggatgatatcaactctatttttaatgaatctggggtaagctctcacaccattcagctcatagcattacattcttcataatgcactggatgggcttggtaacatctattctaactaacgcaggaccaaacacagcttgttgtcgagaggcgagaagagaggccatcagtgatgaatgcttttgagttgatctctacatctcagggtctcaatcttggcacactctttgaaaagcaatcggtacgatcacattcttaaattggtcattctgaagtctgaactaaacatgttcaagtacacttacagtcatgagttataatctaaaatgctaaaccaattttctttctacttttagcagggttctgtgaagcgagaaacaagatttgcatcaaggctgcctgcaaacgagatattgtcgaaaattgaagcagctgctggacccatgggctttaatgtacagaagcgcaactacaaggtaactaatccaaaattccacaacttgtttctaccatttttatctgaaacaattaacattctgatgacacttttatggattggaatcagctgaagttgcaaggagagaatccaggaaggaaaggtcagcttgcaattgcaacagaggtacaccaatgatacaacatcactatttactatgttctgtcattctatatgctgtgcagcttgtgctactactctttcctgggtttatagactgaaatcagttcatccatttctaaaggtttttgaagtcacgccctcgctgtacatggttgagctccgcaaatctaacggcgacactcttgaattccataaggtacacataacagtaaaattactgcaggacctcacagttcatacttcagactgggattcggctaactcatggtgtaattttttacgcgtttcgcagttctaccacaacatctccaatggcctgaaagatgtgatgtggaagccggagagtagcataatcgcaggcgatgagatccagcatcggaggtcaccgtgattggcagtttggcaccaaaagttcagtgatagtataaagtagataaccagccaggaaaacctactaaggaatggcctgtggctgtttttttttttttggttctttttaccttttaagttgagttactatctaatctagacatggttgtaaacaaagtttgtatggagatggaatgtgaatgaagaatgtgcatagttttgcttccttgacttattttaaaagcagtaacctgtgaaatccgatgaatgaaattgaaatctgcagcaggatgcctgacgatcgtagaagacttgcagcagatatgagattacatatatcctctttatttcagttttgatgcaattcgtaaatcgcaaggctcccatcggatggcctattcagccaaagaaaaagccaaaatttaaattttcaaacttaattttgacattgattttgagatattttcaacgtagtttctttttgagcattgacttttaagtcaccgagaacacatatataaaagttttacctacaaatttatttttatactctaataagccgtttaggaaaaagcaaccgatgagccccaacaatcgagagcgatctccaggaacagataaactgcttgctctctgcgtgttcatgttcaccggagagtgcggctccgtacactgttacgtcgccggcggcaaatcaggcggcgcagcgtctgccggctatggctggtggccggaagcgcgcagctagcggcggaggagcttctccggtcgccagagtcgagcacgacgtccgtacgcccggcccgacccggcccctgtacatacattgccaacaaatctcggcccgcttgagggaaagataataggcccatctaaacttggctcgctaccaatgaccatggaaaaaatcccatatgattaacttgtcggatctgatttgtgggtcctactttatttctagggcaggtttagattccctggcaagttttttcaccctatcacatcgaatgtttggactagggatgacagtcgggcacgggcagtgagataattcatgtccgcgggtatacccgttactacatgacgggcaaggaacactatccatgcccgttgcccgcgtttacccatcacagactcacggttcaacgctttaaccccaaacagagagacattatcacagtttaaagaaaggtacagttgtaccaagttcaataatacaaagcattacaagttcatcattactggatggtggcatttatactaatttaactgagggaccacatgtcagtcagtttttgtgggtaaacgggtgaaccatgcccgtatacccgttgggtataggttttgacccaataaaaaacccatgggtactaaatggagaacaaatccaactctattagtgtcgacgttttatgtcgtgattccggtatttgcatagtatggggatcgttggtactaggatatacgcgagactgaggtaaaagagatggagacggggatttttatacaggttcgggctcctgaattgtcaggtaataaccctacatcctgttggccgaagccggtattgctcttattcaccataatcataccagtacaatatttggggtagcctatctaactgttgtcgacatggcggtttgaaggtctgactcatagtcgacaatagggtagtcttcctcctcgagtttgtgctcggcgagatcagagatagcgctttcgtctctcctgacagtatccggagacaccgtaggggactagccgtgcctatctctgaagtcgatatccggcgtcttgtcttggcgtatgttagcttgtatgttgatcttctgtcttgacctattgttccgtgtatgttgattgtgggtggcttccatggtgggtgtctcccctctcctcctagggggccttgtatttatacccataggtgtccccttgtccaagtagaattagggaaaccaatatggatacaatccgagtagtccttgtcgtttccatgtaaaactctggttgtctttccttatccagaactcctcctatatccgcaggttgtttccgtataggacatggtatgtggtggatcctgccgagatttagtcaactactattaggtacagggtatctataaccctgacaattagggtttttatccatgagtaaacgggcaaacaagttaaattgccatccctagttccgacacatgcataaagtattaaatatagaaataacaataattacacagattacgtgtaaaattacaaatcttttaagcctaattgctccatgatttgacaatgtggtgctacagtaaacattgctaatgacggattaattaggcttaataaatttgtctcacggtttacagatggattatgtaacttgttttgttattagactatgtttaatactctaaatgtgtgtccgtatatccgatgtgacacgataaaatttttcactcctggatctaaacacagccttagtttttaagatgactagactgtcatgtcatagaaaaccgtctttaaatggccaagagtgccattttgaatggttttaatagttgaatgagtcgatatatccgtctttgtgtatgggggggggctatatctgaggtattttacttgtattggacttttttatgtttgacacataccagcgaccaacttgtctacggcacattgggcctaggatgcaaatgggtcaacctgcgaaacacatgtcaaatactccctctattttttaatagataacgccgttgactttttctc

SEQ ID NO: 4455 - DNA, 8421 bp, Oryza sativa
taccctatcactcataatactttaagtgtgatttatatcttacacatttgcataaaatttttgaataagatgaatggtcaaacatgtgagaaaaagtcaacggcatcgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgtacccgacccattcactctctctcctctctctctctcctctcgcccgcatcggccgccatgcgcgaggaggtgcggagctcgtcggcggcgccgcccgacccgccgccgcgttcggcctcgccgcccgccacccccgtcgccaggtaacctcccctccctctcgctgctctctccgtctctgtgcgggggactcccgctgtgctgctggtgatgatggtgcgcttccgaatcgaatcgggggggaggctttgctcggggaaggggacgggtttggattcgcggcgtttcggctcgcgcgtggaagaatttcggtttttggtttcgtttgtggctctagggattttggggggtaggtgggttggtggaggggtctcgtacacctagggatttaggggcatctatactaaaaccctagggattactatctagtttgtggtaatcgagaagcctctctttcttctttttttcccgcggaatcttagaattggggccttgtagaaggcactactacctgtgtgcctgtagctctgggagaaactggtgttttgtactagttcgtaattctggtactgttctagtgtgcgccttgctctcgcgagcgagcttactgtagagctagatttctggggtgtatggtttttctgctgctgtcctatggtcagctgggcgcttatcagtcactgtggcattgaccttgcacctgttgtggttcttcacactgatgacatgttctttgcactggtgtcaaaatacatgtttttgtggtcatttacttacgtagtctcatcttgagcccaactagttggatatttgccaaatttggaatgcttaccatttttagatagaataaactgttgtactatcattttttatcgttatttggttactatggttgggttgtaattaaaatgttccaatgatatatattgataggatttgtttcagaacagtatagcgttttcagtgtatgctctccacatagattctggtgtatgtgcatgctgaagctcattcctctcttatttacagttcggctggtgcatcatcaccacctgcacaaacaaatgcagctagcatagattggttaggtggtgagccaatatccaaagtggaatcatcatcccagattgctccacatgctcctcggccttctcttagtactaatgctgctggagctgccgtggatttctctcaaccatcttgtagaccatgggaacgaggagacttgcttcggcgactggccacattcaagtcttcaacatgggcttctaagccaaaggtcatttctcttctctagttggtccttttttgttattttctgtgattgtaatttgtaattggcaagccgctcaatcttacccttttgcatttataccagtttagaattaagaataacatttttcgctcagaggatgtatataagtgaatgctgagaaacatgataaggttggtaatggaagtctgaagctaaagatatactacctctgttttttttatttgacgcttagttcaaaatagaaataaccaatgtcatgtaaataaaaatggagggagtataatttttatccatatgccacatacaacactaagttttgtctcatatattttctctttagtccttttttgcatattggtaatgctcaggagacatcttgtaacttagatgtgttctttatacctagctgcttacatatccatgtctaaatgaagaattacaatgtatagggcaaatgacatgtttgcccaaatgcccagctgaaatccagatcaggcatatgtttgataatttttgaaccagtacatcactttctgaaatgtccagcttagcatgtaccttatggtacctagataaagttattttcggccattttgatgtctcgtattgcaaagaggaaaaaaatgctactgaaaatgacaaatccagtttgttttagaagaaactaatagcttaatttttacaggctgctagttcactggcttgtgctcgaagaggctgggtgaacattgaaatggacaaaattgcatgcgagtcatgtggagcacatcttatatttacggcattgacatcttggtccccagctgaaggtatgtcctgagtgaatgtattttaccgcagatctatggaactagctttttcctgtttaggtttgtcctgcagatgtatggcatgcattatttcaatatgaatacttgtgttctcacagataatcatgcttgcttgtttcatgaaattttgcaacaggaaattccatgtgctttcttgtgcatataatttttcactgtcatctgaattagacagatgtagtctgagaaataagttggttgctgttggatgaaattatgcctttagttatttaatgttgtttgtatgatgtgttcctcaattgtacatacagcatgggagcagctcttttattgcatggtagcaaaagtttgtttaggttctcactactgcaaaacaaatttatgttattaatggaacaaaagggatttgtgttctagcattcagcattaccaacagtcatgacttcttgatttctttcatacacgcttctcaaaatcctgctacccagtttcatttttaccatactatttagttgagataggcatgtgccgttttggctatagcatatttcttctcaagctgaaataagctcagctgcgaaatctaattttccctgactacaatctgtatgttatgttgtagttgctaatgctggggaagcctttgcggaacaacttgatgcatcgcacctgggtgattgtccctggagaggaaatagctgtgctgatagcctagtccaattccaccttaccccatcagctcttgttggtggtttcaaagatcgctgtgatggacttttgcagtttatatctcttcctgttattgccaaatctgcaatagagagtatgaagctcacaaggagtcctcagattgaccgtgtcttatcccaagcaatcactattttatctggagagctgggttacaaaacagacagcacaacaggaattgatatcaatcatcaagatgagtcctgtagctactctcaagtaaatctcttgttatttatgctctcatatctttattctttgctgctatagtcctcagaatttgtggctttatttaatctaggtcacttccatctaatttatctaggcacagaaacttataagcctttgtggatgggaacctagatggcttccaaatgtacaggactgggaagaaaattcaacccgttctgccaaacatacagcctcagctgatccagatcagatccattcccgtttacccgagcataagcaaaattcgtactctgcatcagttaagaaagataagggcaaaggaaaaattcatgtaaaagactctggatgcagcatgaggtcacctttgcttgattgcagcttatgtggagcaacagtgagaatatgggatttcagatcggtgcctcgtccttctcatcttagtatcaataatattgacgcacctgatatgcggaagggggtgctgacacgtggaattagtgctacaagtggcatcaatggatgggttgctgaaggaacagaaagagagaatgttgaaggacgtggtgaggcaggtaccgatgagggaaaatcactgtcaaatgctcaggttgacctaaatcttacaatggcaggtggtttgccatctacgcattctgtgatgccctctatgcatgatcatttcaatgatggagggatgggaagagatctgatgattgggcagcctactggaagtgagctaggtggctttgcagcctcatttgagtctaggggtcctagttcaagaaagcgcaatctggaggaaggtgggagcacagctgataagccgctaaataggcttcatcctgctgacagcatagaaggaactgttattgaccgtgacggtgatgaagttgatgatggcgcacaagattcagatattcggagcaacaaaaggcctcgtggtttcaatctcttcgatgtgaatcaaccatcttcttctggagctggtcccagcagaaatttaagttttgacctggatatagatgtcaataaatttgatacatataaagctgaaggtccatctgcccttcataacccctctgcgtcgatgagggcatcttctgttattgcgatggacacagtccacagtgcagaggaaaattcaacagagagtgtttgataccatccatgtgatgttgatgacgttcacaagccgtctagtgctgtcaggagtggtggaatgagtgaggcattggatcttaactatagcaaccaagcaccgcaaagcagttttgtacagcctgctgctgaaagtaatgcaagggagataggaggtagtagtatgaatggaggggaggaagtcctcaatgcagaaactgctcctgcttttgctagggaccaactaagcctgggagttagtggagggagtgttggtatgggtgctagtcatgaagccgaaattcatggagttgatgtttctgagcataaaactgatagtgttgttggagatgtggaaccagctcccgagcttactgaaaatatgggcaatactggtgagtcagcccctggacctggaatgatggatgagtttgtccctgaagatgttggccgagaagaacctcagggtgatagccaagatgtggcatctcggttagtgggtagagctgacagtggctcaaagatttgtggttcaactaaagctgattctgttgagagtggagagaagatgagccatggcataggtcatgagagtaacctacagcattccctttctcgcaatgctagagtttattctggcattgatctgtctaaagatgaggtgacacagattgctaaattgccagcaaatgacgactatgatccaggagatgatcttggtacttcagaatctaactattctgcaccacatcctttcattgaactatatttatcaaatcttttatatgtttatcaacagagggattgggctgtaagctccaagaaccttcatttgtcaaacttaactttattaatcagcaaagtgttgataataatttcacagtagcaattttggcatcctatgcttaaataaaacagctgtcaggctgtcatctgatatgcatacacaacaattagagaggaatccgacataaatgcatttgctgtggcaagttaattcgaatactccgtttttatgttattccatttgtttgttggcagcagcaaacgggggaaatgactatgaagcaggtcttccagaatttgacccaattagtcatcacaacaattattgcccatgggtaaatggacatgttgctgcggcttgctgtatcaatactggttccagcactagtaccggactttccggctggcagcttacagtagatgcactggaaactatccagtctcttgctcaagcccaaaatcaaattatgccgtctgactctgcggcatcactgtataaggtaagttttgcgcagaatcacaaaatgcaatcctttgtttattaatgttttcctaaagaccagcttgaatcattgcatggtctatttgcaggatgaccatgtggcgcctagccgcaagctgttgaaaagggctagccacagcaaatgttaattgaagctcctcctatacagacatacatttggtgaacttaactaatccttgtcaccagcattttcacagttcaaatagttgactgatgcaaacctgagcagagttgatatactatttgcaaaatttaggttctggccactgacagtccagaagagctttgaagctatccatgatcaggtggtggaagatgaataaattaagcttcaacttagttattgtagagtgtagatgagtctgcctggccttttgccgagttgtgccccctttggttgtatttttgtatttcgaacctctttgtatctattcaagttacagacagattatctagttagtgaggctagaactttgaacaaccttgtcctttttcgtcaaagacctaactgtgcaaatgtgcaacattttgtccaattaagtattagtttccgttgtattttgattgctatcaaaactgggtatcgttgccgatgctgatcagagctatcggtgattagccctctcctttgacaagccattcattcatacctataaatgcatggtaacctcgtcaattttctgctcgatcatatatcgtgctgttcatgaccgtgatgtcatgaacaacatttgatgctgaatttccttgcgtggcactaggttgtttgaaagtggaattgtatttgataaatgcaactttctgttccaacgtaatgcaccctgccctgtttggattcaggaattcgaaaattagagttagattcctctagttatgttgagggtttaggagaactaatccccactactttacatcgtattggcgattcatatcttgaacggaagagacagagataagcacatcctttttactgagaattcggcgacaaagatgattccaacaatatgcatgcagccataataattttattaagagaactttcagtacatatagcatggtggtgtccccagacgcaatgttcaagttgatcatgtgcaatgttcctgcgtattcaaaggctcacaaaataataagatatagtttcttttaaaaaaaaacagatgaaaagaaagataaaaccacgatccccaaattccaaaactttacctccaagttatatccagcttaattatgtcccggcccataactaattaactaacctatcgataattatctggaaactataaatcaatcaattaaaccagcaattaaaccagcgaccctagagagatctagggttatcccattctttgacgagacctccatcgatcgcttcagatctcaatcaatcaaagtaagtaatcaagcttcgtctccattaccgatcaactcctccgcgcgctcgccttgattaattattgagttcgattgatctcgttgctgtttctgtgtagtataattaatcatcattaatttgatcatgatgttgtagttgtaggtgatcatggcgctgcgctgcatgctgatgagggcgaggacgacggctctccggccaccggcgtcgtcaggacagacgtcatctccggcgagcatgctcgccggcgccctccgctccccggcggccgtgctgatgacgccccacacatcgccggcggcggcggcggcgagttctcgccgccatctctccaccctcttccggcaggtgcgtacatagttcgtcattgatcgcttggcctcgtaaatcgtaactaattatacttttctccttccatcaacaacgtgtattaatttcaaaagaaattttaggatactttgagaaattaacttaaaatattttggtacctatacatcttgatatcttcttaaggatgataaattatgttaggaatttccccagcgatcgctagcaggaaaccagacgacacaacgcatgcgtactgtggctaagcctgcaaattcgcagaacagaggaaacagagcaaattttgtgcagcgcttttctcagctgcttttctggttacttacatatataaaggaacgaatacaacggaaacaactaaccaccaagaccacttctcacgccatgctctagctgcgtccatccccacaaccacacgacgtgatccgagctcccagcacaagacgcgggcaacgagctaaacctcggataccctcataacagactccacacgatggctatcacacaacacgtgagctcatgcgtttattcagaaaaaaacggaaacatgcagataactaatcaactaactaacccgtggcacacaagattactgctaacaaaactctccctaagcttgatgtgccgattatacaggaaacataccaatttgttcccgcagcttctgaaacttgattcgagaaagcggcttcgtcaggat

SEQ ID NO: 4456 - DNA, 5387 bp, Oryza sativa
gcatcacttagcgatcatgcactttcctgttcagctttagacatggttccatcggtgttgcacagggttgcagcgggtaagccaagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgccgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctcctgtccatcgatctcaaaccccggtggctgaacaacatacacctcctcaatcagttccccattgaggaacgctgatttaacgtccatatgatgcaccatccaaccttcctgcgcagcgagagcgagcaacaaacgaatagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcgtcgtggtctgcatcaagattagcagctgctccagttggtggcgacacaaaatcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgacgaagtcggtgtcgagatcagcggccgcctcagcatcccagtcccactgggccgcttcgtcgaagacgatgtcacgggagatgtgaacacgccgagtagccggatcataggcgcgatacgccttggaccccggctcgtagccgacaaagatcattggacaactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacccggcggtatttatcgcctctccccaaaacatacctggtagccccttcgccttgagcatactccgcgccgtgcccaccacggattggtttcgccgctcgacaacgccgttctgttgcggagagtagggcgccgtgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccagctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagaccaggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgctgagtcgcacgttcccggtgatgttcgtgtcgaggtcggcgaacgccatcctgctgcccgtcatatggtttgacgcgccggaatccataatccagcgcccgggatcatggtcagccacgtcgtcgagcgctggaaatactttcatctccacgagttccaccacggcttggtggggcggtgtgggcgtgtcgccctccggcgccgccgcgtcgaccgtgtcaacgcggccgccggtgagcaacatcaaggtgtgctcttcttcatcctcctgggcgacgtgagcctgttcttcgcgcttggacttgctcctacagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgatgactttatcagcaggttcaggatcaccgagggttgcaagctggttgacgatggttgtgagccatagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggctcgatcgccgcccacaggcagtgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttacatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacggaaacatgcagataactaatcaactaactaaccgtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctatgccgatgtaactcggtgtgatttccccattctccacggcttcacgaatgaaatgaaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtggtgctcttgcgagtgtcaatgtctccagccatatcactgtcactgtaaccctgcagtcctctttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacatggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccattggcgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctgctgttcatcgatctcaaaccccggtggctgaacaacatacacctcctcaatcagttccccattgaggaacgctgatttaacgtccatatgatgcaccatgcaacccttctgcgcagcgagagcgagcaacaaacgaatagaatc

SEQ ID NO: 4457 - DNA, 10592 bp, Oryza sativa
tctttcttatgcaacaagctagaattaatgcatccaactgctgtcaataaagtttggattaattatttcgtcgtcaaccggagcccaatctgatcgcgtcgcgcatacccgtcgtctgccttgttgctgccatctcctgatcgcgttcgccgctcgatcgaacgatcggttctgcgatctcatcgatccctggttgattagccgatcgatcgatcatgtcgtcgctgctgcgatgcacgttgatgagaaagacgacggcggcgacgatccgagccgccgtccggtcaccgccgccgccgttgtcgtcaggacagacgattacgccccatccatcgccggcaggactcctcgccgccgccctccgccgctcgccggcgtcagcactgatgacgccgccgcgcatgtcgccggcggcgtgctctctccgccgtcttgccacccaccccggtcaggtacacatatatagttcgtcataaattgtacagtaattaactaattaattaattatttctcctcgttctccatatgcatggctcaatgcaattaatcacgtacacgcacacatgcaatttatcagaaactgtaatgcatatatatatgtactagaacggccccataaagtacatatagaagtcatacatacatacatacatacatacatacatacatacatacatacatacatacatatatatatatatatatatatatatatatatatataatttatttatttatttattttattttcaaaactagcaaaaatgcccgtacgttgcaacgggtgaaaaaattgtaatgataatatactttttttcatgaataatcatgccaatcacaatgtttgtattttaatgagcagcttgttttttatataaacgggcttttttttcttgcgaaattttctcaaaccattcagaaatggcgcatttctttctaaagtttctttctagaatgtttttttttgcttttttatttacaacgaaaaccatatttttctccctttttttcttttcttttttcgtgtgtttttttgcctttttttacaattattttctcgcgcgtttttttgcttgttttttttcaaatgttctttttttttgctttttatcaatagaggagaatatatgatgaaataaaagccgtgtagtaggtggcaaaaaatcaatggatcctattctactcagagcgattttttcaatagacggtgtctttttcttgcacgattttttaaaaccattttttaaaatggcgcgttttttctgatagttttttcctcttatgtttttttaaaaaaaattaccgatgatggaaatatttttcttgcgcgtttttttatggaagatggaaagcctttttagcatgttttttttttgcacttttttttgacttttttctcacgtgtttttttgaatcgtttttattttctcgtgcattttctctttttaaatagttaggttatattagagatagaggagatatatattgattagaaatcagactttgttttgtccttttcattttttttcttgtgtgcattatttattttatatgaaccagctttttattttttagaactatttttttcgccactttcttagggaatcggacgaactttttaagatgtttttttcctttttttttgcgtttataggaatcagactttttcccgtttttaaaggaatcgaatctaatatttttgtcaccacttttttttttgccttttataggaatcgatttttttccgttcggatctatggttttttttcgccacttaggggaattgttgtttttcttttttttgcagcttttctttttctttttatgcacctttctccttttgttctctcttttattattacttttaacaaaaacgatgtcaagtaccttattgcaaaattatagggactcaaatgtaaatataaaagttacagtaactcaaatgcaaaagtacaaacccaaaaattaaaatcatataaaaatggaatgctcttgacctataggttccgttttttaaacatattttcaatctggcacatcattttgtttcaccaaaatgtgtgagatatcacggtatagaatgaaagagtggtggcgggtatatcgaactcaaaaggagtggcgtcttttatttttcgtttttaagggggaatcggatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattattggacggtttggattatcatcagcacagaaaaatgcctactgcagctctacttctccacaacaacgaaggcatgcgaatacactactgcgtcgatttagggacaaaattatccaaacctggaggtaacaagttttttttttcactattcaaattaagatgaaaattgagggtgacacttaatttgcacgtttacttcaagcaaatgtttatatatatgtaactaccccatctacacattatatatagttacttataatatgtgtttacgtcacttataaacattgttacatttacttttaaagaattatatatatatatatatatatatatatatatatatatatatatatatatatatatatataagatgaatacaatgaaaaaagacaatactagtaactattcaaatggagttgaaaaaaacaatgcaagcatcatctacacctgatcatcgacatgaaaggaacggccgtgaaacaggaaactaacatgactatagaattaacatactttagagcaacttgcatgttttgtgttctgaggaagaattaagtagtcactcgaattgttaattaatttttctagtaataaatagaaattaatccggtatgtagacaactaaagtttaaggaaaaaaatttaaattccagtcctcacaactgagaaaaattacagataatttatttagagtgtatatgcacttgtactagtaattaatttgcgtctgtcttttttttttttgaattgaaggcatgaagaaacacgtgagatgatactgaatgtctctgcaatgctgggtttggttgctgtcgtcgccgtcgtcggatgcattatgaagccccactttgaggcccagctagagaagcttgcccaagcttttgttttgttgtttctactggctctacttcaagcaatggtagaaatgcaaaaggaacgacggcaaaagagcctagaagatgatcatgctgatgattctgaagagagcaagaagaagctgaagccaacaaaaacttagaaacttttagtagaacaagttttacattgtgcaaccatgcatgcacataggatcaaaataattatgtatacaggccggggagtagtggattattccagcaatctacatttttgttttgagaaacacagtataaatataggcgctcacaacatgtataagttcacatctataaacatacacatatatacacaccataccccgttacaagatatacaactttttaccaacagtgattaagtaataaacccacggtttcaaaaacattgtaggtgattgtcaagttgatgataatgtagttggttattttatagtctcctatagtctttttctgatctccaataatataggttgttccgttacttgttgaaaacggaatacctaagtgcaacggattagtttacagagaaattttgattagctcgtattatatcatacactttccgttatcacttggtaatttaacaacgtttatgggaatttggccattgtgatgacgggataggaagccagctttttttttctaactccaccttgactgttcattaataaaggacccccacccgtgacgcggtgcgacccttgcacccccaacacccacccccacatacacacttcctggtgtttcctcgggcactagcggccaaagaggaagcacaaagaggaaataagtggggtctatcttcctagcgccaccgctgcattcaccttaccgccgcctaggtgggcaagaaacaagctaggtgacaatgcaatgacctcgaccactccagatcttggtccataagtgccctccttgtcatcttcgccttcttgctgtccagccccccaccatcgcatgccacaatcgagtttgttctcaatctacgtctatcatgctcatcgtcaccagatcaattggaggggagagagagagaaagagagaggaggggaacgacgacggcgagatagggatggacaacagcagcaactgaagaaggaagcggtggaagcgagatagggaggggcaatgtctagatgggagtcattcgttcctctttgatttgatttgcccgaggaaggaatgcacgagagagggggaggatgggaaaaggagaggggtaggtggctgaaatgtggttctgttaggagggaagggtgtatgttaggtctttttttcacagggtccaagctgataaggtcttaattgatttggtaataaaaaaagtaaattattatgttggcaatgcacgaacttgttatgtggtggaacctgctcactagagttcaagtcctagacttgagaaggatgctcatatatacggctaattattctttttaaggtagtgatgagtttatcctaatctcaaaatatgttggctcggcctttcgaaggttctcataaggtcataagggtaagttgtgcgcgcgtacgtcataaggtgattgtgcatatgttggagcgtatgcatttgtaatttgtttctaaaaaacacacaacattagttttctttattgccaagtatacacaacattaattttttttattgccatcccatcaaaagtgtttatagagatagaatgtgtgcggatgtgtttataggatgattatatatgcaagtgttgtgagctcgtgttattttaaaaaaaaagttcccacaacatttaatttcctttgttgccatcccatcggagtgtacgttgattttacgtaccaatcgatcgacagaaacacgtactccctccgtattttaatgtattactccggtgactttttggctaacatttgaccattcgttttatttaaaatttttgtgcaaatatgagaatatttatgtcatgcttaaagaatatttaatgatgaatcaagtcacaataaaataaatgatagttacataaattttttgaataagataaatgattaaacgttggataaaaagtcaacgacgtcatacattaaaaatggagggagtactatacaccagccttgttgatctctcctctctctctctcgcgtcgctttgcgttgcgccatcgacgacgattacatctgttgcatcacccaaattaaggtgaaccttggtacttactgctggttcgtcatgtgcccctgtctactgcatgattgattccataatttgttttactgctcaattctgcgtgtgacgattctaggagatgttcggttagatctgtgatagtctatgatttattaattcttgtgattttggttgtagctaggatgccgagtggtgaatataattttcaaataagatatatgaatggtacgtcaaacgttggacacggatatccacgggtgtacttattttagtacggaggtagtagtaactatgtggtggggttagtaatcgagtgttctattagtgttcggtcctagcatactttggactgaccggtctttgcacaaatttgatttttttttcaaaaaagaaaaacttagctcaaaattcaaccgtcaacaaatatcaatatcaccctatacgtcgccgacacgacacaataataatcgatcttgtcattatttgcgttatttccgagacaaataagcttctcgtcgacctgttaattaattagatctcgatcttgatttggagtggatcgatcatatcatggcgctactacgctgcatgctcacgaggacgaggtttattatccccaaatcgtcagccaccctccggccagcgccgccgccgccggccgggctcctcgccgccctcggctgctctccggcggcggccggtcctctccgcggtctcgccactctctcgggtcatcagctggtacgtacgtacgtagaacgtagttcgatcatcaccggcctaaaattactatcgcttaaaaaaacgtgaatattaaagaataacctaatatcaaataatttaaaatgggtgaggcttcaaactcaggtcatctagcccaccaccttatggagctagctgaaagatccatgggtctcaattctaccgcttgatctgcagtttacatgcaattatattcatgcaagctagcttgattgattattactccacgcgttataagtgtctgcgcgtttgtactgtgtttctgaaaacataacaatgtaagacgcaactattattcttcatgtttggtaatacaagacgtgcatttatacatcaaaataattatcatatcttcttctaaatttgttttttttaatccttcaccctcaagataattttattggatacatacatcgtatttagtaattatttcttggtttttacgttagaggtagttacaccttatatttaggattgagtgagtacatacttccttcatttcatattataagacttttctagcattgtccatattcatatatatatatatatatatatatatatatatatatatatatatatatatatatatatatatatatgttaatgaatctagacatatatgtgtccctagattcattaatatctatagaaatatgggcaatgctagaaagtcttataacctgaaatggaggcagtacaagccatcgatcgacgattttatcatatcttttggtatatggtatatgaatatagtatatctcattttataatgggttatttagattcatgccactattaattttacagatttaaagtatgccactactatttatctatttaaaatcataccgctacaatttaacacatatttaaaatatcactacttacccttttcataaaccgaaatttatttatttattaccaaatttctcctatcttcttcccctgatccccttctctctccactccccttcctcctatgtcccatctctctcttgatctagaagagacctagttagcttaggtcaagggaaactgagatccaagagagaatgggaaggaatgagtggagagagaagaggatggataggggacgaagatataggtaatttggtccaaaaataaatcccaatgcattgaaaagctatgtagtgactttttaaatatatattacattgtaatgctatgactccaaataaatgaataatagtgatttatttaaaaactatgaaagttataatggtgtaattaactcttttttaataaatgatgtaattgaatttttttttcgttacattattctctttcataaaatatttttttttgcaaataggcagctaggcatgcttaaagtagttttaaatttttgaaagaactttgcttaactaagcatttgaataaaaagtgtttgtgaaaaagtatgagaaaacgataaactgcatcatatttaaaaagatggagatagtatcatagtatatcccaatcaaattaaggtatatgtacttctccaccatcttcaggcaggttggtacgtatgtagttcgtcatcgatcaacccagcctcttaaatcgtgatttatatattctttttctcccttgatatatcgatatgcagttaattaatcacataatcagatgcaatcaacaataatagtaataattatatagtataaataacactggacaaccaaatagcaacttcgtgtcaaataattaagaaagtgtaggcggcgtacccctttcgctatactatcatgtgcatttcattgatcatataccttttgatacccatttctcgatagaattaattaattaattgctcaaatattgttgttaagtttagatgctctctgctgataattttaaccttctctgctgataaattgttgtgacgtttaaaccgacaggttgataaaggatgctgtagcaatccagtcgcaaagagaggagcatttgtgagggatgttcttcaacggtttggactaagaaacttcagctcttctatgtattctcaaaagcatttaaagctgtcacctcaaataagtttatttttaagtaatcattgtgtcgaagtttataaaagaagagaataattatgttgaaagtagataaagtagaaaatagttgcattgaaatttgataaccttgggatattttaatctttttggtttattggcatgtgtcgaatcaatgaaaaatgaatttattttggaagaaaggtagtaaatatttgctgcctctagccacgaagtttccttttcactttttaaatgtagaaaattagaaagattttttccctataaattatgcgaatcgctcatcactcaccacttcaccagagaagccttcggccttctacaccttctctagctcaggtgatcaccaaatcattttcatgaagaaatcaatatttcaaatattaattgtggacactttattacatgagcattaattaagtaaatatgtgccaatatattgtattgtttggaaattaaatatgtgccaatagttgcagttttataaagcattagggccacataattggtgttatatacaccctacatgttttaatagatggtgatattgatttttcgacatcatgtttgttcactagttttattaaaatgtctaaatatcatttgtttttattgtgattttttattatcaaaggtagtttaagtataacaaatttattttctatttacactaaataagacaaatggttagacgcaacgtctaaaactcaacgacatcatcaattaaaaaatggaagaagcaaacgccaatgccataataaccaaggttttctacaacttttattaatttaaccataaaaccttttgttattttgttaaattttctctattaaatactacatcaaataaaccaataattcttccaaataagatattactagaaaaacacccatgcattgcaacgggtgaatgctattttaatcgataattgttagattttttctctctagaaagtatatgggatttatcaccaagtactagcaagcacaccatatatagttattttgatcatgttaccatgtatgcatgcatgtgtatatgaccatcaaacagcacaatcatgcatcacttagaagcttggcgtatttattttttaatagaatagtacttagaagctttgcgtatttatttgatagaagaaaagattactgttatttatttataggcacaaactttaggataagatcgacaccgagagtaccaaataaaccttacatatttttttcttatcgaaaatttgacttatcccattattattcatgtatctaaattacacatctagtcaaattataatttgactgcacacatctatttgagaaagaacatacgggagtaagtttcatgtctttgcctcactttttttttttttgtctagggaggagggaatacgcgatgagaaaaatactgtccactacagttttgggtgtatattttgccatggccgccctatgtctcattctgtttgatcttgaggattggtttcgtgattatttttcttatgttccttatattgctggaagaataaggaaaaaaaatgcacgtagcataatactgaaagccaatgctcgcggttctaatgaaagcgagagagaaacaaagcaaaaattgacccaaaaatcctcgagttttgcaatgtgtacctacaaaggaagaaataattgttcatggattctactaattacattacttcattgacaaaatggcttggaatgctccaagttcctgtggttttaagcaaatttcagtagccactatgcaaattttagtgacatagcacccaaggacataatattaaagttcatgtttaggttcataaggttcgaataacaggattaaagtttgggcttaggatgccaatttagcttagcaaatgtgactgccacgtgacattaagctgtcaataccaagggcattaaaatttgcatgtacccttctccaatggcaccttttactgtctggttcaatagaatgcatgcactacaaatatcataaacaattaacaa

SEQ ID NO: 4458 - DNA, 6515 bp, Oryza sativa
tgacaatatgtattgttaaaaccaggacaagaaggcttttcatataactgtaaattaaaagaaatacacagaacaaaggaaggtggacaatgataaatcataaatatacgtgccaacagaaatgttcaaagtttccccacaaataaaacaaatatactacctccatccctaaatatatgacggtggttagttgaaaaatgaactaaccaacgtcatatagaaaagaacagagtataagaatatcaatattaacatatagtaggcacattctcctttaaacactggtgaaagaatgtctactcatcaattgaacctacatcctatatggccctcagtgacagagacaagagggatggccagtggcctggccccctccaacaattttttttcacataatcatttaagtagttaggtaattaagctaagtgacagtgtattcggccccctccaagagtcttaggcccctcccatgtttaaatcctgactccgccactgatgggtgatggccatataggcaccagttaacacaaacaaaggacaacaattaacaaggtatagctattaggacataggcagcagactaacacatatcaagaaaaacaattgacaaagtacttagaagaatcctgtaactcacccctgcccactcgccaagagtcttagcactaggcacggtaacaaggtgaacgttgtgctcagcacacagagccttaaccaacttgacataatcaggttggtcgcagtcctcagcaagcacacaaagctgagcagcatgcttctcgatggccttggcagcctcacggagacccttcacaagcccatcatgagcacttgacttcttcatcacaagctgcagagcagtcatcagatccatgggctccccaagaaccggggcagctggagtctcaactggggtctcctccctgtaaaagtgtttagatctcagcgaaaatgaataggctcgctacaatacatcaatgtttcaaagaccgagatgcacataagatctattaacaattactagtaatacactttacaaggtatttttagttctcttctaatttgactgctctttcaataatggaggtccaaatactttggcatgtacgtggtgttacatttatacaagaattgagcacccataatataaaaaatgcattgtttctcactactggtgacactgtacaaattcagtacttcttggatgcaaacaagacaattaagttggataattcaattccatataaacatagtttgataagcaattgagctttttttttcaatctggctgtgaatttaccgtctacactccttggtgctagtacagaacaggcacatatcatctgatatgaatcatgattgtatttgctaaactagacggctcacatacaacgaatccaccaactatactaccagctgccaaattctaaatcaccaagaccccataccagtacagcagaaatccgagcaatcgcactcatgactcccacatcctttcactcaatgatcccatcgaaatggaaaccaaatgacaatttccccaatcaaggacaactcaaacatgataagaccaaacgattcttgagcgagcagtagcgcagccaaggctcagcaacaattacacagtaataacagtgttctaccaacagcagcaacagcaagaacaggctagatccaaaatgctacgaggatagagagagaaaaaacatggaactagcagaggccaagaagaagttggttgcaagaacttacgccatctccgcgctcaaaagaccggaacaccgactgcgacgaaacgatctgcaacaaggaaaacaagcgttctcagcacgattagcgaccgccggcgcactgacgcggaggaacaagaagagcaacggcggcgccgcctaccttgtggcgaagagcggcggcggcggcggggttagggttttcgcgaggagggtgaggagtgagccgcgtgggagaaggtgttcttatatatcgcgttcactatcgggccctgatgggccgaggagctccccaattgggcctcataatgtccagagttagccttttgagcccacatgaggcccatcacgtgttgcagggatgcacatgggccggcccatctcatggcccacctaagatgagtcatgggctcttctggctttcactctgttgtgctaattgtggtgctttgtggatgagctctggcagactacggatctgtttgaggagcttctagcagctgcagcttcttctaaaatcttcagttgccagaagctcccccaaacagtccaactttttatccagattttgagaatctgtagttgtagaatctagaaaatgaactataagccaaagctggatttcccagcttctccagattctcactagctagcttttcagcagctgcttctcagaatcttaagctccccaaacaggccctacatatgtcaccttcagaatcagaacactggtctaatgatgtgtcattagtgctaagaaatcagaacaaatccatgtaggagaataatataatccattgattgtttcttccttgaaaaggaaagatggggcgccaaacacatgtgcgtacatacatgcatgatgcatgtgtgacagttttaattagtgtttgcaaagatatttctgccacaagtggcactctatgaatcattatggccatagttcatccccactctaagtagccggtgagagatttttttttagacatatagttagtaattatttgattaagatcatttgtctctgagctttaagtctccctctctggttggctatgtcaatgtgtgggctacacgatgatatttgacaataccacttgaaaacgacatgatcacatactattgctgggagaagaaaggcttacttaattaactagtggacgcacagcataaattcttgtatacgcacacttcaaaaaagaatcaaattaagttaagatgagaaaatgaaatactcaattttcacatgaattaattcagatcctgcaaaattccttaaaaaaactttggtttcgaaggaggcctatactattggatggagtaagttttttttttatataatgctcgatgaagaacgaatattgcgcactatagattaatggttgtgaattgtgattaagcatgtcaataatccaatactttttattttctagatgacatggtccaatacatattgagaaataataatttctagatgacgtggtccaatacacatcgagaaataataattatgtaagtgggtctgaattacatagtaacatggaattagtttgctttatttatccagcaaaacatgagcttgggatcatgggatgtgaaaggttgtaaactgcaaagccctctagtccctactttaataaattaatcaaaataattagtggcttactttattctcccaattctcctctgcctccaagttgcatgaaactgaaaggcagataattatagtgctttgctttaatcccaaggaaaggagaaaatctcctgccaaattaagctggtattctttttattcagaaaaaaggagtataaagttggtatatatatatatattgttcgctttagaagaatcctaaaatttgtcggttggtatacctttgaagtttgaactagctttgagcttttgccagaaataataggtaaaaacgttgtattgctgcaaattaggaggtaaaaataatctataattaaccttggcaaatttgacaatatctatgtcggtgacatggggccgggggtatcgtgactagaggcttgggtagccgcggtcacccacgtggcctgagggcccgagggtgacgtggccacccctccctctgtccccccgaggggtcgggccgctcccgtttcggccccgagggttggggcgccccgaccccctgtggttttggcgccacgtgtgtgggttagatgagcacagcggggctcacctacccgcatttataacaggttggacgagcgcgccacaccgcatttaatgcggcgcagcgcacacttatcctgtctgtgaccggtcgcggtgtatgaccggtcacagaccggtcagatcgcgggttaggtggcaacaggcggcctgtcacacgcctcgccccgtcccgtcggaatgatgagagcttcctggctctcgtccctagccggagccggcgtgctaactcttggagttggtatgtcagtcccggtcagatccattccaggcttcagcgcaagcatggcaaggaagtcgctggccattgaatgaatgttgaaatgggcgtccaccgggaaagctggcgaggggggcaggaggcgtgtgctctgcttgtcagaagtcacttccggctatagactagtcctcattgtaaaaagcatgtttcctttcttagccagctagaggcccttgtggtgacccctgactagataaaaaggaggcccaggcctaggagagagagagggaagagaaaaaaagggaagaggggttgagactctggcgaatgggttctagaccctgaactcttgctcgctctccggctctctggattccttcacgcacagatccaccagaacacaggagtagggtgttacgcttctcagcggtccgaacctgtctacgtcgctcgtgtcttgtgcatttcctctctcgcggacgttcctcagatcgagggcgaagaacctcacttagcgcccccggccgaaccggcaaaggggggcctgcgcggtctcccgatgaggagccccacgctccgtcaatctagttgaaccttctttgaataatgatgacctagacgcgagctcccaactgtcaggaatggaacatctcaccagctcaaggacgtggcgtgattactagccaagtatactagcgatgcattttgatcatgaaaagggccggtttgtttttttcttttgacctagaaagaaagtactcactccatcctaaaatgtttgacgccgttgatttttttaaaaaaatatttgaccgttcgtcttattaaaaaatttaagtttttttctatcatttaatttattgttaaatatacttttatttatacatatagggaaggagggagtactttagtatgtacggagcagcttttgcatatagtaatccaactatatatgccagttcagctcgtgcgagtaggctcgggataataactccataggtagtatttgctatgtctagttggggggtgtttagatggggctaaaactttttagcccatgtcacatcggatgtttggacgctaatttagaatattaaacatagactaataaaaaaactaatttcataaatgagagctaatccgcgagacgaattttttaagcctaattaatccataattatcaaaagtttactgtagcatcacattgtcaaaatcatggcgtaattagacttaaaagattcgtctcgcgaattagtccaaggttatggaatgagttttgtaattagtgtatctttgatactccaaattaatgtccaaacatctgatgtgatagggacttggaataagtctctgaaaacaaataggcccgaatgggtgccatatgccaaacataaaccgaaaataaaatcatataataacaataaacggggtattgcgccgtggctaggaatgggaggccatagtgagagaaatacataatgaagcctaaaattgatagccatgcatatcccacggtattattatcgcaatcgacaggtagagaatggcggaagacacatagacagccaatcacgacgactcgcaaaacattgttaagctaatttagcttatgttggcctatcatgcccttctaattttagttctcgaccatagttatgatattttgggatttagcattctagttatgctattaattaagtattttaatatttcatataattacgatttagagggccctgattttaggaggcactaaacagtcgcacacctcacagatgctaccgtacggccttgcgtcgagattacaaagttgacttgtccactttgacactgaaatatccatcgtatattgatgcaagctaggagtttgagttgacaagttaattggaaatgccaaataaaaaatctgttaacatattaatcatatggatgtgcaaaactcgtggcttggctcgtttgaatttgcaaatgagttgagctaagggtttagccttgagttggctggtgagttagctcacgagtcaaatgagccatgacaagcctcgcaaaaaaaaaaaaggccatgacgagcaacataagctagcaacacaccagcagtctaactagtactaaaatgctaccctctccggcctataatatagggttatttggaaccatgccattataattttacaaagtttgagatatgtcatcgatatctcaatgacatgtaaaacccacatgagtcaatgatatgtgggtcaggatgacatatctcaaattttacaaaattataatggcatggttccaattttccctataatataagtgattttgggtggacgtgacacatcctattacaatgaatctgaatagggatttt

SEQ ID NO: 4459 - DNA, 8150 bp, Oryza sativa
ttcatagacctgaaaatttggactgaccttgctatatatacatgtgtttggtggaatgtatgaaaatatgaagcaaactatgatttactatagcttggattgtatacaaacattttgtaaacttgaacagattaatgttggtttgagcgtgttggctcctgacattaacaagccaactcatgtaggcaaacgagccgggtcgagctaggcttaacgagctagttgagtttttgttattctatcaatttgttatcctaagtcagaactgagtccagttggcttgatatccagccatatgtgtgcacagtagcaattgaaaaagctataagaaatccattgacatataccaccaagatcgaacgtgaacaatttaatgcatatgttaattaggctttacgtatcacgcgttgcattatcttgagtcaaacttacgtgagtttcgtcctaagtcggactattccaataatcaagttcacaaagaaaagtattagcatgtataactttaaataaataaattataaaattatattttataatggatattatgctcatttgatatataaatatttttctaaagattttggctaagctcatgatagtttgactaaagaacaaaactaattttcaacggagggagtaacacaaggaaggatgtattcattagactatagctaatggagcatgatttcgagtctagactatgacatattcatggcaataattattctttcagtgatataagacatatccattaataatgagatgtccacgatgattttgtcaaatctcaatatataccaattcagcctttagaaaatattctaaaaataggacgtacatgtgtgtacgttcataaaaacaagtgtgtgcgtattgtaggcgtgcatgtgtgtttcaaagaaaaaagaaaaaagaagtccggacaagcacctatggttgagttatttttaaggacggatatatacgagtgcacgattgaggccgtgtttagttctcaaaataaaaaatttcacgctgtcagattgaatgtttagacacatatatggagtattaaatatagaaaaaaacaaattacatagattaagtgtaaattgcgatacgaatcttttaagcctaattgcaccatgatttgacaatgtggtgctacagtaaacatttgagaatgacgaattaattagcttaatctgtttcttttagaaatctaatttattttgttagtagaatacatttaatattttaaatgtgtatatgtatatccaatgtgacaacgtaccaagaacaaggcctgaattttgtgcgtgactgcgtgtgcgcagcgcgtcccaagcgttttcccttccgcctcgccgtcgtcgacgtcgccgtcacgtagcgtaggcaggcacatgcgcggcgcgtgtgagcgggcggttggacgacatgtgggcggggtgtcggcagcccaggcttcccccgccacgtggctttctctctcgcaaagcgaaaggcccaggagaagtactagtagaaccacacgaatgggccccacaacaagccaggtcctttcatatccactgggctttctttaattccttttacaattttattattattctcgtgaccaaattgcccccctgctgtgccatttagcgccccgctgcaactgcacgtgggccggtgcacccacagatacagcaccgttgccgttgcccgttgcccgttggatcctaggtttttccttcaaatctctttctgttatgactactcttttttcctttttctttttcatgccaagtatggctctttgttagcgcggcatatgccgacatggacaaatggacatgcccaagctttaaaaaaaaaaatgcatgcccaagcctatccatatatgccagtatgtacacacacccatgcttgcttgttttttatgttttctttttttctttccatatgcgcttctttccagttcatgtcaacatcacagctcgttctgttttttaaatagataataagtaccaatgagaatttaagagaatgacaatgttgaattgttctatacgaatgtaatatactactagtacatgtttactgaagttcgtccccctcccccttttaattttttttaataaagtttaatatcacgatgtcgaatggttctacataaatgtaatatatagtagtacatatttagtgaaattcatcttctccccgcttcaaaaaaaaagtttacacttcggtcatcatttataattataaatgtgtattaatttaaacggatacatacttaaattttcttaaccctatacttttccatcccaaaatataagaatctaggattaaaaaataagctatccatattcgtactactagaaaatgcctcatccagtttcttttattttgagatggagggagttcatacttaaacatgtagtttgtactatttatctaaataacttattgcgtgtttttcttacttgtcacacttaatacacttgataaatactttaatctttccataaattgaacaccattttttaatacatcccaaacactccccgtatcttcaccacctgtcaacctcgatcactctccatcgccaaggacacggcttcaaagggtaaaacggtcactccacccgtgaagtcaaaaaagaaggccctactgcttctttccagcagcaaaagcagcgaaacaaattttttttttttttgcgagggcagcgaaacaaaattaacaatcagatataggggcaatacagtaattcacgctttcctcctttgtctcctccccttcctttgcttgtctagtagtgtcttcttcctcctctccctttccttcatttggcaacctccacaactcatcaactccactcctcccctccccctcgcaaaccaaacccaagcaaagcaagcatccaatgcttccccccttcctccctaatcacccccgctaatcgctcccgacgccaccactaatcgaagccggaggagggaggcggcggcgggatggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacaaggagccccgtcgggtggctgcgccaggcgatctccgcctcggagggtgacgtcgtcgccgccggcggggtcgacgccgccgtctacctcgtcttcctctcctccggtataataataatagcaacaacatccctctcccctgcgctctcttagttcagttcagttcagtttatttcaggagttgagttggttgtgattttgctccaacggaaaaaaaaatggtttcgtgcgatttcttcgagtattttcgggtcggggagttctaaattttaatttctaggtgcccctgtagtactgaatcccaggaaatttggtccagagatttcttctcacttttgtttttttgttatccttttgtttgcagaagtagtagtaccgtgtattatatataaaaaaactgataaaaaatatttttatgtttcaccgtttcatgtaccaacataaagataacaattactactaattcatgctttcttagactaaacaatttatttggagaaaattgcgtggctctgtaaggccttgtttagtttccaatttttttttcccaaaaacgtcacatcgaatctttggacacatgcatagagtatcaaatatagataaaaacaaaaactaattgcacagtttgcatggaaatcacgagatggatcttttgagcctaattagtccatgattagccataagtgctatagtaaaccacatgtgctaatgtcggcttaattaggctcaaaagattgtctcgtggtttccaggcgagttatgaaatttgttttttcattcgtgtccgaaaaccccttccaacatctggtcaaacatccgatgtgacacccaaaaattttcttttcgctaacaaaacggggccaatttataggggcaagtcgtgctgaatgaaaggttggctatagaaaactatgatgcatggaggattgccaagtatgaaattcagcatgttaattgatttatgctgcactttactgattaaatttggctaaggtgccattttggctaaaaatagctaagttgatataacatattgacttgccacctattatgacaatttgtttaataattttctcttatgttacagtgttgtccatcttggtgttctctgggattgtgctgcttccagttctgctacctgttgctgctactgacgataacctgaacctggaaagggctattggcctgaagaatggcaaaacaccccagaacttcacagagctcgagaaattagcactgggcaatgttcaagtaagtggcccttcaactcgagtttacttgcatggcttggcttgttaccagtttatgatgtatatgactataggaatcgcacggcaccagtattttgcttgctgagattgtcccttctgtaaaagaaaaggaacaaatataagcatgttgttatatacaaaaacatggcaaccatattccctgattgcttgttactatttacatgtcactgtatgatcattgatcagcctagtgttcctttctgttctgttagctccgccatttccaaagttttgatccaaatggatttgtgatgatcaatatccttgaataactgccatatcagtttacgccctatggccaattggcttgtagcccagtatgagggcctgtttggtacagctccaactcctaaatttagctccaagagtccaggagttgggtctggagtggagttgtggagttgcctaaacccaactccacaactctagttcattttgggagagagctccacccagctccacttccagttttggtggagttttggtggagctgaaactgtttggctgaactccaactccaggaggggtggagctggagttggagctgtgccaaacaggccctgaattcttgatgtggctgcttgtaaagtctctcaacattgtattatgaatttgttcatgtgtaaattatgagcaatcaattagtacagaaactggtcttttatttttctgtagaaattgtagagatagaacttcctaatctccagtcaaggctagcattcaagatcctgattatcatataatcatactcacagccaaactcctttacattttctacaggaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggtattgccactcttaagatgtttttagggggactgatggtccttgttttatctttcttgtatacttgtgcgacatgtctcagaatgtaccccaaaatccatgtattctgatcataatgcactttgcaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatctttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgcagcttgcacttattgttttccttgctttgctgcctagtcttctaatgttcctctcaaagctggaggggattccttcacagggtcatacagttagggcagcagcagggaagtacttctacttcattgtgttcaatgtcttccttggggttactattagttccacattgttcagtgctttgacaaccataatcaataaccctcctgggattgtgaacatgcttgccagcagccttccaggaagtgcaactttcttccttacatttgttgcactgaagtaagcaatgctttcttctcacattatgtacctggtattgtcagctatttccatcctacacgtctgtacaattcagaaagtaacttttcatttgtttttgttgccagattctttgttggttatgggcttgagctctctcgcttggtccctcttatcattttccacctgaagaggaagtacctatgcaagaccgaggatgaagtgagagcagcttgggctccaggcgacctaggatataacaccagggttccgaatgacatgctcatagttacaatagtgctgtgctactctgtcattgcacctctgattattccatttggtgttgcttactttgctcttggatggattatagtgaaaaatcaggtgagccaagagttacttgctttaaccgaagttttaacacactaatattgaaactgaattggaaaggacaaattaattagtagtttcccattgtcgaatgtaggttatgaaacctacttcagcatgaacttctgaaatccgctttcaatcctttttaatactcttgagtctctgatgatagccattgctagataaactttgtgacggggtaacctttcttttaacgcaggttctccgagtttatgttcccagctacgagagcaacgggcgaatgtggccacatatgcacacaaggatcattgcagctctactgatttaccagatcaccatggttggtgtcatcctgctgaagaagttcttgtactcccctgttcttgtgcccctcatcccaataagcttcatcttcgcctacatttgccatatgcggttctacccggcgttcgccaagacccctctcgaggtggttcagcacaacgtgaaagacacgccgaacatggatgccgtctacacctcctacatcccggcttgcctgaagcctgagaagctagaggatgtggatatcttcgaagacgcccagttgcacaccacctccagagccccatccatctaatgcaagtgctggttgcttgtgtcgagaccggagagtattactcatcatcactgcaaacgaatttctgatgaatttccacgttgaaatgaacccctgtgaagtgtgaatctgctattgccaggataggaaaacttatgtcatgtccgtgtacataatatgcactcgggattgcttgccttcttaatgtgtgtgttgaggtttattctttacttcatagttctaggtagctgctgtggatatcgcgcctttttaagtttaagtttctatcatatgttcatgctcgtggtgactgctaaatctagtcctcttatgtgtaacaaaactcagaaatctgttggatcccgtgcaccgtaacctgattgataatttactgatttactcattgttactgttcattgaagctagtatcatggctgactcggtgtccgagaatgttgtcatttttgctagaatcttgtgtattaaccctggagggcaggcaggtcgtgagttgcaagttgcaaccgctgcactcgccagcggacggtggcctcgccgtcgtcgtttctccccgttggcatgggcctttttgggcccagacatattggcccggccttggcccatctaaccagcccaccgcgttgggccggagattcccggcccactctgcagaagagcacggctcgaaatcgcgcgaaaatccacagcgcccgcgcgggcggcgg

SEQ ID NO: 4460 - DNA, 8996 bp, Oryza sativa
  unsure (1)..(8996): unsure at all n locations
nnnnnnnnnnnnnnnnnnnnnnnnnnnnnnnnnnnnnnnnnnnnnnnnccttggcccatctaaccgcccaccgcgttgggccggagattccggcccactctgcagaagagcacggctcgaaatcgcgcgaaaatccacagcgcccgcgcgggcgggggcgcacgaacagcggcgagccggggaccaaatgcccctccgatgagcgaggcgatcccgtccacccgcccggcgctgtgccactgagtcgcgctcctccgcctacaccttggcgagccataccttgacaggcgcaaacatatccacgcgcgggcgctccgggccggggtgcccacctcccacccgcttcttgacaagcaccttctcttccaccttgccgccctccgagcgccgccgtttcactacgccgtcgcggtactctcccgcctcctcccgcacgggccactagacccgttccccctcaacaccgtgctccgcatcgccgcgggctcgccccgcccgcgcgtcgcgctcgagctccaccgccgccgcctcgcgctgcccgacacgcacacctacccgccgctgatccaggcgtgcgcgcgcctcctcgcactccgtgaaggggagtgcctccatgctgaggccgccaagaacggcttcgtcacgctcgtcttcgtccagaactcgctcgtccacctttatggcgcgtgcggcctgttcgagagcgcgcataaggtgttcgacgaaatgccggtgcgtgggcggaaccttgtctcgtggaattcgatgcttaacagctttgcggccaacgggcgacctaacgaggttctcactgtcttctgggagatgttgggcgttgactttgcgccagatggattcaccatagtcagtgttctacccgcttgtgcggagtttggggcgcttgctcttgggaggagggttcatgtgtatgtggaaaaggttgggttggttgaaaattcgcatgtgagcaatgccctgattgatctgtatgccaagtgtggtagtgtcaccgatgcaaggaggatatttgaggagatggggttggggaggaccgtcgtctcttggacgtcgttgatcgtagggctggcagcgaatgggtttgggaaggaggcacttgagcttttcagtctaatggagagggagaagttagtgccaactgaaattactatggtaggagttttgtatgcatgtagccactgtggattggttgatgatggatttaggtatttcgataggatgaaggaggattatggcatttcaccgaggattgagcatcttggatgtatggtggacctgttggggagagcaggaagagttgaggaggcttacgattatatcatcacaatgccattggagccaaatgctgtggtatggaggaccttgctgggttcttgtgctatgcacaagaagctggaactagggaaggttgcttgggaacggttggttgagcttgaccctgggcacagtggagactatgtgctcctctccaacctttatgctgctgttgggatgtgggcagatgttcatgtgcttaggaagacaatggtaaaagatagagtgaggaaaaaccctgggcatagtctcgttgagctccgaaactctgtatatgaatttgttatgggagacaggtcacatcctgagagtgagcagatatatgaaatgctggctgagatagctgagagattgaggcgagaaggttacatccctcgcacaagtaacgtattggcagatatagaggaggaagagaaagagaccgccttaaactaccatagtgagaggctagccattgcatttgccttgctgaagtctcttccaggcattcctatcaggataataaagaacttgaggatgtgtggggactgtcatgttgcatttaatctaatatcaaaagtttatgatcgtgaaatcattgtcagggatcgaagtaggttccatcatttccaagggggggcatgttcgtgcaaagattattggtagttgattcatgtaaagattgacagtgataaaagcgtggtttatgaggttccatgccaatcagataactggtgctgagttcttgttgcataacatgttctgtagcatcatcatatattgatagtacaaccttgacgatggacactgaacactacctgatggtacaagtgagaaaactacaaagatatgaggcatgttatgcagacgacccagcaattattttgttgatatgcttataaggtaccagtacaagcgagaaaactacagagacatgaggcatgttatgcggacgacccccaattattgtgttgatatgcttataaggtaccaaactgtggcttttgtctgggatccatttctttccttttaattatcataccgaattttcaaaactgttttgattctgaatacatacatctttgaaataagccttataaaattgcctgagttttatcaaactttattctgggtgttccacttatatcggacctgatcctttttttaaagaacatatcaggcatgattctagttacaaatttaattccatacaaagcactactggagtttattgcttggcttccctttatgtatattggtaagcaataaatgtttccactcattggctaccgatatgctatagaactggatgctgaaaagttgcactgcattaaactataagatctttcttttcgtttctttcatacaacatcaaactgtctaaagcttccagagcaaagttaagatacaactttcatcatgaaaacactaaagtttttatcttaatattatgcattggtgttaaccttttaatggatgttgcattgttccatatgtttctactttctactcatggggattactgttgacatttgtgtgcaccacttccatttatcctctttttggaaactgtttccagcaccatcccaaattcactatgtaaaatgtcttactagtgcgttttgttgcattctgtacgtatgccatttcagttttgataagttattttacttaacctagtttttttaatggaatcagcacaagattgtgctatttcattgaacaaggggtaaaaaagtacaggccctaggggcactggacctagttttttcaagatctgattttctttatcaggttctctcctgtattgaacccttgtcccaggttaaaacatgcagcattctccatgtaatcttcaggaaacctcttcattaggcttcactctttacaaagtgaatcaaggttcttcccttaatcctcaaggaaagcttttctcattaagccccgacatatgctaccatgaaacaacaaagaaaagaaattagaacatgcacttggcccctttcaatcttatggaatctattgcctaagtttctttttgttcttttagaaataatgtccatgcttgcacatcttgaaggcaaaaggaatctcatggtttcctggccttcaagtcattctcatccatattattctattatgttcataaaggtccctgcattggttgcacaatccaagaaccagcagctgctggtataatcatttataacatgttctgctccaggcattacaataactgcaacataaattaatagacgatcggcatggcgattctcatcatggtaaagctcactcatttatcaattcaatgacagcatataaaacgtcggtagggtctgcagatattacaattttgtaagaggaattatggtaaagtcatgtttgtgtagattcgaaccaaattagtcaaatggtgcccatatggccataggaactgggcgggtggctctctgatagctacaagatgcatttctctctgtacattggaaatatgggatctttgtgccacttttcaagccatctcctccctgctatggccataaatatgcaccacggtggggacttcttttagttcgtgtcttgcttgcttagtaattcgagtgaaaccctgaccctttcccatgaacaagacaagctttcctgttgatacagctgcccttcgttcagacactcaatatattccctaggccctcacattgaggagagagtggtagatagacaaagagggagagagctgagtgaaaagcagtgactgctttcagttcggtttcaaccatgaagagaaagcagttgatcatgcacagccttttgattctgggatggttcataggtgggtaactgcactgctcttgttctttgcccgtgtcttctccacaaatatttctcatactaagtatttgaatgagcttgctttgatctgttagtagtaccactgcaaactttatatgcataatctcagaactagctgtatctatgaacagactgttttgtttgttcacgtttagctgtaaatgttcagtcaatccgatcatcacaatgttctcactgactgttttgtttgttcacgtttagctgtaaatgttcagtcaatccgatcatcacaatgttctcactctgtcatttcctctgtgatcagtctcagcagcaggcgcacgcgtcgcgccacaggagaaggcggagtccgcgacgccgatcccgacgctgtcgccaccggaggggaacatgacgttcgtggacggcgtgacgtggtgcgtggcgcgcccgggggtgtcacaggaggacctccagaacgcgctggactgggcgtgcggccagggcggcgcggactgcaccccgctgcaacccggtggtcggtgctaccagccggacaccctcctctcccacgcctcctacgccttcaacatcttctaccagcagaacggcaactccgacatcgcctgcaacttcggtggcgccggaaccatcatcaagagaaatccaagtaacacaacaacagacagtttgtttacatttttacaattcagcattgttcagtgacatctgtaattgtaatttacatctgttctttgtgttcttgataggttttggatcatgcaagttcctggcatccgagtaagttcagtccataattgtttcagatgttcttctttctccttattacatatgactggtaaattaattaaattttgctggattggtgcaggacatctgctgcatcagcactgactcgaggaagcatgtggatgatcttcgcagctgcgtctatgatgtttcttcatctgagagttttccaatccgtgtgaattgggtcgatgctaccaaagtaattagtacctgtggtggtttggttctctttgtagtatattacttatgtaagaagcaaggaacagtgctagttttttcgtgtaaaattgtgaagattatatattactacctccatcccaaaatgtttgacgccgttgacttttttttaaaatgtttgactgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagtcaacggtgtcaaacatttagggaaggagggagtatgatttaggtcgtgtttttcactctgtaataataatgaagtaaatagttagcaagagtttgtggagggttaatgcatggttaattctttgaattttgtttcagaaagctctcgcttgcatagccgcagaggtggagtaggtcacaagcgtacacaaacacaatagccaattacgagccatatggcccaatatggtgaggcccacaaggcccaaggtgacaaagccccgcatagtcagatccgatccgtaggttgaaatctggacggtcggcacgtcacgcacggacgcgcgcgcttattttagtaccacctcgagaattcgatcggagaagcaccagcttatatacccgcccgcgctagcctggtcatctcttcggagacatccgataaaattggaacgattcagagaagattagcatggcccctgcgcaaggatgacacgcacaaatcgagaaatggcccaaatttttttgagaattctgcccaggtccctggagcttatactttttatcgcagttatgccctcggttctttctttctgccccttctgctgaatctttttcttccgttctcgtccttcgtgtatgaaggcatagttaagttgtctgcacttcagcccctgaagattttttatcttataaatagaccctcatctgtttccttctttagtgctgcccattgttttcttagcagttatgccctcggctctttctttttgccccttccaagttttttcttgcgctatcgtcgtccatggcttcatcgatggaggctcatacttaagttgtctgcacttcacttcagcccctgagattgttttctcttacaaacaagttgctgtatatttcttctctgcttcactttttaataccaatcaggtcctattatatattgtgcattgctgataataatttgtttagtgcacctctttttttgttaggcaccctgtaatctactagtagtactttggagccataaggccaatcttataacagctcatatcaacatcacgtcctctcttttaactatttctttggctccaacaaacgccaatcatatcgtccacaaccacaagcatacgcagtgacgaaccaataacaaaagctaccaacattctatacatattaattatctaattattggttaatatattaattattaacatgatataaattagctggaactaaataatctacccggggtccgtgaccccgagatagtgaacgtagccacgtctgtacgccactaagcatatgctaaaactcagttcaagattttttaattaattaacaataagaatgcatttaaatgcaattaagaatctttcacccttgtattttcaccaattagacctcacatacgcggcataacttttttacattcctattttaaactgaattaatgccactagttatgcttaaaacatacatgtttttttaaggaaagctttttagtgccttttttatggcacttttttaatctacgatccttctacctaataacaatcaagcatatcatcacaatttaggatctccagagagctcgagacaggacgctgttcgctctagcgtccgcgcctggacgttagtcctagtagcgtccttactattttcataatttgcactagtacctctcacttactaaatatttaatttcaggataattaattattataggattaaaaacccggtatattcttagataaaaagaaataaaattcagcttactctattttagatccaactttcaaattatgcaactgcatgtcgcgtgaatattaattcctggtggcgatgacggacacattcagccccttttttcttgttcggagttttgatccaactcatacctacgttgaggactttgtgtcacacacgaaccagggatgacgagcgtattaacagattctgaacacatcacgacgtgataataatgggcatacgacttagcattatagggtagggttagaagaagaagtgtttggggcgtgtttcgggcttagagggatgactgggacgatagcagattgactgatgacgggcaacgagatggcagctgacatcactgccggagccatgaggttaggagaggatggaggaaagggttgatagtgggggtaaaattgtcgactagttaggatgggtggggtagaggacgatggtggagaaagtagacaatgaagtggtggcagcggcaactctaaccactagaggtgagggagaggttggggatggggccaatagaggagacagtaatgcggcaaaaatctaacatggtcagcggttgaatcggagaggtcaactgtgggattgtcagagaggagtataaggcttgtttggttgataccctgataggggcggacgaaaagctcgaggctcgttagctcgctcgactcggctcgtttcattttcctaacgagccgagctggcattttagctcgttagagataacgagccagctcgcgagctgcttgtgagccttaacgagccctcagcaatctgccaggccacaaagcccataggcccatttatttagaaggcccaatagacaatagtgagcactaaaagtgaaaaccctaggtcattcccttatcccttcccttccctgttccctttggctggcggctgagttctgtaggatcgaaacgcaagaactaagccaaccagaggggggggggagggtgaatggttggtatgcccaaaaacaaaaacttttagcagaaataaaagttaccctcaaattcacgagattggtctgaccgaagatgattcgctggtctgaccgccctgatgctgtcggtctgaccggtgtagatcgatcggtccgaccgctcgtcgccggtctgaccgcccttatgccgccggtctgaccgccactcgtcgccggtctgaccgccggtgtattgccggttggaccgccgaaacccggtgaaatacaaatcgaagaactcttaaagtggatgataactttattacttctctctgtgtttacaaagtgcaacaacaacactccttacaaaaatcttgagaaaactcgaaaccctaactcaactatcaacttaattactctccaaagcgataccgggaagcctcacgctccctctctatttatacccaaggtaggcagcctaaagccacgaaccaaactcatactagaagtcctaatcaccctaggaaaccttctcgtacaagaaacaaactttacaaaaccaattccaccaaatttggactccttccaaattcgactccgcatcccatacgcacacaatacctccatcttaagccatatggaaccttcaccttccatgtgtgaaagtgcatctaggcccctaacgattttggtgattaattacaatgcgattagagaggactaacatttttctttaagcaaaggtgaaggttgctatgtcctcaatgagttagcgtaatgcatttcccgctgaatatgttaatgagatgtgatgcggcaaatgannnnnnnnnnnnnnnnnnnnnnnnnnnnnnnnnnnnnnnnnnnnn

SEQ ID NO: 4461 - DNA, 10694 bp, Oryza sativa
  unsure (1)..(10694): unsure at all n locations
nnnnnnnnnnnnnnnnnnnnnnnnnnnnnnnnnnnnnnnnnnnnncactccttacaaaaatcttgagaaaactcgaaaccctaactcaactatcaacttaattactctccaaagcgataccgggaagcctcacgctccctctctatttatacccaaggtaggcagcctaaagccacgaaccaaactcatactagaagtcctaatcaccctaggaaaccttctcgtacaagaaacaaactttacaaaaccaattccaccaaatttggactccttccaaattcgactccgcatcccatacgcacacaatacctccatcctaagccatatggaaccttcaccttccatgtgtgaaagtgcatctaggcccctaacgattttggtgattaattacaatgcgattagagaggactaacatttttctttaagcaaaggtgaaggttgctatgtcctcaatgagttagcgtaatgcatttcccgctgaatatgttaatgagatgtgatgcggcaaatgagcaaatggtatattgtatcttttctttttgtttgagtcaataggaatgccgcactattaagagggatgatgcattgacatatgaggagtgatcaaagtgctcaacatcaatttttaaaagtgtttctcctcagtttgatgtgttctggaaatttttggagttttccgaaagtcattttcggactttctgaaaatgcacagaaccaattttcgcttctggaaattttcggatatgtccgaaagacattttcggattttccgaaaatgactgagaaggcaaatgtggttctgtttattttcggacttttccgaaattgattttcggagtttccgaaaaactttagcaaagccaaaaacgcttctgtgttttttcggacttgtccaaaagcgattttcggacttttccgaaaacatccataaccgtgtttttggttctggaaattttcggacttgtccgaaaagttttcggaatgtccgaaaaatctctcgttgactttgctgttggtgctgagctggaattttcggacatgtccaaaaaacttcgggaacatctttgtgagcttcatctttggtgactttacttcctccctctccactagcttagctttcttgagccgctataggtatagttgctgtttgtgctagcatattcttgttgtaggcaactagatctaggatttactttgctacttgtgctgactccgaaaattttcagatatatccaaaaatttcggaaatatccgaaaattactgcttccgcttttaattggatttttgaattagcctattcacccccctctaggcctaattgacactttcaattggtatcagagcctaatctcctaattaggcttaaccgcttaaagagatcatgtcgggccaaacgggggaaggcaaagatggtgataagggagctatatttccttatgactatccacctatatctacatcttatgtgagtacctatagcggcaaagctccgtacttcaatggtacggactatgccgcttggaagcataagatgaatatgcatttgaagtctattaacccatttatttggagaatagtcgaaaaaggctatgtgttgcagaatcccgaagatcccaccaaggaggacgacgagaacaagcacaagaacgctcaagccgctaatgcaatacttagcgccttgagtggaagtgagttcaaccgtgtggatggcattgagagtgccaaagtgatttgggacatgcttcggaacttgcatgaaggcacggatagtgttcgtgagtccaaggtggagatcctcaaggggcaatttgagagatttgtgatgttggatggtgagagcccaagtgacatgtacgaccggttgagcaagatcgtcaatgagatcaagggacttggctccaaggacatgaccgatgaggttgtggtcaagaagatggttcgagcaatcactccaaggaactctaccttggtgaccatcattcgtgaccgtccggactacaagactctcacacctcatgatttgctcggacgtattcttgcccatgacatgctcgtgcaagagtccaaggatgtcatccaatacatcaaccaaagctcaaccacaagcatcaagaaggaagacttggcattgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgaaaagagcccggacacttcattgcggattgcccacacctcaaggatggttcccacatcaaggaagataagaagaagggtgagaagaaggatgagaagaaggagaagtacaagcatagcaagcgggaacattatggccaagctcaccttgggatgatcttcggctccaactccgagtcaagctcaagtgatgaagaaggagtcgcaacgttcgccgtcaagccttcatcaccaccgagactcttcgactactcaagtgatgaggatgctcccatttgcctcatggcaaaggagcctaagttaccttctcctctcaagtcatttaatgttgatcttgttagtgatgaggaggatgaggttgaggatgaagttatggatgacgaattgttcaagtccataactaaggaatccctaccacacttgagtgagttgcttgggagaattgaggaccaatatgcaactcttgagaggcaaaaggctttgctcattcgtgagaaagagcggtctcatgaactcaagagtgagcttgctaaggagagagaaaaaaatgaggctttggtacggctttacaagtaaaccaaagagtctcatgctaatcttgaggtggcgaacgctcaacttcaagatagagtggatggcttggacaaagcctacctctctcttgaagagaagttcgaaaccttaaaaaatagtgtctcttttcctagtgagccatcttgttccaaaattgtcccaagtaatgaaccatgtgtgagatgcaaagatattgatattgaagcttatgctactaactctatctctttgagtgccttgcaaaagcaaaatgagaagcttatgggactccttcacaatggcctacttaagtgccatatgggtagtaaggccctaaaggagtacctaggctatcaaagggacaacttcaaccatgagggtcttaggtatgttcctccaccaaaaggaaaggtggacaagagtgtgatgatcaagaggccccaaggtcttagcaattttgttaaggccaaaagtatccttcctaatgattatgcttcacattgttcttttgatgcatcttatgttcttagaaagaatgttagtggtcgtgttgttgctaagtatgtaggcccgaggggcaagaatatttctatcaagagagtactttgggtgcctaaggcacttgtcactaacatgagaggacccaagcaagtatgggtacctaaaactagaaattgatctcttgtaggaatatatctccggtggaagaagttgggtgattgatagtggatgcaccaatcacatgaccggagaagaatcaatgttttcaacacttgatccaaatggcacttcacaagataacatagtctttggggacgatggaaagggaaatgttatgggattgggtaagattgcaatctctaatgatctctccattgccaacgttctcttggtaaaatctctaaactataatcttttatccgtttctcaattatgttctatgggttacaattgtctctttaccgatgttgatgtgaccgtctatagaaggaatgattcatccgtggtctttgagggtgttctcaagggaaagctttaccttgtggatttttccccaagtaaagccaaacatgagacatgcttagtggctaagtccaacacggggtggctttggcatcggaggctagcccatgttggtaagaggaatcttcacaagcttctaaagcacgatcacatccttggactaacaaatgttcaatttgagaaagatagggtgtgtagcgcatatcaagccggcaaacaaattggagcacatcaccccgtcaagaatgtgatgaccactacaagaccattggagcttctccatatggaccttttcggaccaattgcttatctaagcattggaggtaacaaatatggtcttgttattgttgatgagttttcacgcttcacatgggtgttctttttgcatgacaagagtgagacacaagccatcttcaagaagtttgcaagaagagcacaaaacgagttcgacctcaagttcaagaacattcgaagcgacaacggcaaggagttcaacaacacgtgcatcgagagtttccttgatgaagaaggcatcaagcacgagttcttagctccatattcacctcaacaaaatggagtagccgagaggaagaatagaactctcattgagatggcgaggaccatgttggatgagtacaagacatcggaccggttttgggccgaagccgtcaacaccgcatgccacgccatcaaccgcctttatcttcaccgccttcttaagaagactccttgtgagcttcttacctgtaacaaacctaatgtctcttactttcgtgttttcggtagtaagtgttacattctaaataagaaggctagatcatctaagttcgctcctaaagtggatgagggattcttgcttgggtatggatcaaatgaatgcgcatactgcgttttcaacaaaacctccgatattgttgagatcgcgcgtgatgtgacatttgacgaaactaatggctctcaagtagagtaagttgactcacatgtgttaggtgaagaggaggacccgagcgaagcaatcaaaaggttggctcttggggacgtacgtcctagggagccacaacaaggggtgtcttcctcaacacaagtggagccacctacatcaacccaagccgacgatccctctacctcaagcttggatcaaagtgaagaatgcgagcaagtgccaccctcaccgatcaacttagctcgcccaaggatccaacaaagtatccaaagagatcatcccaccgacaacatcttaggagacatcaacaagggagtatccactcgttctcgtattgcaaatttttgtgagcattactcgtttgtgtcttctcttgtacctctaagggtggaagaagcccttaatgattcggattgggtgatggcgatgcaagaggagttgaacaatttcacccggaataaagtgtggattttggtgtagcgacctcggcaaaatgtaattggcacaaagtggatcttccgcaacaagcaagacgaggccggggtcgtaataaggaacaaggcgaggttagtggcgcaagggttcacccaaatcgaaggattagattttggtgaaacttttgcgccggtagctagacttgagtcgattcgcatattccttacttttgctactaacctcaattttaagctatatcaaatggatatcaaaagcgcctttctcaacgggcctattaacgagttggtatacgtggagcaaccaccgggcttcgaggatccgaagtatcccaatcacttgtacaagctccacaaggcactctacgggcttaagcaagcccctagagcttggtatgagtgtctccgaaattttcttgtgaaaaacggctttgaaatcgggaaagccgattcaactctttttactaaaagacatgataatgatatttttgtgtgccaaatatatatcgatgacattatatttggttctactaacaagtcttttagtgaagagtttagtaggttgatgaccaaacgttttgagatgtccatgatgggtgaattgaagttcttcctcggccttcaaatcaaacaactcaaggaatgaaccttcatttgccaaacaaagtatttgaaggacatgctcaagaagtttgggatggagaatgtcaagccaatccacactcccatgccatcaaatggccacctcgacctcaacgagcaaggtaaagacgtcgatcaaaaggtatactgttctatcattggctcacttctttacctttgtgcatctaggcccgatattatgcttagtgtgtgcatgtgtgcaagatttcaagccggtctgaaggagtgtcaccttgtggccatgaagagaattcttagatatttagtgcacactcctaaccttggtctttggtatcctaagggagctaggtttgatctcattggctatgccgatgcggattatgccgggtgcaaagtggataggaaaaacacatcgggtacttgccaattcttgggtaggtcccttgtttcttggtcttccaagaagcaaaactccgtcgccctatccaccgccgaagcggaatatgtttcggcggggagttgttgtgctcaacttctttggatgaagcaaaccttgagagattatggcctcaatgtatccaaaatcccactcctatgtgacaatgagagcgccattaagatagccaacaaccccgtccaacactcccgaaccaaacatatagatattcgccatcatttcttgagagatcattccacaagaggcgacatagacattcaacatgtgagaaccaacaaacaattggaggatatctttaccaagcctctagatgaagctaggttttgtgagttgaggagtgaactaaatattttggattctcggaatgtggattgatctattgtatgcatgtttgcttggtataataggttttgcatagcaccttgtgacaaaatggtcattcaactcatggatgggcactggtcacttttgtggagaacttgaatctatgtgtatggggatctcatttttcaatgaattttggtcctagcacaacttgaaatagattcacacattccctatctcgagggtgaattatcttgtctcatggtaattccctctcttttgatccctcggatcatccatttgacttgtggctattgttttgtgtgattgattgtgtgctagtcacaagttcaattggagcctatagtgctcgaccatccctccattcctaaatcctatccaaatctttgcgaaatgtgtttttgtcaaaaatttcccggagctagtcccctgcaaaattcctttaaaaagtttggaaaactgtttcttcaaaattccccttgcaaaactgtgttttccagaaattttccgactttctgaaaattttttggatttttcgaaaatttttcggaccttccgaaaatttcctgtcctatcgctcttcaatcaaagcaatcccaggatttttcggacattccgaaaattttttggatatatccgaaaaatctataaaagcgtgcacaaccttctggatcttttcggacttatccgaaaattttcggaaatatccgaaaatttcggggtctttttatgtcacctcgtggactcccttctctctcctttccactctttttccccacgggattgactccctcctccctccccaccggcgaccacctcctctctggtgacctcccgcggttcccctcctctccaacctcgtgggagcgcgtttggggcactccttgggacctacattgtcgatctccaccacgttcttcaagtgttctttgcgttcttgaggtattcgccctaaaatcaaatcctttgattcctcaagttttatcttgcgatttcctttggtggagatgttcccctagtgccataggacctgcagattcattttcacaagtttttgttggcggatttgtgcggcatctgagtaatagggttcggccggaatttttcggacttttccgaaaattttcggatttgtccgaaaatccttggccgacccctatcactttggatttgcacgattcttgccctcactcacttgtttcttgcttccttggcttccattcactgatcccttgtatctcttgtgtttgaaggatgcctccccgcaagcaaacctcccataagtccaagcgcccgagggaccgctctcccactccatcctctcatgatgattcagacggtgattggtccggtggagaggatgcggttcctcaggttgcgcggggggctcggggcggcaatcttccttctcggcggtctactcaagctcttggtggtggtggtgatggtgagggctcctctcgtcaaccgcaaacgccgccgcaccaacccaatgttcccattggccctctccgcattcatacccccgagagggatccggcggtgattcgtcacgtgtatgattggaggcgcaagtctgaggttgttgctcctcgccgcgatgaggatccacgctcccttcgccgcactgccacggatccgcggttttggactctttttcagcaagacttttatgagtctgtgatcaagtccaaagctcatcccactgttcccatgcaatggatcaattgggaggagttgcaggcgcacaatgattcggtgataaattctgtgattacaaattgtgatctcatgggtattcgctctttcatgactttgcagcaaaattggtgcaacgagatcattgctcagttttatgccaccgtctactttgatcattatcgtgccatgcactggatgactcagggatcctggtattctgtttcctatcagcagttggctgaaatttggggttttcgtcttcgctccttacttaaccttgatgacctgcataatcttcaaattcctgccaacactgagttactccctctttactctccaaatgatcctaatgtggtgttgggcaaggtcgatggtctcaagccgtactttgcctacttgaaccggatgtttcgccggtcctttgtgcctaaggatggtgatgctagcagcattaaccacctctctcggaccgtgcttcttaggtttgatccccctcctcatcgctttcatgtttatcactttgtgtgggaggaaatccgcatggcttccattcagtacaagaaggggttggtctatgcccctcacattatgcggatgatcgagactgtcactcagcttcagtttcgccatgatgtgactcattctcagcttcacttgcgcctagataaggccccccgctcctcagctgctcgggacatcccttccttttccactcaggcacctcctgcttctgagcgccctgcccctgtggctcgtcgtgagccgtctcccttattccgcattttgcggagtctttttggtctttgctccgcggaggccaaaaagaaccgccggcggaattcggcgaagaaaacggctcacgacgtcaagttcctcaaggcaaggtattatgaggaccaccacattgatgtccctccttctcctccgggtttcgaggccgagcccgatgagccagaggaggaagcgattgaggatccatttgctgggttgcctcctaacttcgacttcttcggttatggccatggctatggctatcttcctccaccacctccagaggatcctcctcaggcgcccttcgcttgagtcgtcgtcgcatcgtcctctctttttttggtgtcttgatgccaaagggggagattttctctctatctatcatgtctttatggtcgagcacatttggtttttatttgtatgagactatgtgtggttgctaagttaagtttaatgctttgtaagactttattgtttaattatggatgcttgagatgtaatggatcttattatgtttaatgtggtgcaatgccttatcctatttatatggtgcttgtgatgagatgtaattattcttatgcatatgatgtgttggatgtgatgagcatatgtgatatatttgttctcttgtgagcttcaatgtggatgcaaagatttagggggagctctctacttgcttttatgcacactctcacggggagctttcgctaaacctttgcaccaaaaccttaaattatattcattttctcttatgttctaatcgtattgtcatcaatcaccaaaaagggggagattaaaagtgcatctaggcccctaacgattttggtgattaattacaatgcgattagagaggactaacatttttctttaagcaaaggtgaaggttgctatgtcctcaatgagttagagtaatgcatttcccgccgaatacgttaatgagatgtgatgcggcaaatgagcaaatggtatattgtatcttttctttttgtttgagtcaataggtatgctgcactattaagagggatgatgcattgacatatgaggagtgatcaaagtgctcaaaatcaatttttaaaagtgtttctccttagtttgatgtgttctggaaatttttggagttttccgaaagtcattttcggactttctgaaaatgcacagaaccaattttcgcttctggaaattttcggatatgtccgaaagacattttcggattttccgaaaatgactgagaaggcaaatgtggttctgtttattttcggacttttccgaaattgattttcggagtttccaaaaaactttagcaaagccaaaaacgcttctgtgttttttcggacttgtccgaaagcgattttcggacttttccgaaaacatccaaaaccgtgtttttggttagaaccgtgtttttggttctggaaattttcggacttgtccgaaaagtttcggaatgtccgaaaaatctctcgttgactttgctgttggtgctgagctggaattttcggacatgt

SEQ ID NO: 4462 - DNA, 10653 bp, Oryza sativa
gtgaaggttgctatgtcctcaatgagttagagtaatgcatttcccgccgaatacgttgatgagatgtgatgcggcaaatgagcaaatggtatattgtatcttttctttttgtttgagtcaataggtatgctgcactattaagagggatgatgcattgacatatgaggagtgatcaaagtgctcaaaatcaatttttaaaagtgtttctccttagtttgatgtgttgtggaaattttcggagttttccgaaagtcattttcggactttccgaaaatgcacagaaccaattttcgcttatggaaattttcggatatgttcgaaagacattttcggattttccgaaaatgactgagaaggcaaatgtggttctgtttattttcggacttttccgaaatcgattttcggagtttccaaaaaacttcagcaaagccaaaaacgcttctgtgttttttcggacttgtccgaaagcgattttcggacttttccgaaaacatccaaaaccgtgtttttggttagaaccgtgtttttggttctgaaaattttcggacttgtccgaaaagtttcggaatgtccgaaaaatctctcgttgactttgctgttggtgctgagctggaattttcggacatgtccgaaaatctcaattattgtgcataacgggcagaatttggtctgtggctataaatagccccctcccctcacttgtgagggctgctggttctattgcaattatttgtgcccttggcttgctctctctctaacacttttgagccttgctttcttgtttcccctctcacccgtgttcgattcggatttggtgtgtgtgtgagagttgtggattcgagtttgtgtgagtgcttgttgttgacttcgtgaagatttgtgagcacttgcatcatctccgggagttctttgcttcatttgttactcttggaggttgaggactccaaggtggctaggtgtcgcccccgagccaccgatctacttgtggttggccgggagaagtttgtgaaggtcggatctcacctccgaaagggaagagatacccttagtggaaggaggagtgcttagtgcaacctctagaggaaaagggttagctaagacccggctcttagtgagctcctcaacggagtgtagaatcccctcaaggattcaaactttgggaacatcttcgtgagcttcatctttggtgactttacttcctccctctccactagcttagcttgcttgagccgctataggtatagttgctgtttgtgctagcatattcttgttgtaggcaactagatctatgatttactttgctacttgtgctgactccgaaaatttttggatatatccgaaaatttcggaaatatctgaaaattactgcttccgcttttaattgaatttttgaattagcctattcaccccccctctaggcctaattgacactttcaatgtgtattgaactctagccttagtatcccgcatgatctctgaccaccctggacgttgtcttatctccaagccgactcccggtccatcaccgcaaatactctcccggtatcaattcacctacacatgaaacaaacaaagaaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatccaatcatctccaaaaccacttcgagaataatattccaaatatcaaaaccaataatctccaatgccaattgttcatcacaaaataataatcaaaaacacctttgattttacaagttcgtggcgccgttgccacccaccccagcacccgacgtcgctgctctcccccagcgcccgacgcagcgtcgccaccacccacccccagtgcccgacgtcgctgctctcccccagcgttcgaccacaacgctcgacgccaccgcccgccaacaaccccagcccgccacctaccgacccacctatggcgccgcccagcagtgagcatgagctcctccccatggtgctggtgagctcaagctcgtttcctccgccgtcaagctcctcctcgtggttgcagtactggcgtggtcgagcttgttccatccaccgtcgagctcctccggttctccccgtgttcaccggtgagctcatccccatggtcgcctcccttcttgcttgcccccatagctcgtgagcctaacaagccagctcgagctttcaaacaagctgagccgagctaggtttctagctcgttaggataacgagccgagccgagctagctcgttatccattatcctaatgagctagaccaggccgagacgagccgagctagctcgctatctacccctatgccctgagcaagatgcttgagagaaatatatgcctgtgtggaaggaaatatatgatgacgcttaactaatcaggcacacccctcgtcttgttgtttggttggagtcctatacctaagataaaacatgtccactttagattgtgacaactattatcaaagagagattgaatggagtaaagccagacacgcatgttccttagtctggcgagcaactttggtggccctggcctgagcgtgggtggtcctcagggtagtaataaacaaacaagcaactaagaattctcaggtaggctttaggctaggcaactcctctctagggcaagcagcaaccaaacacatccccataggttctgtttggagaagtagccaagagttatttgaagatctaatttttagcacaagaaatagccccccaataaaatagcccttgagttgtttagatccaagagctatttggcctttaatgcactttcccaatcatgcgaggagtgggggcggcagtgctggtgggggccggcggtgcggcgggtgaacggccgcacctcctgcgaggagtggaggtggcggcgctggtgggggccggcggcgaggcgggcaacggccgccgcgccgacgaggagtggaggcggcggcggcggcggtgaaatatgaggcgcgtgcgcgtggataaggcagaaaggaggccatgcggagagagaggaaagccaccttttttagtgggttctacccgaaatatcttcaatgagcacctcttggataggatagtttttttatgggttatttccaaatagccctcaaatagctcacccatttagatttgttgggctatttgagactaaaaaatatcccataatctaaacagggccgtagtctctcacctaacttcactttcgagtttgctagatctgtatgtggagcgagaagacgacagaactgatgagacgagatggaaagaaagaaaaacaatgtgggctgggttagctacggatgcacgtgtgcagccactactacttaaaaaaaataaggatctttcatgacccttaagatttattttcactagcggccataaaaaacctcgcttgtaaaataaaaacagacctgaaaacttggtcccaccaataaaaatggatttccacaagcagagtcttaagagcactacttgaaaaaaataaccccacatatgaaaatccatttttactagcggagtctaagggttaccaccaacaaaaagatcataggagaagggcgtgtggatcaagtcgtccttatcccatccctcaactatctctttttcttttccatcagccacttcctcaaccacttcctagatatcccctccctcatccatttcctctcctctccctctcttgcttcgatggcttgatggcggcgacggcggcaagaaaagccatggctgggctcggtggtggcagcatagggaggagacttcatggtggaggaaggaccaacaacggccaggctcggcagtggaaaggggaaccgtggcgggctcagcggtggcaaggagaaggtagtgatggtggaggagcaggacacctgatccggtgatgacaagttcgtctatggcggtgaaggggagtgctgcctccaccatcaatccctactcgaggagagctcaaccacaacgacgaaggggagggcggtagtagtagaggaaggggagtcctagcttgtggatccagtggtggtaggcatcgagagctctagttctagtggtggcggtctttgggagctctggatctgctggtggctacaggttagcgataataaggacaatggcttagcgaaatcgaccaagacctccttcctcatctttcccgaccagatctgagctcgcctgacctcctttctttgaaccggcagcggtgatctcggcggctcccgaaagggcgtcttccacccatttggcgacaccgccatcgacgacgtcgactttttcatcgaccaagacgtgtggatttggggattgggaatttgagacagtgatagtggatcctgatttttaatattttttctcctaaaaacattctcgatggtgggtctctctagctaccatcagcgaaaatcactttttcatatgcgacctttttaccttagccacttgtcaaagttgattttcgctggcggccggctgctcatcagcaaaagtttattattttcactaatcttaggtcgttggcggcgccgctgactgcccaaaaaaacctgttttggctgtgagaaaaagttgttattgcagtagtgaccgaaagaaaaattttagaattataccgttgaaattcatttttcttagaaatatacgagattcgaaagaatttacactaattgacgaaagcgcgacaaaatcgcaaaaccaacgcgctattgtgcggtctcgcagggcgactgtgcgagatcgctctgacatggggcctcggtctcgcatattggccaagcgagatggctggaaatgacgctaatgacttaattaatcttcctaattagtggcaaattaattactaataataataactagttaaacaaaaataactaattaattgctaatgacactaattaatctattaaagacgtgagttcgcgcgccaccagcgcgggagacagcggggtcgcgcactctttatgcgagactgcggtctcgcacttttccttccgcgacagtaccacaatggtatataccatttctgtaattttcttctaaacgtgtatatttctataaaatcagaggaaaaaggttttttttttcgtgatcgaaacgcgtttgcgtgggtctagaccgtattatattactgctcatgtattagctgttctgtacgcctgcttcattctgcataccactgcgcactgccgccgcttaattagtggatatccctaagcctaatttcacaagataatccgttggaaacacattggaattttaactaaactagtgttatacatgtgcattgcaatcgaatttggagtaatacttaatggcgctgtgctttcagtggtaggcgatgtacccgtcgacagtgagacgcctatagtgacttcgtcaatctctccaggatttgccggcccagtcttcgaggtaaggtttgcgtgcgtgtgtttatagggatgagtgcgcgtgcgttgtgagtgtgtgttgtactgtgtaattcttaaaaaaaaatttggagtaatactggtgggaggggtgggtcggtttgtttttttcttgggattttctcagatagggagggtgggtctgtttggcttttatgggattttcccacgtagtcaggagaggtgggctggtttggttttttacatgattttggctcttttgagattctaattttttttcttcaaacttctaactttttcgtaacatcaaacttacctacacatataaacttctaacttttctgtcatatcgttccaatttcttcaaacttctaattttgacgtagaactgaacacagcctttctcgcgctgcgagcggtaggggatgatgaccgtgtatttaaaataatagagataatgtatagactagaaatatttataaccgggttaaggtcgagttcggcactcacctttcccaacctatactccatcatttttcacgcgcacgcttcccaaattactaaacattatgtttttttaaaaaaaatatacaagaaatttgtttaaaaatcatattaatctatttttaaagcttattttagttaatgcttaattaatcatttgctaatagatcgctttgctttgtgtgcggagaggtggagttcccaacctccaccttcaaacacagcctaaacaagttattgtgaacaaagtggagtaaactgcaggagccatatatatccaattgaattttcacagtgaatttcaccttaactaaatcgtttcttaactaattaaaatattcgtatttttcctttcgtcacctcgtccgtgcgatggtttttcatccgtcccacccctcctccaaaaaaaaatcccaatcggaattccatcatcacacaaacagaatcccacaatgagcacaccttctctccaaatctcaaatcatcacattccaaatcaaaaacaaaatcctagtccaaatctaaatcggaatcatcaaaaaacatccagaatattaacacgagatgacgagaggagagggaggggcgagccagaggccgccacgcgctgctccttgccacctcaccttcggccgaatctggtaaggagtggggcggcgaccactgcccgatgaggagagaaggagccgacgccggatctggcaaggagccaccaccaccgccgctcgtggtgggggagggcgccgccacagccactcgccgcgagggaggctgccgcgtccgccgcttgcgggagggcaaggcattgctgccgccgtcgccgatgctcgcaggaggaagggcgctgccgttgctcgggggagaaggttgccgtcaccactgccgctgctcggtggggaaggctgctaccgtcgccatccgttgggcaccgccggtggggaggggcacgaaaaggtgcgccggtggggagagaggcggcctgcgtggaggggaggaaggggaaaactggaattaggattagggcttatttggtccgggggttttgatggattaggagccgatctgagccgtccatcaaaatgaacggctcagatcgctcccgcgtcgggccagcatccatcatcgggccgcatcactgctaggccgtgctcgcttcatgagccgcatgtaggtcggtgtcacgccccgaactagtcccgaccggaactagcccgtgacgctccaaattaacctgttaatcgataccagtcccaggaaacagtgctggtatcataggaagacagaatatcacagcaacagaggtctctttaatatagagaaggagtacagtcatgttgggctgcggacagatcccgagctcacaactgcattacaaaagggaagcggaagccaagacttggaccaaacaacacaggcgcgacttgggaactaggccgaaaccctaaaactcaacgtagccggcttgctcctagaagaactcctcgtcagtgggatccgcttcatcttcttcagcaactggggggagttatttatatagagcaagggtgagtacgggagtactcagcaagccatgggaaataagtgtttaatgcaggcttcaaggaaaggctgttgtttttgcaattgattttatttgaactcttttctgaaaataactaagtgagtgcttctcaaacgacacggatgagacagtgcgtctcgtccggtcggagtatgtgcaaatgtatcagtctttagaattgatcaagattggcacccggccaacaactttcaaacgaccacccaggccaacaactttcaaacggccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaatgggccggccggcccaacaaggcggtccagagcgcgcgcgcgggcggggaggagagagggagccggtggaccgggctcacctcgcgtggtcccgagtgggacccgcttgttggtgacacggttcaccgtgcggaacgcgcacgcggcgcccgctagggtttgggggagggacgcggtgcacgcgcgcggttcccggaggacgcggatgcggtgggcccacgcgcagcctcacggctcgcggtggaccgcgcccgcgagtggggccgaggggagcggctgaccggggtcggctcgacccggtcttggccgagctggcgccgacgtggctgccacacgggccggcgggaggtagacgacgacgccggccggaacggacggcggacgacagcggcgagcggcggagcgaaccacggcgatacaggcgaaaacgagcacaccgggtggttgcacgggacgagaggagtcgagccaacggctcggattcgccggagggagctcgacggcggcggattgcggcggcggcaaccggcggagagaaaaggggaaaacggcgacgaggtcacgaggggccgattcctggcggcaagagcttctacgcggctacgggaatccgtcccttgcgccggattaggaggaaacgcatcgagggaggccggcgacgagaggcgcttccgagcttgggcggcgacggcggcgagcacacggcgagcggcggcaacggtcggggcggcgccggctagctacgggggggctactcgtgctactacccgagtctaaggggaggaggtggaacgaggaggaagaacggagggaggcactaccgtgcgggtgggcgcagtgacgagagccgacggcacgaaacgtgatcgtttcggcctctggccgaggaagagaagggggagggcgtgcccggagtccccttccgcgtccttgctcgtgccggctccttcgacacgcgcaacgacgaacggggacggcaaacagagcacgggaggcggtgacaatggcgtggcggcgagagacgaaaacgagggagattgcaggagggaggagcttgggtttataggggcgacaatgtcggtttgggagaggggaaccgacattggacggtcaagccggcgagctggcgcccggctagcggccaaaacgacgacaggaggtgacgccggcgagaggaggaaaaagaagaaaggaagagggaaagggggcttgcctccttgccgctttgggaaaaggaggagggagcgggggggtgacgcggcagagggaggaggagctctgcctcctctccttggaagctagcgcgtggaggggcgggccgagtcgatgacgacgacgatgacggtggggtggtttggagcggggggacgacacgggcggcaggcgcgggcaggcgcggcagaggctgacgacggcggcgaccaggcggtcggccaccacggcacgcgcgcgcggaaagcaacgtgcgacgcggcggtttgagcgg

SEQ ID NO: 4463 - DNA, 4598 bp, Oryza sativa
acgattgatctgggatttaagatctgagaaagcacggacactagacaacaagcaaagaaacagatttcgcaaataggatttttaagagataatttttcccgctaggcgccacgacggaacgggcgctacagtcggctcggttgcgggctgaagaacaaaatgggctgaaaaaggcccaaatagaaaggaagatttttatttaaataaatgttgaaatgatgtttgtattattaaaattagcaattaagttcggaaattccaataaaattccaaagagcgtaattaatcgtggggaatttaataaaattaattccaaccatatcattttatttttcacacttactttacttgtaagctagtaatttaattattatacacctagctacttaaaaaatacccagatatcttaggaaatttgtatttcaattaattacataatgtaaatctttcttaacttttccttaattttctggtctttatatttcccgttgcaacgcacggatacttttactagtaacaataataaaattaaaatagttttcacctattgcaatgtacggatatttttttttgccattgatacatgagagccataaactatcttgcttgtgttggaggcttgaagctgtaacggataataataataagaagaagaagaagaaaaaaaaaagagaaaggtggggcccgcaaggtaggggaaggggcccatgggccaagccagaagaggtcgggttcggagatccccattaccactagtcctactgtacttcggttacggaggagattttttttctaacaaataaactaataattattataaagggaacagatccccggtggggcgaagaccgaaaccctagccgtcgcctccgccgtcgccgtcgccgtcgaaaccctagccgccgcctcctcccgatccgaccgtgtcgccatggccatgcgctctctcctcaccaagctgcggatcccggcggccgcttcccgccggactctcccgccgtttcgctctttatccaccgccctcaggttcgcttcgttcccctcgctattaacctaatcaatcccttctttctgatgatgtgcgatgataattggcccgttcaatcaccaccttctcttgtatctcgcggtttgcacgcacatgttctagcgattcacctctccgattagattagtgttattacccctaatgaacctttggacccttaatttcgttcattcaaattatcctatagtaccttgtgtgttttgttgtctctgtgttggttgacctaatttaactcaaaatcttttatttcccctgagatgaacaaaccccgatctctgttttttttccccttcgagatgaacagatcgagctgttttttatcagtattatctaccaataacaagtactagcatttactgtcctcatatgatactcgccgcgctgggcttattttcttcagctctattatgatcaaaccagtgactctaacttatgttagatgcaaacctcagttatttacctgtacctgtatatagtctcttccatctgagtttattaattattcgtagtaattggtttgtgtttgacattgcaccaccatctgactctctctgtctctcttgccttatatatataggctaagggtaagcttagcagcactgctactgcccaagatggcactccagttcctggagagggcaggtatggcgctgattcatggttctagttcagcattaatatctaataatcatttttctccttttaatttgccaacatgcatgtttaactctagagcttgcgtctcatggcttttttttttcattttccctctgcctgcaaggcgcatacttgaacagattatggaagaaggggacaagcgccaggggaagctgatgtggtatgaaatcattggcaacttcatcgcgttcaatgctacactctatactgtctaccttctataatatgaataggttcaggaacaactttattcaaatactgtgatgccatttggagacatttcaatgatgttcgttccaccatttcgaggagaattcacaaatctattacttcaacctcatcatgaaactaccactaccgcagcagctgagcatcagcttcacggcgtttaggttttttaaaattacatcgacatcttagtactgatgtttgaatattttaccatcgctagcacaggtgactgcattgcaacggaaaagctaaaattacaatgaaatcattatctaaatctcctatgaaaacacattcttcacggaatatagcaatatgtagaccaaatcgatcggtttattttaatgttgctcttgatccattacagatactcggtgtcaccactcaccaccagcgcgcaatgtagaacaagacttgctcgtattgatggttgtctttgacaattgacatgctaggtcaaggcatctaaaagagaatcagtttgcacctacaacaatttctttaggcaaaacctggcttagtaccattaattgcactcgagtattgttagtactgatgtactataacacaaagtagaaaaattaaggctgtgtttagattcagggtgcaaaattttggcgtgtcacatcggatacacggacacacatttgaagtattaaatgtagactaataacaaaacaaattacaaattccgcctgtaaactgggagacgaatttattaagcctaattaatccgtaattagcaaatgtttactgtagcaccgcatggtcaaatcatgtagcaattaggcttaaaagattcgtctcgtaaatttacacgcaatttgtgtaattaattttttttctatatttaatacttcatgcatgtgtccaaacattcgatgtgacatggtaaaaagtttttgcgtgggaactacacacaggggtgtgcctacgttatactaccggtgtcacaggacaccgggtagattattcaaatcctatataaattacactatattaattaatatattagtcaataattagatagttagtatgtattggacccccggtaatttttgttctgggttcgccactgactacacaggcctaagttttctcgtgaagcaacaaatcctgaattcctgtattacttaatccaagagatctccacgtaaatatgtctatcttttttaactcaccatgttgatcagccgccattcttgatctatcaagaaccttgtcatcaggatgtcctacttggagctcttgacgattgtttgccataccaccttagtacagtacaggtccttgaggtgtctttgtactgaacattacccagtacagatgcatgatcttcctagctacacggaccctgcagcctgtatcccggtcatgtcgtcgatcttgtatttgctttcaaaaaactgtatatacatacatgcatgcacagacttacattgtgaatatactgtgcatgatcttgtatctttgtattggagaagactgccataccatgcacaggattgattgattagcttggttttttttttcctagcttaattgccattgcaattaattcaaccatatattgcaattaattcgatctcctgaccatctcaacctgcgaggaagaactactactactactactactactactactactactactcgatcatctctccggcgctgtgtgtgtctctctcagaactaacgaatcgatctgcttgctatagctatatatatagacacacgggcgatcgcttgttttgcttcgcgggagtcattccacgatggcgcaaccagccgggcgaacgaacgaactgaaggaagcggacgttggaagcagatttcgacatgcatgactcgatcagtctgccgcgggatgactgaacagaagctaagataatttgattgggatgaagtactttaccagcctcaaaagaaggttttgtcctaaaataaaacaatggtacgaaaagtagcataaaagaaaataatgcttatgatagaatgaataattcatttgccaaatgaaacatggtatataagcaaaccttgcaacatcacacaggcaggcaatctcaggaatacccatgagtacatttccttccaccaaatcaccatggcctgccagatttgagtgcaatcaactttcagacatcttccaacatcttcacgctttggccagttcaacaaggtatggttcaagttcaatcagataaagcacccaagacacaaaatacacttcaagattaactaactattcactaagtagaaaatccatcgttgatgtcgcagtcatgcgatggctgctgctgcacccacagcttcacagcatctcccacggccagaagtgaggtcttgaagaacacctccagataactcagattcttgtagatggcttcagctggcgttgccccttcgaacctcacagccacaaaggtgcatacaagcacctgcatgcctgcaaagccaagtgatatagtcgactgtcgacgcctagtcttttcgaggtaacttgcgagcattttcccaataaggattctgtgattaaaaaaggaggagagttaggcctggtttacggtgtgtttagttcacatcaaaattggaaatttgattgaaattagaacgatgtgacagaaaagttgaaagtttg

SEQ ID NO: 4464 - DNA, 958 bp, Oryza sativa
aaaactttcctgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatcttcctggctcgcacttgaaaagaattcttatctcctagcaagacctagaaccaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttgatgatatcgttgtctgcgtacacacccaggtctccagctccatccttcacagccttgctggccttcacagtgagcacgcgagggcgaagaagaagatgaaggcgcctccacgacggacatgtcggcggcggtggccacccgcggcatggtggaaccatcgccccggtagatccttgccaggcgagccaaagcgatgtgggccctttgggatcccaccatgacgcgtcgaagcgccacggccaccccgacgatcttggcgcgcacggcggcgaggacggtcgacttgccggtggcggtggcgaggcccctgctgcagacggcagcgagggcggtcgacttggcgg

SEQ ID NO: 4465 - DNA, 3822 bp, Oryza sativa
atgaacccgagcatggcggcggggtggattcgcggcggcgcggcgggatggagacgggaaccctagcgcgcggcttcgagtgacgacacgagacgagaggaagggtagctttgctgtgcgtgcttgctgtcaaactcgccacacgcgctaatcacaattaccacccatcattgtcttaaacattttttttctaatattagattactcctactgtactaaatagtactccccccgtcccaaaatataagggattttgagttttttgttgcactattttgactactcgtcttattcaaaaaatttatgcaaatataaaaaacgaaaaattgtgcttaaagtattttagataataaagtaagtcaaaaataataataattttaaatttttttaaataagacgagtgttcaaatagtgcaagcaaaaactcaaaatcccttatattattgctattaaacctttgatgtttgacaacataggaatataaaatatacagtaatgtaatttcatgccacaacaaacccttcctatagaaaatgaatccacgtgatttttccaaaaaaggaaaaatgtttggtagttccataggaaaaggataggcattgcgagtcacacggaaagaaaaaacatgagatcgatctaaaggagccatgttagttgccctccaaaatttcattggaataagccatttcataggttatcctagtcttcctttgttccaatgagccattctggaatattttctagcgcattcataattcctattctttttgttggttctaaaggagcccttgactccttgaggcaagtgtgtagtgacacacgagtaagtaaggacattaaattcatatattagagaataccttcaagtgatgttatattaatgttataagtataattaatggaaggtgagaaattggtcaaagtacaacaaacaaagatcgtacgtaaactaatacacttgatatatttttgggacgggacggagggaagatgtgctattgtcgtatcgatcgaattcctgctttatatttcaaaccttaatctttttcttctttctgttaggactattttctttaaaaaaaatatttatttttattattatatatatagatgtatccatgtttgtaaaaataccaagggtgaatttaggagccacacccacaaaactgggtggctcgttggcgcataattaatttagtattctttccgttccaaaatgttaaaacctattaggataagttccatttgaatttggatggaagaagtattatctgtaaagaaaacttaaaaataggttggtgtgatttttttaaaatcaaattttatgtaaatattttgttgaaagaaaaatgtaccgttttgtttaaaactaacgtgggaggtataaaagtgaggtgagggtagaagttgagtgtatcccttctttagatcttaaaaaattttaggcaaaaacgtcacatcaaatgtttggacacatgcatagggtattaaatgtggaaaaaaaaaactaattgcacagtttgtatgtgtaaattgagagacgaatcttttaagcctaatcacaccatgatttgataatatgatgctctagtaaacatttactaatgacagattaattaggcttaataaattcatctcgcagtttacaacgtggaatctgtaattgtaatttgttttattattagtctacgtgttcgtatactttaaaaacttacaaaggttctataggctggctgccaggcccctttccaaacaccactttaagatctttcaccatagcaaacactgttttaccgctgcgatgttttggcttcgtacggtggtccgccgtatgttcaaagtgcttgcctttcttccgtactgggtggtttgctgcaaggaatcgatgatgacccatgtacacaaccttccgacagtgcttaagatacgtactttttgtttcatccatacagtgtgtgcaagccttgtaccccttgttggactgcccggataggttgctaagtgcaggccaatcgttgatggttacgaacagcagcgctcgtacgttaaactcctcctgtttgtcctcgtcccacacggggacaccttccttcttccacaacagtttaagatcttcgaccagtggtcttaggtatacgtcgatgtcgttaccaggttgcttggggccttgaataataatcggcattattatgtacttcctcttcatgcatagccaaggggggaggttgtagatacacatcataacgggccaagtgctatggccgctgctcatctctccaaaaggattcatgtcatccgcacttaaaccaaaccgtatgtttcgtacgtcctttccaaagtctttaaattttctgtcgatgtttcaccactgcgaaccatcggcggggtgtctcagcatcccgtcctgttgacgttcttcagcgtgccaacgcatcattctagcattccccttgtttctgaacaaacgccttagccgtggtattatagggaaataccacatcaccttagcaggaattctcttcttcgttagctgcccgtcaaccttacctggatcatcttgtctaatcttgtatcgtagtgctttacaaatagggcatgcttctaggctctcgtactcctcaccgcgatataggatacaatcattcggacatgcgtgaatcttctgaacttccagtcctagagggcagactatcttcttagcctcgtacgttgtcccgggtaatttgttttcctccggaagaatgttcttgacgagtttcaataaatcgccaaatgccttgtcactaacaccatcttttgccttctattgtaagaacttcagagtggtatccaactttttgtgcccctgctcgcaacctgggtacaacgacgttctgtggtcctctaacatccgctccaatttatgggaccccttttcactttcacagtcctcctttgcgtcctgcaacatctgaccaagatcatctgcagcgtcattatcgccagcatccctgtccacctcgtccgtttgattttcttcaaatccagcgtactgagcccagtcgggaatgttctcgtcctccgcttcaccttcttccatttcaacctcttgctcactgtgggatgtccaacaattatagcttggcatgaaccccaactcaaacaagtggaaatgaatagtcctggatgcagaatattccttctggttcttacacttattgcatggacaacaaataaaaccgttacgcttgttagcttcggccactctcaaaaaataatgcacgccctcgataaactctttggaccgccggtcaacgtacatccattgccgatccatctacatgaaatgaaaaaaaattgtacataaataaattttcgtacaataatgacagtcaaacagtaatgataaaataattaaaaactctttcgacaagcaattcttattaacaatttttgaagttctaaactaatattaatgttgtacttctcttaattttcaatttagtttgttttctattttttaagtaattttcatcatattttaaactatgagaataaaatttctatatattcttcttccccacacaaattttctctctcatcaacttacaacaaagttttggagaaaaaaaatgtgtgaaacatagctccaaaagtaatataacaacaaaaaaaaatcttggatgatgaagttactaaccttttagacacctccgatttgtatataatcactaaaagaatttcacaacatattttggcatgacctcccctctttctttgagaaattttgaagcttgctctcgggctggaggaggaagaaggcatatataaagggggggatct

SEQ ID NO: 4466 - DNA, 6776 bp, Oryza sativa
gggactaaagatcccgggggccctgacaacgtctgacatctctacaactgggactaaagatgatctataccaactgggactaaagatcacatatgaccgttgtagccaccaatcaggactaaagatccggttttaaatggatccgggattattgtggatttcggccgaccgaccaaagatggtttctccaccagtgcttgctccgtctccacccaccctttcctctttcgctctccgcctactccgcttagggcagtagcaatgcaaagccatccttctgtgtcttctgttattccctactatcgccgtgtttagatgctgtaaaaatttggctaattttcttttatgtacacagacacatattttaagtattaaacgtagactaataacaaaacaaattactgatttcgactgtaaactgtgagatgaatcttttgagcgtaattgatccgtcattagcacatgtatgttactgtagcacttatggttaatcacgatgtaattagacttaaaagattcgtctcacgatttatagttggactgtgcaattaatttttctttttgttcacatttgatgctccatacatgtgtccaaacatttgatgtgatgaaaaagttggaatctaaacacagcttatacacagtgggcgttatctgttttggcacaatgcaagttaccaaggttagcattgatatcccaggccaaggaatatgttccccaactacccctttgttctcctcgacgcatcgcctccccacccacttcatctcccaatcccccgctttttcccccagttcgtgatgatgctgctccgacggagacggcggcggcagcggcggcggtgatggtggtgaaggtgtgcgaccacgacggggcccaaggaacggttctttcgacggccgccggcacggcggccgcacacgcctcaggcgagtcctgcaactgccgctacgtcggctgcctcgccacgtcctcgccgccctgccattgcttctcgtcgcggtctgcggtctgcccctgggacttctccagcagagacagcgaggcgggagcgaggtcacacatggagccgaactagcgtgagaggaatagaggaatacctctctctttttctttcttatctcatgtcctagctctcccctcctcctagatccagttctcccctctccctcaacatcttcttcctctttcaattcgacgggaggggtagcggccgcggcaaggggagcccgtgggcagagtttctcccacagttgccggtagcagagctcgggtcgtgggcggcggatgatgtgctattttttggtcgtgtggatgtgtgccgatggaggtgaaccaatgcgatgcaattcgctgagatgccggctggtgcggctgtgcaagccgctcatatattctcccttcgtctcataatgtaaggtattttgactttttgtttatactgtttgaccattcgtcttattaaaaaaaatttagaattattgtttattttatttgtgacttatttattatccaaagtattttaagcacaactttttattttttatatttgcataatttggtcaaacagtgcaagaaaaaaaattaaaatttcttatattataggacggatggagtatgtcaggggacgtcgatcaaagtccgaccccgtgcaaacagctagtagtagatgatctcgtgcatgtgcaccgtgcacgcgtacggggtggcggcggttattttgttgaattgaatcgccccttgccgagctgaccgacgtctctgccatagtgccatccgcgacgatatatcgatcggcggcaaggccgtctccagatatttggggccaccgaacgaaatgctaattggatcctaaattttgaaaattttatataactaatataaacaaagcatactttcaatcaactatataactttaatatgtgttattttatacaaatattaatgctaaaagagaaaaggtagtactactgatctcatgttgtactgaaaagtgaaaagcatcatccttctagtgtttcttggaatgaaatcttaaattatatcttcataattaatatcgagattgagctgctgcatctagcctgtctcttcctacgtttttcagcacctgaatcatactttctgtttctagaagtgatgaagtgatgaggaattaaagcaattgaggaaataaaagccttcctgagttcctgttttataaacaaaataaagaaaaagacatatgtcgtatacatacatacatacatacatacatacatacagtatacacacttgattagagaatcagagatgactagataagatgagatcagatgaaagtctagttcgttcgtcaaattacttgatgatcaaactccctttgattcatagaattggaaaaggattttcataggattcaaatttctatggatcttttttctacatgtccctttgatttatagaaaagaaaggaaactacaatcctatgctttccatttcataggaaaaatagcaagagatgtgacctctttgtgaacttttctttatttttcctatagcactatcaaagactcctattgtttttcttgtgttcgctaattcctataggatttgagaaacctactactttaattcttgtgtttttttttattcctgtgttttttctatcctgcgaatcaaagggccctcagtctggttgccaggggcgccctcgccggctcgcgcttgctggttgccggcttgccgcgcgcgaccgcatgccggagttagccacgccgccgctgccgctcgatcggcgctcgcccgctcgattggccggcgattgttgtgctgtctgcctgcgcgtgcgctgcagcctcgcgtcctccctgcctcggctgctcagtccattgtccacgcctccatggccatccaacagaccaacacagcaacttaacactaaacgctcgcgagttggagtcggtgaatcgcggcgacgcctcgactaacgcatgcatgctgcgagcgatcaccaatcaccgcgcgcttgagatgaaaacaaggcaactacgctcgcgagacgcgacgcgacgcctcggactgcaaacttccgccgttctcgcacacccccatcgacggccctgatcggcggtcgatctggtggctgtggtgcacggcgatccagcgacgccgcgcgactcgggtctccagcctccaactgccactacccgaccgacaaaacctcggactcgtctcctgcgaaaagctaattaatccctcggtaaaaaaaaaattggatgtgacatattcttgtatatacaatgaatatggataaatgactagtttagtttccaacttttatttttaaactttcaactttttcatcacatcaaaactttcctacacacaaacttccaactttccgtcacatcattctaatttcaatcaaactttcaattttgtcgtgaactaaacactctcgtatattggttttttatactaaatccgtcctaaaatgtaaacatttttagctataaatttaaacatttacattttggaacggagggagtaacatatgatcttgagcatcaagcacgtaggagtactggagtagtaagctggcgaagaaccaccgatcgaggatctgcttgagttcacgcccgcatgcagtcaccgtctagcttgacgtagggtttaccagaccttacgaaattttttttttaaaaaaagtaaatcggacttaccaagccaaatatcacttggtttaatttgcgattatgctttaaaaatcaaattgaattttaatttgtcgataattaaattagttttttttcccatgcacgcactgtcctgcgttaggttaatattatactgtcgctcggcgtcgttcaggaattaattcgttgtcctctcgaacgaataatttctttacgtctgatgcaacgacatacaatattaatgagagagatgcctgcatataattacttatactgaccggaggatctggtctctgtttttcactagtaaaagagattatcatggacaaccttttttttcgtaggtgccaggcggggctaaaaatttttttttggttcccagtaatataaagaccaattatgaaaattctttttctcaggtgaacctattaagaggcccgcctagctgcaaggtcaacctctcgtcctctcttccctctcaatatttttaaaagttaataagtcacccatacttatatcctcagctcctctctctctcctgctcacaaactcatcacctgctctttctcgcatggtagtttgaataacatgctaatgaaaactatggtaaaatatatatcttagttagaaactaacaggggcctaagtattgggtgcatggagactataaatataactatctcatttgaaacaaatagaaaaaaaatgcttaagacttttagatggagaaagtactgacatagcacctactcttatttgctatagtaatttggtttagcacacattaattaaggcctagttaaaatgcatgatctatactcctttaaaatcagtaatttgtggtgggagcgaatctgccattccacctaatttcattgcaaattttacaactcacctcttcaactttttaatactaagaatcaatcaaatctaaatgggacatataaaatcgaattgaagtaatcattcccaataggaaaaagatgtgtaacccacactattatcgtaaattttcttttatccatatcaaaacaccgaaaacacacagagttgaagtactagcatgagtgtgtttcatcaactctacaatattaattaaaaacacagaaaaaacgagaagaggtgccttggttgcatcactgacaaattgaattagaagaaagttttcataagggtttaatctcttgcttatttttctatgaatttgagtaggaacacgatccaataaaaaattttctgtcatgcatgttttctatgaatcttaggtgtatctagaaaaaagaccagaaaatttaaatctactcaaaatcctttggctgtgtttagttacacatcaaaattgaaagtttaaagaaattgaaatgatgtgacggaaaagttagaagtttgtgtgcgtagaaagttcgatgtgatgaaaaaaataaaagtttgaagaaaaaaaagttgaaatcaggacctttgccaaatctttcatttcaaatgctcacagtagcaataaaatattgcatgaatgttcatgtcaagtttatactcatcacacgcacagtaatctagtcagacatgcataccttgagcagctgccccctgccctgcatggtgactggagtaatagaggggtgtttagattaggggtggaaagttttggagtatcacatcagatatacgggcacatatttaaagtattaaacgtagtctaataataaaacaaattacataatctgtctgtaaattgtgagatgaatatattaagcctaattaattcgttattagcaaatgtttactgtagcaccatattatcaaatcatgaaacaattaggcttaaaagattcgtctcgtaaattagtcgcaatttatgtaattagttattttttagcctatatttaatattttatgcgagtattcaaacattccatgtgatagggtaaaaaaatttgagagggatttaaacagggcctagatgatgatgagtgtggcagacaagagtggatctgatatgggtgccacagtggctataagctcccttgggagttgttgcttgcttgcttcggtcggatgattgatttacaccatgccctagccctgcccaagcatatgcctattgctagtcactctactccgagagcgagcaagcaacaattcgtgtaaaaatctatcgcgctagtgaggccttgtttatataaaaaaaaatttctcaaaaacatcacatcaaatatttagacatatacataggataataaatgtgagaaaaaatcaattgcacagtttacatgtaaattacgagacgaatcttttgagcctaattagtaattacgcaatgatttgataatgtaatgctacagtaaacatttgctaataacggattaactaggcttaataaatttgtctcacagtttacaggcgaatctgtaatttgtattattagtctacgtttaataatttaaatatgtgtccatatatctaaaaactttaagccgaataaaagtgaacacacccttactccttagagtctactctactatgtggctcgccatgctccaatgcgtcatgactataggaactagcaatagatttcgtacgaaattacgaatactagtagcgaagctcgttctagctgttccttaatttggatttggaggatttctcatgaaaactttagattattggagttcacaaggattttatacttgcatgcacgctcttttggactagaagaataatgccctgttctttctatatatttcgtcggattatattttatccacagttctagaaatatgttttcttagaaaaaaaaactttctctaccgtatcgttgggattaatttttctatactatacaaatttatttacaaaaatatataatttatctctattatcaaatagataatccgatgtaataattcggtaaataatatgggcctaagcttgataaagcttatgaaatagtttaatttcctaccctttcatttcaaaggaaaacaaagtttatttcgtgcgaaccatccagcgtcattacctcaaatattcttgtgtttcaaaaatcatgtgggcttctgatcgttttgcctgtgactcaaattgcagaaaaacagcatgta

SEQ ID NO: 4467 - DNA, 13256 bp, Oryza sativa
  unsure (1)..(13256): unsure at all n locations
nnnnnnnnnnnnnnnnnnnnnnnnnnnnnnnnnnnnnnnnnnnnnnnnnnnnnnncctgcatttttctattcatttttttaataatggaatgagtcagcctttgctcaagagctacagccaactattacagaattcacacaaaagaaactcacacctaaagttcacaattgcaaaaacaaaacaaatggcttgcacaaactagttgacaccaacacaagataaagatcctataactatagaattttattagagaacctccatccaaagttggcaaaaagttacatgatcgtcgtctcaaatttacgacttacatcatttataaaaaaaaattacattttcctattcatgttcctgtgaatcatgcattacaaagaagctctcaaacatgtacattatctattacggagtgtttagattttaggcgaagtctcttctctaaataaattatcctaacaaaaagaataaaaaaatacatgaaataaacttatagtcactcataaaaactttaaaaatacatgaaaagagaatttcaataaaataaaaccatatataatagataaattgtaacttaaaagaaccgaagctagctagcccgcccatgaaatctagcaattccctaggatatttttattttaaaaaaatcggtgttccatgttcacgctgggctctagggttgaaaaaaaaaacaggaatagataaaacatacgaatatggtaagattgtggatgtaaagcggtcactactacagaaagggacatataattaagtcggcactataggtgatggaaatggtataaccttcgtcctaaacatgtgcccgcaaggacaccaatggcaagaatcagcacctaagagcccacaaggacaccaatagcaagaaccggcacctttgtatataaataggtgccggtttttaattggaactgacacatattttttgtcagagaaagatgctggttccagctaaaaaccgacacatatatgactgtcagtcataggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggcatggaggcggcggctgctccccctacccggtgttgcggcagcggctgctgctgctccccctccctggcgtggcggtggctggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggctccttttgaacaatgggaaactaaggaattttggagaactagattcctatggaaaaatttcgtatgtgctcctttggaacaaaagaatatgtcttccaaatcatttaaagtccctatgaaatgggccatttcatatgtaggaatttcgaaagaaaactagcattatcatattttcttattcctatggcacaaagttaactttgtaacttttttcgctgtgtcatccaaacaacagtttcgaagcattcctatatatattattaatgtccataagaattcaattagcataacactttttccccgtgtcttttatctttctttgtttttagaataccgtgttctaaatgagccctacatgtctaaaactagcttgtaggaggcatatccttataatcattaaacatggtgaatcgttaaatgacttaaaaatgctacaaaatgaatcaaaaagagaaaaaacatatactaaaattatgtttttaaagtttaagttttagctattgagcaatcgtctagcgtggctggcctcggccagaaacaagctgccatacatagtctgctcctcgtactctagggctacctaggggaggacaggaggagtacgtggtgggatcctctgtgcagttgagtcacttacatgtggaccatagtaaaatgggacccacatatcagtgactcaactgcatatgcagtaagtcagaagatctgctttcggaggagtactagcagcagctataggccacctccccccacccatccaaaaaaataaaaataaaatcggccgtatctacaggtactgctagtctactactactccaactagttccatgcatatacagactagtatccatactctaccagcttgttagtagtagaatgttctctctcttttttttttcttttttcccaattagtttcatacccttaactttagtctagatttacaaattaattagtatttcctccgtttcatattataagactttctagcattgtccatattctatagatgttaattaatctagacataacatctatatgaatatggacaatgctagaaagttctagacataacatctatatgaatatggacaatgctagaaagtcttataatataaaacggagggagtactgcttaattaattgcacatgcatagaatttcccgttcctctacttgaatcttcgtgtacctccccaaacggagacaaccattattattattattattactaggtgattccccgtgctttactgcaggaattactaaccatttctcaatatattttttcaacaatcaagctagaagtaaaaaggaaaaaaataaatattagggtttttccatacatatcatgaaacaaacaaatgatacccgttctttaatgtgaagcatattgataattatatgttaaatattatagaaataaaaaataaatttgttaaaatattgtgcaaatgatatgaggggtgatgattggatatacttgcatgttaatttgtagaattgaataaattgtagatgatgttgtatgcttgcatgaggttaaatatgtaattattgctagtagatgatgatgtggcatggttgcatgttgagctttagagatgattgggtatgcttgcatgttgatttgtagaattgaataaattgtagatgatgtatgtttgcatgaggttaaatatgtaattattgctagtgggttatgatgtggcatggttgcatgttaagctttggacttagcgggctatagctttatagaaagtgttataaaaccagccccgaaattaacatcggtagctaaacgtggaagaagcgccataggagatccaaacacaatgacgacaccgaggcacgatatttggtaatggagttcaaccaaggcctacatctctggggcactggttacgagcgctcctccccgatcagcatatacaacgtatcagagttacaatgactcacggctggacgctgccagcagccgctccctctcgctatactaagtcgccatgcggttacaataggcacccctctctatttaagagagaccctaggagagagtccgactcttactctagtcctaatacctattacaactccaagtcctaaactgtagctgactttgtacacatattcgacacaaactctaacaaactccaccttggcgaatatgccatgccaacctgaatttgttccttgcgcgaacctccgtgtacccggacttgagtcgatcttttttcaccactcacgcatttctaccccgacaagcctctaccaggctcaccgtaaacaagagacttcactatccttgcgatttcttccttttgactccacctgcaacagtgctccaccttctctcgtatcaccacagttgtcttgccaagcgaaattgaattccttcctagctttcacatcatagacttcttaaagaccatgttcaactccatctaccgtcttaaatttgacttgatctaatccatggccagataacccacgtcaccaccaaatagataaatcaaactcaccagacttgaagagaaccctttcttccttgtcgtcttatgaaccgagctaataaatctaacatccatgctttcccgcatccgtagactgaattcctaataatctgggaaaatcaccgttgctttgaatcatccgaagaaattaccaccatagcgctcactcttcctcttcagcgacgcatatttcatatatccccatcatgcaaaccccacagatcctggatatatcctgtactgccaaacagtccgttgatacccttaacgttttcacccgttgttgtccaggatttttccttcacacacctttgccacactcctgccccaccacagccttgccttcgaatcataatgcagaagccctgatgcacagttatttttgttgtcaatccatgatctcaatctagccctagacgaaatgtccatgtgagtgatcaactcggcttggtgaacgagtcccattgaaatacgtgtccaatcccagccacctagcctccgtgctgatctccacgtccatcacgactccaagttgagaagcaactccgcaaccgaatcgacctccaacagctacacaaactgtacatcatccgcgaccctgattcgatccgataccaagaacttgctgctccatgcatggacctaagcacaatgggcctccctgccgcgcgcatgcacctatggatcattacatgcatttaactaatgtaccagcatgcatgcatgcaaaattagttaaccatgcatcgctaatcatgcatgacagcatatcaccgtgccatccaattgtgcttctggcctcctctgtgtgctgctcctttgcgtgccgtcgccgcctccgctgaccggagccggcccgcgccgaatactgtcagcacctacacaacaaccacaccatgccgtgttcctgctgtccggatttcgtcaccaataaatccgctctgacctccgattgaccaccgtcaatctagttgcaagcggaagccgacaaatcgcatgtcgtctttccagtcgccgaatgacccgagcgttacgtctagccgtctccctgtcgaacacaactcatcgaaagacccgggccagccctcccggagtgttcgattccaccgaccgagaacgtcgattgcctccagcttcaatcaaccccgagcgtgtggccacatgtctccctgttgagagtagctcaccggaaagttcgagccacccgcccgaagtgtccgacccacagattggttcaccaatcgcttccgccgccatcaacccgagcaccacatctggtcgtctccttgttgaaagcaaccatcaaactgttcagactgccgtctgaagtatccgattccatcgatcaaattccgttgatcgccaccatgttccacctagcgtccatgtccgtttcttgacaccctgtgtagttgtcgcagcatggagcacctcactcgtacctctaccatggatctcccgcatgctttgataccacttgttataaaaccaaccccgaaattgacatcagtagctaaacgcagaagaaatgccataggagatccaaacacaatgacgacaccaagacacgatatttggcacggagttcagctgaggcctacatctccggggcactgattacgggcgctcctccctgattagcatatataacatatcagagttacaacgactcacggccagacgccgccggcagccgctccctctcgctatgttaagtcgccatgcggttataacaggcacacctctgtatttaagagagagatcctaggatagagtccgactcatactttagtcctaatacctattacaactccaagtcctaaattgtaaccgactttatacatataaccgacacaaactcttacagaaagtatagattgcgtggtgatagattcaggcatctctccaaatttactatggtaggtttatatctcatcctaagcttaggttgatttattttgaaaccgagagagagtagactatatatatatgcatggaaattaaaaagaaatgccatgtgtacttagaacaagtacattcaattttctccctcgttcgaccgccatgttttcaaacatggatctcacaacctaaatcggaatttctaacctgcataaagatgacgcaaattccagtaaccctcccgatcgaaataaaataaaatacagggtttgacaatatttatcacacctcgcttcaattgtagatatatatttgatgtttacgataagacttgttcaaatttttggagcttaattttaccattacttttatattagaaaaagttccgtattacccttagactttctttctctactccttggtctgctcttttttcttggtgtcagtagttgttatgcaattcttttttctcgatgatgtgatttttgttctgtcagatagtttttgtatgaaataacattggttaatttgagggaggaggatgaagatagatacactgtgtcactgctgaatatcattccaattctgactcgtcccaaaatttgcacttcatctctttttgcagctcttgtttattatcttgttatatttcgtggaattttgcatgctgttctcctctttcatttcttctttggtgatttccaaactaacaacttgaatcgatactaaactgacgcccagtcatgaggatccgtgcatgcagtgtctagggacactgctgaatgtcgttccaattctgactcctcccaaaatttgtttatttcagtatcttgttgatttatttcgtggaatcatgcatgttgtcctcctctttcctttcatctttgctgattaatctttcagtatccaaattaatcaggatttgctcagcagaaagaaaccaattagctcttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaggccagcgtgtcggcgagcgtgaacccggcggggtcgccggtctgcaggccggagtcgcgcgcctccagcttcagccccgccgtcgacttcctgttcgccgacggcgccagcccgaacctccccgcgaacagcatcagcgtcgtcgtcgtcaccatgatctgcatcgcccccccaaataaattgcccatcacattccattcacatcaagcctaatcacgtcgttgaattcagctaattaaccacactgataaattaattcagtgtgtgtgttcttacaacgttggtggctgagccgatgtagtcgcaccggatgccctgggacctcttcttgctcatcctcaacgatggcagcgtcacctgtgattaatcaagaaccagggacaattaggaatgtgtaattgtatgcatctctagttatacttttcgttacaaaggaaaataatttgatagcattggatcatagaaggaactgaccatggacctaggagaggagtaggtccggaggccatggaactgcggcacggatgtggcggcggagagctgggaagccatggctggagcctaccttctccttctccttgcagctgagtttggaggaaaaaaataatgtcaagtgccaccatggagatgcattgggctttaattcttggaggagatgtggaatgggagccacaaggggagcttgtggactgcagtggccactcatggataggttacagatccttgctgctgatgtggcatctcctggttagagcctgccaatgtggataagatgctcacctctgcatgcaatgttcttggatgcagctgcaaatgttgttggtggtgacttgatgcatgttctgtcaaaaaaattgacaggcatatatagtgagcaagagaatgggaaagaggaattatgtggagcagtaaaaaaaaatggaaatcttggtattttttcaaccgcagaaaaatgagtaaatgaacctggatttactgtccctgtaggctggaataagtgcaagagaatgggaaataggaattatgtggagcagtaagaaaaatggaaatcttggtatttttcaaccacagaaaaatgagtaaatgaacctggatttactgttcctgtaggctggaatgagttgcttgcatcgacactgaagtggatgtgccactttaccagttgctcctttgctggtgctatgccgagtcatgaactgaaataatcaagaacttgaagcccattgcttgcaattgcagaaatggattttgcaatgtgaaacaacgtggcgacgcatcttactgctgtaagcctacaccacgatgagattacctcacaacgcgcaaagaattaaaatagaatggacacttcaataaccatcactcgtacatatttccatttcgaattttgtatatgaaaccaacgatgacgagccaaaaaaaacagaaaatcttcccaatcaatcatatagcctaatatgagaattgcatacacaacttgtatattaatgcaacaccatatcaccaaccctccctttcctatgtacatttcatgagtatggaaaaccagggtcagaagagcaacccgctcttgatttgagaaaaagaaaaactttaacacactcaaccacacccatacacaaaagctgccacgctccaaatcctataaatattacacatcctccaaactaaacaacttgaatcgatactgaacaaccttttctaatcggtttcatactgtaagttatatcaggttggcaactcgatcttcatgcttctatcttgaggagtgagttgagagatgtgctgttgaacttttgagcaagacctctaatcaccagaatgatgacgtctcgcatgtgccgagtttgcaccatcaagtcaacttcgctctcaccatcaacaacaatcttgaagcggtgctgatcgttgcgatatagctcaacctgaaagattcaatgaacagttagctttagttataaatttgcgtaggacagggattatacattctaaaatgaacattttattttccaagttcatgcaagaatttacatggaagggtggaacatatgttcctcgcacttctgtagttgggaatgatgccttggatccaggctttacaactttgatcctcttcctattcacttctaaaattcttcgctccaaatgtcccatcacttgtgcctgttaaattgtttgtttttccaaaaaaagaaaagaaaagaatgtaacttgtagattgcaacgcttattatcctggtgaattgtgatttaaaaaatatattacatgtaggaggaaataccttttttggtgttctgtccttgtcacacaaaacctgttcaatgcaaattttatgcacttgttactaaacaaagtattaattgttgcaatgataacaataaaaaaaacattactgtgaaggtagcccatttctttagataataaagatagcccaagtagaaatgtaattatgcttgagacagttactattgactgaaataatcactctgctgcagaattgctcagcactcaaatttggaaacattagctgtgcaaataggaaacaagtatgctctccatagtttgacgaataagaggcccagctatccatgacagtgagacagtccagtagtctaatactaccaaaaaggaactaacatcagtattgaaatgaatattacctcaaacttgacagatccatcatcaagcttctgcttcacctccttgtaaatttcaggctctgcataagaaaaaaccaagcagttaatagaccaggctgacaaccttaagtaatgctctgaagattaaacttaatagtgaataaatataactatcgcagaaagtaaactgaggctagaagaaactgtttagctaaccgctgccggatcaccaaaaggataaaaaactgagatgatgataataataaatgttagtaggcgacaagataggtgaatggactataccaactgcaattggctccgttgaagcagagataggttgtccctcaactccatcctctctcacaggtgtataaatgataacaagtctataacctacatcatcaacattggcttcatatgttcttccaatttcgcctgcacaagaagttaattgcaatataagaatataagtaccaagaattgaagcaaaaataagtgggcatcatcttgtgcccattaggatttaaaagtggtaaatattatatcatttaaaaaaaatgtagaattcaaataatcataccaggtatagagataagatctgggcttccaaccatagacctgagccattggattttgctcttgccttctttgcctccagaataggtaccccgaacagcatacaggttagtgtggaaacctcttccttcaatctccagtttttcaattttaggttttcctgttaaaatcaaacatcacgcttcagtggtattgcaaattttaatgatttgcatgaggatggatatcagtacggtcatcaagcaaacttggcaatagagattaatccaactagccaagcctcttttagtagtatatacacaagaagttcaatgaagatgacagaagtacacacttatgcaccaattgaactaatacaacatgatgcatccaaaccccaactgcaaagagggagtcaagatgcagaagtgcaagcctatggactgatcctctacaggcctatccattttgaaataaataatgaatattttgctcaactaaaatatccatcagtttcacaaagttacaatacgcatgctgatttaatcaataagacataagcggtagacaaccaacctggtaagatcggagcagtcacaatggatatcaattcgctggatcgtccaaatacatcagagactgagcattcacatttcaggcatcggccaatatcttcgaaacgtactttgtatgagcgagagcactggttagccagtggctcaaaagtctgatccacttcagatccactggaagcaaacctgcatccagagatccacagcaagtgttatatgccatattgaacaatgtgacaaagtcatgactcacgacatacacctctttgcattaccattgatatgttatctctttcttgtagttactccatagatgttgttgaactgcagtgcttggaatttgttcaagaacagtcagtgtctctctctcaacctgatttcccttgaaagagagtgcttcgattttaagtcgttctggaaagaaaaggagaattaatacatgtagttgcatggaaaatgtgaacatagaacagtatgtaataggttcagatattaaaattaccagggagaattatatcagatggctcagagagcctttcttctccaatgatcccatcagaacgaacgggaatgtacctatcaagaattacaaaatatcatattccacaaatggaagcctgatcggttatgcagtaacacaatgtaaccaagtcattttaaatgtgagcaagaccagttcaaaatagaaaaattaaagtgccttacccaaacagtagacggcggctataatctgcatctgtcacttcatatataattaaatcagcaccatctatacaatgcctggttccatcactagattccctgtaccacttatacaagcttgacccctcatatccaccataatagactcctgttccgctatacaacaatgaacttttctgcttcaagtgaacatccgaaacagatggaaatgctgcaaggttggtaaaggactgaggatgtgcaggcagtagtagtaaacacacaacactggcaaggaaaagatcaatgggcaacctgccatgacagggtcactggtaacagccaccaacgggtcaccgatctctccatcatatcgtgcaggaacccagtgaagaatcaagtagaaaccaacatcatctaacgaaggtttgtacatcctgacagcattccattagatcaaagaggattagttcttaacctaaaccattcaaaagtaannnnnnnnnnnnnnnnnnnnnnnnnnnnnnnnnnnnnnntattcttgtgtttcaaaaatcatgtgggcttttgatcgttttgcctgtgactcaaattgcagaaaaacagcatgtacacaattaaaaaaaattgcagggtaaattttgtaaatcaactaaaaatatcgagttttaaaatttaaattttagccacggctgataagtactcccttcatcccaaaatattataatttgtagcccttaaggtttgtcctaaatataataaattattcacaatattctcttcccaccaaatcacaacctatttttcacctacctcctcttctcatacatttataacattttcctatttaattttacgtactttcttaataccatatccaactctaaaaatctttatattctggaataagcagcagaaagcaaaacaacgaggacattggtattcaaaaaagcatggcatttaattcctgcatttttctattcatttttttaataatggaatgagtcagcctttgctcaagagctacagccaactattacagaattcacacaaaagaaactcacacctaaagttcacaattgcaaaaacaaaacaaatggcaagcacaaactagtagacaccaacacaagataaagatcctataactatagaattttattagagaacctccatccaaagttggcaaaaagttacatgatcgtcgtctcaaatttacgacttacatcatttataaaaaaaaattacattttcctattcatgttcctgtgaatcatgcattacaaagaagctctcaaacatgtacattatctattacggagtgtttagattttaggcgaagtctcttctctaaa

SEQ ID NO: 4468 - DNA, 800 bp, Oryza sativa
cattccttctatagagggtcacatcaacatcggtaaagagacaattgtaacccatagaacataattgagaaacggataaaagattatagtttagagattttacaaagagaacgttggcaatggagagatcattagagattgcaatcttacccaatcccataacatttccctttccatcgtccccaaagactatgttatcttgtgaagtgccatttggatcaagtgttgaaaacattgattcttctccggtcatgtgattggtgcatccactatcaatcacccaacttcttccaccggagatatattcctacaagagatcaatttctagttttaggtacccatacttgcttgggtcctctcatgttagtgacaagtgccttaggcacccaaagtactctcttgatagaaatattcttgcccctcgggcctacatacttagcaacaacacgaccactaacattctttctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggccttactacccatatggcacttaagtaggccattgtgaaggagtcccataagcttctcattttgcttttgcaaggcactcaaagagatagagttagtagcataagcttcaatatcaatatctttgcatgtcacaca

SEQ ID NO: 4469 - DNA, 953 bp, Oryza sativa
  unsure (1)..(953): unsure at all n locations
ttatattatgggacggagagagtaatctctaacagaaaaaaaaagaactccaacctagtacatgtgttatcctcgatttgggatccagttgtaatgcacaggatctaccgttcccggtgttagggagaacggagaccgtttgatcaggatcgaaggaatcgcattagctcacattgttctcctcgcatagtcgcatgaacagtacttctctgcagtactgtagatgatccgtcatcctcatatgtggcatttggccttctcgatcgatccctcccatctactagtcgtctcgtgccgctccgcttattcatagacctgaaaatttggactgaccttgctatatatacatgtgtttggtggattgtatgaaaatatgaagcaaactatgatttactatagcttggattgtatacaaacattttgtaaacttgaacagattaatgttggtttgagcgtgttggctcctgacattaacaagccaactcatgtaggcaaacgagccgggtcgagctaggcttaacgagctagtttagtttttgttattctatcaatttgttatcctaagtcagaactgagtccagttggcttgatatccagccatatgtgtgcacagtagcaattgaaaaagctataagaaatccattgacatataccaccaagatcgaacgtgaacaatttaatgcatatgttaattaggctttacgtatcacgcgttgcattatcttgagtcaaacttacgtgagtttcgtcctaagtcggactattccaataatcaagttcacaaagaaaagtattagcatgtataactttaaataaataaattataaaattatattttataatggatattatgctcatttgatatataaatatttttctaaagattttggctaagctnnnnnnnnnnnnnnnnnnnnnnnnnnnnnnnnnnnnnnnnnnnnnnnnnnnnnnnn

SEQ ID NO: 4470 - DNA, 841 bp, Oryza sativa
accccgacctgaaagtcgcgctcgcttgcatggagcagcgcgcggaccacctcgctgctgcgtccaagcccgagggtggtgacgagaggcttggcaccaccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcgtggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcgacgtactactcgcatttctttgggtagccaaatagggcgtaatgttgaggcttatgtcgatgacttggttgtaaagacgcgcaaccaaga

SEQ ID NO: 4471 - DNA, 16107 bp, Oryza sativa
cgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatgaggaccgtcggtgtcatgtgcccgggcgccagatctgttcaccattgacaaccataagagacccaagattcagtcacgcggaagggaaacttgaacttagcggaatcaaatgccaaatttgaacttcccgtacagcttgatgtaagagaacaacagaaacacaaaacgtattcaaaaagttccctccaaaaaccctaatcccacacctagacctaattcgaattcgaaccccaccccccgccacgcacgaatccgacaccgcgacccccgaatcctccaattcgcgcccagaacctaacggcacgcgaaaccgaagaaaccccaagagaaaaacatccccgaaaattcgaaacggagacggggggtcgcgagaacctgaagaagccggatctgaagagggcgaaaccctaggccggggatccgcggcggacggcggcctcctcctcccgtgcggccgccggcgagccggatctgctccggagacgggcggatctgagggtcgcgaggtggccgccggctcgagacgcctccccgccttatcctcttttttttttctcttttttcttctcttttctttttcctcctctcgagtcgagccgtctcctgcttatccttttccttcgcgaagcgactcgacttgagccgagccgaggtggagggagccgagccgagccggggagagccgaagtggagatccgcgcgggggaagcgagagacccgaaactgggaagcgaagcgatgcgagactgtgacgcgcgaggggcggacgccctcgcgggcggtatttataggcgggggtgaggccgcgggtcggatccgggccgtcggcttcgcggggatcggacggaccaggggttagatctgggcgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtgcggagatcggccgtcttttatcgagcacgcgggatctgggtacggtttgggcgcgccggggagcgaggtgacttggaggagaaggcttggtgccacgtggaaggaggtgcgtggctgggttattggagggaaggatgtaacgggtacgggttaggtaccgaaagagaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtggccacctcgctgacaccgccgcgggtggcgcttctttctcccgctccgcatggtcggcctcgacctccgcgacagccacctcgcggacacggccatttgctcggcgactggacgtctcgcggcggcggtggcatcgccctcgcctctattttcccccaagcgtgcgtgcgtgtacaccacgtccacggcgcacgtctgcgtcaagaacgtcgcgccagccggggcacccacgtcaacagatgggttcgcttctccgccgcgtcgagagggttcagctgaagaaaaaaacatcctccccctgcacgttttcagtgacccagataactcctctgctcatattgagtttcttcatctgggttatgtctgcctgaacacagttgctaccactggtttgttggctttgccaacactcatcttaagttcattaatcaattgttgaattttacgtgtcgtacaccaccaccgtcgccggcctcccttgctccgcctcttcccagaccagctcatccagtgccaccgacccgacctcctccaaccgctcgaagtatgggccacggtggccgcccaagctccgttgggccgctctcgtcacagccgtcggagaacaccgcgacgtgcaccaacgacgaaccaaggcagggcttggtcgagccaacgacgaaccgcgtcacggcgacggtgcaccggacgccgccatgaccgcgaagacgagcagcaacggcggcggcgctggtgggaggggaggccgacatagcgtcgcctcgaggccgcgagcgctgacggctccctctcgcacgccgccgccactccgcctccgtcgccgaagagggagagagagagggagaaggaagaagggatagacctacatgccgcacgcaccgacggctccctcgagctctggctcctctcccacggcgccgccggcgcctacgccctcccgcccaccgctgccactccacctccgccgccaccgctggccctcgctcgccgaagaggagaggggtaagggacagagggagagggaggaggaagaaaggatagacccagtgggccccacatttttttcccgaatgacgaagaggtcccacatgtacgtttttagttctaatgctacataagcaccacgtcaacggcacaccaggtcaacactgccacatagacgccacgtcactaaaaccactctcagaaaccgctgagggagtcaagttgcactggttttaatagttgagggagtcaagatatctggttttgtggttcagggttatagattagattcgggtcactattaaggaagttaaagtggacttattccttttgtataggacgtaagtatggttgctaaggccctaaaaagcgactcttttgtggtcgtagcagcccagtatagtttaatttgagacctatgtgttctacttctaagagcaccaataagagatttgctaaattctatcccaaaattctgaatttggaatcctaaacggaatgatgtaggaagaaaattctctccaagagattaagtaaaattaattccctaaaaccaaaagtgggccccatgccaaactactaacacgagacagtttatttaccttcctcacgcgtgattgtgagttccggatcacggttgtgcgctcacggtaataagatcatgtgtctcgatgtatgtcgccgttgttcgctcgttcccaaccctcgctgcccaccatccgttccctccctaaccctagcatgtcattgtctcctccctcccaattctagttgttgctcatttctcacgactttagtgtacgtcgccatgacactacgagccacaatcgcctggtgtgggcgccaagaactgaggggatcatttttgtgtgggcatgggaacaagatgacactggtgggagttagagattgggaagtgtgcgcgtgaaaaatgatggagcaaaatctaggagagagaaaaaaacacaccctaagtgtcagggttacagataaggcatacttcatatcctacgacttatgtagtacacggatatggtatactttcacgtatacgaatcgttcctatatacgctgttggaatctgttataaattatgggaattatctccacgagacaggtgatttccaaagtcctactcggaagggatcgagtttctgttataccgtgcaagatccgatgtctccgagtcttacttgggataaaaatgacccacgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaatagaccaggggttatgacgctataccctccgttacaaaataagactttctaacaatcaaaatttatttatctgagagtatacctatttcttcacttactcatcttaaacaattgcaatgaatgctcatttcatttctccaactaatcacattcatctcattcatctcttgtttagtttcacgtataccaaccccgtgaaaggctttacgagtacttatactttgagagaaagaggatgctaatttccaagataaaaataataacaagatgataatgtcaatgtgtcggttagcttatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcgaaagggggccggcggctggcgatcgtggagcaacgtggaatgggagggcgcgcccgcggcgatggcgccggcgctgaagcccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaaatcccttccaacatccgattaaacatccgatatgacacccaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctcgcggccgcctcttcccccctcgaatcccgataagcagaggcggaattctccaccgcggcagcaacatgcaacccccagttcgattcggctgcgaggtgaggtcgtccgattcccaattcggtcggaatcacgcccaattttttgtctctactagggtttggtttcggtctgaggatttctagtttggtggagaatcgaggtccgatcccccaaccgggtcggaatcacgcccaatttttgtctctatagggtttggtttcggtccgaggatttctagtttggtggagaattacctctgggattttgcggattcgacgtcggttgctagggtttgtgaggggagcgattcatggctgcggggagccacggggggtacaggggctacgaggtggcgagggagcgggagcacgacgtgggggtctctaggaggagcaaggagcactaccaccaccgccacccgagccgccaccgcgactcggaacgccgccgtgacggcgggcgcagcggtggccgggagctgtcgaatgggtacagccaccgccgggattcgccgcgtccaccaccgaggaggcgtccatcggaagggaggacggaggacagggagcccggcgaggtctcaggtgggagtggctcagagaggtccggtgagcgcccaatgaagaccggggagccgagggagaatggtgtcacgcgagtcagcaaggaggaggcgaagatgtccccgagtaagaagaggaagcaatctccagtaatttgggacaggaatggttcaaagcggcaggctcgagaccctgtgaggggcattagagaggtagatgctgtagttgctgagattattatgcatcagtcgcattccttgcctgtcatgagctcactgtctagcataggcgatggacactcgccaatgattttggatgtgtcagttgataaggtacaggagtatgagaagaacaggattgtggatgaggaggaagagggatacccaacaatgagaaacattctgacctcaagatgggcagatgctggcgacgaggaggaaaatgtgtttgtgcccaagaaaaagaagagcgtgtcacctgtcgactcgattgaacgagggtccacaaaaaaggttacaagccctgagtctggagaggtgctggtgtataactcagtgagaagctcctcaaggtcatctgactcgggggtattacagggtagtgcaaaccgggaccttgaagtggagaagggtgacaacatagatgttgaggaggcggctgatgatgattatcctgctggtcatttgctggattctgattttgaaggtgaggactgtaggtctgaaacccctgagtgtacacggtccccacgtaggtgcattaacatgcttcaaggttgtaggagcgttgatgagtttgaaagactcaacacaatcaatgagggtacatatggagttgtatttagggtgagggataagagaactggtgagattgttgcgctgaagaaggtcaagatggagaaggaaagggaaggtttcccactgacttctcttagggaaatgaatatcttgttatccttccaccacccttcgattgtggaagtcaaggaagtagttgttggtagtaatgacagagatattttcatggtgatggagtacatggaacatgatcttaagggtgttatggagacaatgaaacaaccgtatagtcaaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcatttcttgtttctgctggtttatttatttggatcatgcagtttctgtatcatataaagtcttaccactcattcctccctcaggcacaatagattaagggacaagttccgagctgtatcattcactggtgggccgatgttgtcagaagctggatttgatctgctaaatagattactgacatatgaccctgagaaggtaatacacttaatagagtgatccatctgattcttgtatcttcattttgtagctgactgaacatggttttttcatacagcgtatatcagcagaagatgccttgaatcatgaatggtttcgcgaactacctctgcctagatcaaaggatttcatgccaacatttcctgctctaaatgagcaagacaggtacgagtgattttgctttttacttctaatttatcatcctaattctgaaattggcgttttatgtggtttgtaatgttgtatttgcaaaacatgcaggcgcttcaagaaacatatgaagagccctgatcctctggaagaacaacggatgaaagaacaagggaacaatggagatcgtggcctttttggctaatcttgaaccatcactataggtctgctgtggatgctaattttcagcgtggaatcaatggaagtacatgtcttccaaggtgagatatccactggaatgaagtatctgtcttcttggtgcctgcgacaactgatggcgttctttagcaggcatatgaagggggataacatgtctccttatggtccatgctagctattatatcattgcagggttactgggttagctctttctcagacttctggtcacaatctaattcacctgcattataaggtgtgcagatctaacccacctgcatgatctggcctattaacttctatctggtgcaccagttttgcttctgaaatttctgactgtaaagtaccttagtttggtactttgtaaacaatgatcaacaggacctttttttttctgtgcaatgagcacattttcttttgatcttcgcattttgtttgcaagagatggatggagcaaaagagggagggtgcattatgctttttgacgaggaaactggtacatagtaatgcaaaatgtaaggtaatatgctgaggcttattgtgtccactgatgtggtgtataaaaatgaaatgtatctttaatcttttttactgtactttgcaagatcacttcagttgctccctgaagctgcttgaaaactagctaatttatgtaactggtcattataaaaatgatcctccactttctggaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgtgggacatgattttagtacgagttaccagcctagatgtgtggatgaatcaggattttgggcaatccataatttcttgtatctccttgtgtccatgcctgcaagtacagctgtgtgttatcctgcagaacctttcgttcttttgttattctttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaacgaccattaaatactcagcacagttaaggcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaatttcctcgcatgaggctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtctttttttctgaacacgtacttgaattccaatcactatactttgtcatttcacaaacaaatatactagattgaaattgacgagaaacgcatccccagtttccctacggagaagtaccatccaaacaaccatgcgtatcgaggtctgaagatgcaaaacctgtggctttcagtttctactttcagtttccacagtccagtgctctctgctta

SEQ ID NO: 4472 - DNA, 2935 bp, Oryza sativa
  unsure (1)..(2935): unsure at all n locations
aattttgcaacggttaccccgcaacggctacttcaacggctaaaatttgaaaataaccgttggaggtcgaaaaaaattcaaaaatatatgaaaaaaaactcaaaaattaggaaattttttcctataaatagggtagccaacccaaacattctggctcatccaaacattcaatcttgtgctctcttgtggtattttgtgtgttgtaggttacgactttacggtcttccgaatttttggcaaaatttctctaaatattgccaaaaataaaaataactaggggaagacatatattcctatttgtaagctgcaaacaaagagttgaagaaggtaagaaattattattattattattattagtgttattatttacgtatatgttaattttgaaatttcagcatggacgatccgaattacccaatatttgacatgagcgagtacgacccaaatttcggcatggagcaaggtggcagcatccctgcaccgatgccggaagaacctgcaaccacacaggtggcttcagaaggatcaggaactgtggccgcgagtgggtcaacggcctcgtcctctaaaagatcgagaacttccaccgtatggcaaaattttgatgagatcaaggagaccggccctgatggtaaagaggtaacgttggctagatgtaaaatatgcagaactaaattatctggaaaatcttcaagtggaacaggacatttaagtcggcatgcggcgtcgtgtgctaagaagcaaggcatccaactgcgacaacaacaactgatattgaatcctgatggtacggtacgttcgtgggagtacgatcctcaggttgcacgagaatctcttactcgattaattgctagacaagatttacccctaaattttggtgagtcaactgcatttgaaaaatatattcaaactgctcataaccctaggtttaaatctgttagttctcaaaccacgacccgtgatttaagaaagttctataaacaaggtcgtgatacactgaaagaattatttaacacttgcacattttctgttagtatcacatctgatatttggagtggtaaggccaaggaagactacataagtgtagttgctcactttgttgatgataattgggaaattcagaaaagaatcattgctttaaaattaatagatgttgcacataccgctgataatatcgcggaaagaatttccatggttgttcaagagtttgaccttacaaataaaattttcgctataacactagataatgcagctgctaactctagggccatggaaattctacaacctgtattctctgtctatggtcaatcatttcttttacatcaacgttgtgcatgtcatatcattaatctgatagttaaaactggttttaagagggtatctacacatattgattctgtgcgtgaggcaatctcatggttatttgcctcaaacccacgggttgcaaaatggaaaagattttgcgatgcatcgggtatgaagccccgtaagttccgcacggatacagatcatcgatggaataccacgtacctaatgttgaggcatgtgttgccttataaggatttactaaccgtttttttgcagtctaataatgctacgaacagtgatgggcaactaataatgtccgagccaacttggtatgtagtagaaaagtttgctgcatttcttgagatatttcacgatgccactgttgctttatctggagtttattatccaactgctaatttaatgttgcacaaaatccttgaaattgctactttattacaagaaaatgagaatgaccacctactatctgctgcagtctttcatatgaaacaaaaatatcttaaatattggaaggaaatccctgtactgtatgcttttgcatttattcttgatcctaggggtaaattacggggattggttaatatgttgaatattattggagagataatgaacatagattatactaactattattctgatgttaagactaaattatatgagacatttgccaagtatgagaataagtttcagggacttcgcctacaaagacccccaactgtctctgtcgctggtaagaagaaaatacaatggggacggatttggggtggtagttcctcttccactcctgctgggagttccgcttcaggaacaactggtacttttcaaggcacccaagaattgtcctcctacttagacagtgactgtaccagcactgaagatctcaacgtccttggatggtggaatgatcacaagacccaatatcccgtgctctcaaaactagcacgggatgtgttcacggtgcccgtttctaccgtatcctctgaatcggccttcagtacatgcggaagaattattgaggaccgacgaagaaatctaagcagcgatatggtggaaatgctgctcatcgtcaaagactgggagctagctgctgaacgtgctcaacactccgcagagaacttggaattggttgctcagttcgaagatctctacatcgatacagatgcacaagattagctagttttttctaataattttcgacttataggctgtactcttttttctttgtcatggttttctcaaatatgagtttttacatgacaaagtttttaacgaggcagccatgtaatatcaaaattaataaatatcattattccatttttctcatattctttatatttatttagctttttcctattttttataatcatcttttttatatttatgtacctaatttcctattttttttctaaatgataatcatattttttattttcccttttttccttttttttaattttccccctattttcctttttttttaattttttccctattttcctccctgttttttcttctttttattttttcaaataaaatccctcttttcctccttttttccccttttnnnnnnnnnnnnnnnnnnnnnnnnnnnnnnnnnnnnnnnnnnnnn

SEQ ID NO: 4473 - DNA, 9240 bp, Oryza sativa
  unsure (1)..(9240): unsure at all n locations
ttcgttccgtgggccgtgccagcccggccggcccacctggctgtctatatccagaacagtcatcactattcactcctctcctttcccattctgtttctcttctgttggctcatcgttggtttcgcccatattcctcttcttgaaggggatcgctgatcagcaaggtactctctcttcgatccccttcccccccctctctctctctctctctctctctctctctccgcgcgcggcctgtcgcggctgttgggctctgcctcgcgtgccgctcgccgtgctccgtgattacttctgtgctcgtcaggcttccttcgccgtcgtcatcctcgcgctcgcgcgacagaatatctcatgatcgatccgtggtgacgttccgacacgcggtcggtgggtcgttcccccgtttccccccgtggggtgtgcgttggcacggcttttgcgcttggggacttttagcgtttgtgcccggccatcgtagcgatgcgggggaagttgtcggcgatctgctgatgcggctctgatcactgcatatctgatcagttacgtgtccgatccgttccatccctggttggcggtgaaattggcgtgcgtattcgcgtaactacatatctacatgtgctgtttgatcaatctcacgtttcggttatgtgcggtgatgaactgatgatgtagcttatctgaattctcatagcaatgggctttgttcgctatcaagcaagcgttaattctcagtacagtgctttgctttagatgttcagttagtataaagctattgcaggttctgaggtgctcctgacctgcttccacaatgcaagctaaagaatccaaaaagtcaaggttagatccatctcgagctctcaaatgccaaatttattgtttgatttaaaataaccatttcttcatttaagttagtatactgttgtgtgcagggacaggggccgggaccgtgtgaaatggaatgaagaaaatttgaatgacattgagtcgaccaagccagtaagagaaaaaatcaccgagcctaagacgccatatcactcaatgattgatgaagatgatggtatgtgctttggagcttgcatatagaatcatgttttaatacagctaaagaaaaaattccggacaacatgcatctgatgcttgcatctggtccaagggactgtttctccaaaaagaactattgaagaatcagtggataagtccactcatgctgatgcgattaagactgctttgatggaagctgtttcaagtggaaaattatcagcaagagaacatttggaatcctgtagtaatgaagaagaagaagaagaagaagaagaagaagaagaagaagaagaagaagaacaagaagaagaagaagaagaagaagaagaagaagaagaagaagaagaagaagaagaggtggccatcaaacaaggcacaggttagtaatctgcagtcttttcttattgacaatgaaaaacgaaatatccttgtgagtggtatcttgactcttaaagtcttaattggcattttgtattttgatgcttgtgcaagtcgttatgatttcggtgctgtactgccatatagcatatcatgtctgatacatctcacataaagaagataaacacaggaaggaataatttcaggtatcctggtctcaggctatggggttgattaagtaacctgatcctgtgatctgtaaatctgatttgaattgtcacattttagaccgatttgtcttcctagctccagaaaatatctactgatagaaagttcaagactcccttttgtctgattactcctttatccacttcacttgtttttttttttaattcaaccctgctgttctattggcatcatggtatgccagaccaaaacttttgcttgatagcaaggtaagagctaatgcagtgtacaccagtaggttagctctagtcctggtttagtagctagttggaccatcaaaatttgtataattgtaaatagatataaatctcccgtgtgtgttttcccgaatcagttggatattttttgtgggatgatgaccattggggaagactggttgcaagctgtgttgctattttcctatctctagttcagattccggaagtcctcaaggcactggtggatacgcttcaatttttactatctatgtgttttgcaagagtaacctcaaatttcaccatcttgttttgtgtttttttttcaaagtaagaatgactgcttttacatgctttcatatagatttcgaagagcaacggaaggctcactatgatgaattccgcaagatgaaggaactgcgtcggaggggaacgccgtcacaagagggtgatgaatgatgactctggcaccgtcgcacaactcggaagcatatgatcagcgaatcctcggcatgttaaatattggcagtggcaggaatgttttacagatatcctactaaaccttaaaaagctcatgtgactatctgttctcttgcttaattattagtactggtcctaggacagtaccaggtaaaattttggctcttattatggaggtaagaaaatctgtatcgatcttgtactcaaaacttatgctcttgttcatgctgttgattacaaagttcgcaaatgtgacactctctgtggtaatctggtgtgtaatttgtgcaaattctaagcaaatgcaaattgctgggaatattatctatttattttcggcgcactttgctgggcatcgttcagaaatgccaacgtcccactctgtgtgcgaggtagcaaaatttgcattcagcacccgcagtttctgcatattgtcataacccccctatctggacacggtcacacgaaaattggagttattagaggggtttatctgcaaaaggaacaggataaacctggccactcccgttactctcgtcgtcgacctcctcccgctgctcccgttgcggcggtcgccgtcgccgccgacgatgacgagcttggaggcggccgcacgcccgagcagccgccgcgtggcaccgtgcgacccgcggggacgccctcggcttccgccatggcggctcatcctttccccctccccttcctcccgcaggtaaagcctctgcttccttcttcacgcgcttttaagtggaattggccttgctagattgatagctgagtggaaatggaagctgtgtgtggagtttcctcttggctcttgtgattccagactcgatttgttcacctgcgccattcacatggagctgcagttcaaacccttaggttttagcatctgtgtaatttggagagtaggtgctccagttctacttatagacgaaagattcatattatagtcctggtctcagatggggatgccaatgactgaggtcctgttagaattgtgaatttcaatgtcagaaccaattttgcctcctttctttgggatcaaaactggcagtcattcttttcaaaaagaaaagaaagagaaagagaaagagaaatggcagtcatttaatttgtttgtataaatgcaaaagggtctcaattttagttcatttgctacttttgttttggttggactagaaaaccatcaagctaaaacataaactttcaaaagtaaagtaacattgagtatttaacattgtccaataattgttcactcttattcttatcatgatatcatcatcccatacattcttaacgctgctatctgttctacaggctttgcactctaatttctagacaacttcccatttgcaatgcacaatcatgtgaggttacttatttatcccttcttaagatcttctccatgtatgtaagcaactaagcatgcaagttatcgttacagtgcacatcaattctctgtgatgcagatacggataatctgtggttagccagtggtaatgctcaaagctccgctgctgttcggtcaaggttgcttgctgcagaaagagaggaagcaaaagctgtgctatcactatttttaagacagaaaggtttgagaagtatactggctgcacgaattgccaataaggcagatggtttcattgaacacctagtttcaaagctccacattacttacagatcacgatatgctgaaggtttgctttcttgattgtgctttttgcatatctattggtttgaacttttaacaacacgtttatttttcaggaagggagctcagcacaccggagattagagatgctttgattccatatctggaagccctttctaaagaacatggagatggtttggttgaggtggtggagaatttccccgatccatttgctatggaacgggaagccttgtcttcttcaatggttcttacgcccacaagctcaaataaacacaaggcaatcgctcgggtaagcgcaccaacctcagggggagcccttcctgagctagttctctatctactggaccttggcatggatcatgaagagatcaagaatgtcgtgcggaaattcccagcatttgcatattacaatgtggatcgcaaaataaaacctctggtggcgctgctacttgagcttggtgtgccaaggtcaaacataccaggaatcatcaagaagagacctcagctatgtggaatcagcctgtcagataatctgaaacctatgatgacctatttggaaaacgtgggtatcaacaaagataagtggagcaaggtgctttcccggttccctgcacttctcacatatagcaggcagaaggtggagacaaccgtgagctttctcactgaactaggagttcctaaggaaaacattggcaagattctgacgcgatgtcctcatatcatgagctacagtgtcaatgacaatctcaggccaactgctgaatacttccagtcaatcggtgcggatgctgcgtctcttattcagaaaagcccacaggcttttggtctgaacattgaggcaaagctaaaaccgatcacagaatttttcctggagagagacttcaccatggaggaaatcggcactatggcgaatagatttgggattattcacactctcagcatggaagataatctgcttcccaaatatgaatatttcctgacaatgggatacccaaggaacgagctagtgaaatttccacaatacttcgggtacagtttagaacagcggataaagcctcggtatgctcggatgattgattgcggagtgaggttgattttgaaccagctgttgtcagtttcagatagcagatttgaagatattctacggaagaggatggatggaatatgagatggtcataatttcggataaccatggtttaggacaatctcatttgtaacaagacttgatcgctgccctggtatatagtttatcagaacaagtagtgtcctggaaatttgtacttagccatgcttggcagctgaccaattgttattgacagtttgatgtataacttggcggtttatgatgctagtttagctatttttgcatggagtactggcaaatgcattttgtacagctgttgtggcatgctaatgcccctttgccatcctgaagataatgcacttgtatttgatatcaggaaaagttgcagcaccagcacgtataacatggattctcttgcacatcatagaagccggaaaacagacgaagtacatattctccagtatacaactaaaattttagaagctaatcagctataaagagtaattagagagtacactaaaagcatgcagtgcactagaactctggtttacattacgaatatgtaagtgcttcgccatcactcaccactcatcaaggttagtgataaaatggataaaacacagggaagccctgctttttctttaacaacagatgtttgccagggctgcgttcatgaatgcgctgcaaaacgggctcctccttgttttcctgcgcttcagcgtcagcatcgcatgggtgttcgttgtacttcagtgctgaagtttcagatcatgaagattccaacaatagccaacctaataaaaaggaagcacatcaagaaatgctgcaaaatgatgtgatgcaaggactgtataacgtaatttaccaaatgcaactaagacattacactgatgaggaaatacacaaagcagagaagtcaatttgacagaatcagtaaggtaaaacatcagaatttttgcttcaaaattagcaaaaatacacagttgaaaatgcaacttggaagaaatattccaatgccatcaacactaactccaacctccacagcccaactcaaggagtcaaaaagaaagaacgttgacactaaatatcagctatttttaagctttaagtgttttaagtttttgactatttatgccatgaagggcaagtttttcctcaatgcgtgaaagcttctcaattgaatatgtgaaaaatccgcagtagcatgttagccaatttaaatccaaacatgcttttcatatcaaataaaaatatgacagcagaccttttatcactcaattggttgatatatatgaataagttattatggttcacggctaacatttcagcatatgaaagatctgcttgcatggagtttgataccacgtcccgccatgttcaaaaagatttattttatcatatgcagcataaacaaatgaatgatatgcacaacaatcaactaaccagttgcagtagaacaagtttgagtgtttcaattgttgaagacttgaagcagcgatttcaacctactttcaatgtttgcacacatgagcacatatatagtgcaactatgagatgaaaaattataagaggccaactattgacaaagtgcagctcttagcagaattaaggcaataatgaaaatgacaaaataacggactacaaacaaaaaccactatgctaaagcctcttgggtacatgactaaattactcccagtaaagaacactacatcagttgaataactcatcggaaccatgaaaagtaagaacacaccatctctcctagcggcgcacattgagcatctccttggcctcttcctgctcaacctgcagggcgtcgctggtgtacttgctcagcagctccttcttcttccgctccaacaccatccgctcaatctccttctcatcgggtagcggcacatgcgcgataaactccttcccagcctcctcgcccttctctctctccctcttctcctcctccagcctcctctcctcctcaacctcctccttcacctcctcgaacagcacctncctagcagcctccccgccgcgcccacctgccgaggccacctcgccggtcactacccccttcatgggcttccgccgcacccgctccacacggtgccactcagggatgacctcattgcgcatgcgcttctcggcaacggcctcgagccgctctagcatgccgtcttcgtcgtcgtagaaaccgtagtaccctgcggtgatgcgcttgtggatctcatagcgggtccgccgcttacggacctcgggtggcttgtcgaagagctcacggacgccaggagctttctttgcggcgccgaagtagcggtacccggggcccggcccggaggggttgggtatggcgacgatgttgccgtcgaggtcggtcatgaggggcgcgttggagctgcgggagtggtcgcggccgccgagctcgacgatgcggcgctcccagtggccgcgctcgcggaggagcttgttgatctcgtcgttgaggtcgcggaggcggtgctccccaggcccctcgttcgggatctcggcgaccttggcgccgatctcgcgaaggatctcggagcgccaccgctcggcgtcggcgaggtcgcggcactcggaggcgaggtacggccgccgctcccgtggcttccgcttctcctcctgcttcatcgtgatgaagcggttcagcatggactgagccttctcctcgtttcgcgccatgccgcccggtcggaagacgccggtgcccggtgcccaaagacggcgacgccgccggcgaggttcttggggctgggagaccgagggtttggaaggcggcgggttcgatttggggatttccgggttgggtgggaaagagggaggctgctcccccgattcaatcgtgatgccttttcgggtcggtttggcgtctgatgatgatccaacggtgcggattgaatttgggattcaagtactcatttttgctattgaaattgagttgaacttgcgaagatttacgcccagaatttgaattcgtttttagtcaattcaggcatttgttcaatattgtacggaccatcgatggtggagatttgagaaggaaagtgatgtgttttgagtgcatatggaaaatgatctctttggcctttcaggatctttgatatggttagaatctgtttgttgtaaagcttaatattcgtgttggataaacttatgctgaaaattctatccaaatccagtgtgagatgttcataaatcacaagtacatatgctcaaatctatgcgatgcaatgaattgaggaaatcctagctggttaggtaacttattgaaattaagttataaacttaacacatgtaattgtgtatacggctttcaaggtgctaaagtaaggcgtgcatgtgcatttataccttgtttcacaaaaaaaagaacgcaatgatgtgtttcgaaaaaagacatatgtatttgccatgtttacattctaacttttttcttcaaacttctaacttttccgtcacatcaaatgtttggacacatgtatggagcatcaaatgtggacgagaaaaaaaacaattgcacagtccgactgtaaattgcgagacgaatcttttgagactaattgcgccatgatttgacaatgtggtgctacagtaaacatttgctaatgacggattaattaggctcaaaagattcgtttcgtttacagacgaaatctgtaatttattttgttattagtctacatttaatacttcgaatgtgtgttcgtatgcttaaaaaaattttggcacgtgaactaaacacaagtttgaatgcgtgtaaactttgaaacttgatagtgtctcgaaaatcactgggaggacttgtcaaaatcctatggcccttttggattccacggcccaaaccagcggacggcctgcttaaaactagccgccgacttccggcggacggcggcgccggaaacccccaccacatctcccggcgattctctccaaagtccaaaccccccatggctcggaagaggaagcgggggcggacgcggcgcgccacgcaggcggaggcggaagtggagcaatccgagcgagaaatggtaggggatgaagccgtgtaggaggaggaggaccacgacgtcacgaatatgaatcccccgccggcgacggccggtgagcgcgaagaggaggaggaggag

SEQ ID NO: 4474 - DNA, 26846 bp, Oryza sativa
cgacgggtgcgagctccattgccggcgcgctcacagagtgaacaaggagaagcatctcatgaccatgcctgcagatgcaggggcacagagcaatggcttcgagaacgctgcctcacccatcatccatgtccagccgaaggagcttgcattggcatccaccacgcagacgcctcttggatcaaatcggccagttgagatgatggcgaaggggcctagatcaggcacggttccctttcgtcagaacgctggagctggtctcttgggtgcatgccctgtggctacggtcacgtcctctacgccagatcagagcacaccggttagccattctggagcttcaatttccacaccccggactgctcagagattggctaaatcaggtttgatacagagttagtacctttagttatagttataaatactatgagctattgctagcccacaaatgcaatggaacataatcacacagttaagtgggtactaacaacataggcattttctttctcaaaataaggaataacatgtgtgttttacaacaataaatctcatggttaacaaactacagtagaaataaagatcaaagtgtggttttgtgaggtgttttaagtttctagagacaacttagaattggtgaccgaatgcatgtctattgtctaatatagcatcctggactcctggaggacaatttgggaactagagttaagttatggcgactgcttttaatgcatcctctggataatgatgagaaagaataacctgtaatggccacgcatttttgtaggaccttcttatcctcattttacttggggtatccattttttgtaggagcacaaggatgaagagaaatatgccttttctctctaaaacaaggatgaaaaaagaaatatcgaagatgactcctccaaattctgaagttgttttctttctatcaaatgagaggattacctgcaagataatctcctgctgatcgaattgtgcttcaactttgatgtaatctctgtttgtttataggcagagctcatatattgcaggtaacacctgtcccgcctttatagtggggactgcgagtagctaacatggaagaagattttggtttacatattcagttcttgatattatttctattttgtcatttcaccatgcatgtggtaaagtagtttcatagaaaattcgacgaaaagtggaaagtgatgaattcacatttccatattccttcattccttttgagttttgactgaccaagaaaagaagtggtggctctatgcatcgacaatgagtggtccttgtgactttcttgtggtctcacatatgcaaccaagcacagggggaaggcataactgagatagatttgacatgttgcaggaacatggcacatcaacatgaaaggttcagttacttttctttttggttcagacatgattccgtcctgttcaggcattataatcagagttgttttcagccaatggatcaatttgagttttgtttccctatgctgcacatcccattgccccgacaggtctctaagccctcttgttggccatgcagcgcagcttgtgaagcagggcattgtgatcgtgccatggacagcactttcacattggtataacaccaggatggtggttgtcgtgctggatgaggtgggacaaggaggatgtcagtagtgtaaccttgtgatctgatgtcctggttctcggtaatgtgtggcttgctgtggagtttatcacatcatgtcaaaagcagatgcgcttgagtgcttccttcagcgaatggctccagtttcttgggcataattctgttttcatataagcacctgatcccccgctgtgcctagagctgtcaactgaagacagatagaatgaaaagaaaacttgagtcaaggagactatggcattatattgtgtcactttggctctctgtatgaacttggaggcataatctgaccaagactgcactcacatgttgggacagatatggatttataactcgaatggccttctgcttctgcaaaaattagctttgctgctggtggtggaatctgaaagcatgcctggtggatggtgggaggattctgaattctgattcatagtgaggtcatcagcatagatcctattgaattggttttcattacatgtgaggtgatggaaaaagaactcctaggcctatagcacctacaagctgtggatcttacagttttcactgtagtttccttcttacacttctaatccacaattagatgttgctttgcatgaatctggtagagtcttaacaatcctggtagagtcttaacaatcacgagggattcttttacttgcattatactattatacattaaccttaggcttctgtatcaagaagctgagatggaccaattatggagaattatcacatgttaagtgaaggtcatttcttctggaacactgtagtcagtgtttgtacagatcacaaagtaattgagaattaagttgcattacagtccagcatttactacccatatatggtgtgcttggccttatgcaacattcaatcgaccctcctgtttgtagaggaggaatgtcattatccaacttatcatctaatgtatcgtctgccaccacaaccattctctctttggcagttgaagaacacggcagccaccggtggtcctaggttgtaaagtgccgagaaatcccttgtgttaaaattttgtcgccatccaggtgcataaatggtctgttggacagattgacggaaaagcacaaagacaaagcgatgtattcccgctgttggctttggactttcatagctgactatctcatttcctgaaatagtttgtcaggacttcttagaacagattggtgtaagtgaaaaacaaatcttactgccattgttacataagcatttgtgctggattaggagtagaatctcttttgttctttctggcttaagagtcacttcaaacctgttcagatcttattttttgacgcaacagatatattatatgttgcagagcgacagtcatattatgcaatttttaagccgccatcattcaaatatatttgtaatggatcaatgtggaaggtcattgtggcagtgtgcccatcctgttgttttgcgatgagtaatagttttaccttgtgcactttttcaacagcaatagttttcatcatattgtttgtaaaatcattttgtagattttattcttgatagagttcctatattatttttaatgccaaaacaagctagatgtgaatatcagcatggttgccaaagatagtttcatcttaaagaactctctagttcttttaaatgtgtactcagaaaaaggagatgtaaaagaatgggaagaccataccaaagctcgcatttgttgtttctggaatgtccgtcaccaacctgtgtaacattcgcacaactttaattttgcttttattttgagcataataagcaagtgatttcaattccattcattgcaaatgtctcaggtcttaccaatgaaggtattctcttttggttggattgcttggacttggtgagtcaggatccaccatcacctattggtaagtttgttctcactctttgttagaagcataaactggagttcttattttataaataaattaatcatgcgaaacttgtgcttaaacattagtattttgccacttgtattgcaaaatcttagtatgtagtaataccttcacataaccacttatatacataacatgtatttaacaaaaccacagtatataattctaactgggggaggttttcacccaatgacttagcagcatagtgttgaacaccataatatctacctctttggtcatgaaccaaaggaactcctgtttggtttctaggggacagatgggaaagcatatatacatgctcatttcctcagtgaaataaatgcccatttctgtggttttatgaaacaagtgacgagaacatagtgacatacttatgttaaccgtaatttcctcagttattattaaatcagagcaatagtggtgctgaattatttatgcatgattagtttttcttgtcttctattaaggcaaatatgctattccttgaaattgttgtcctgtgcaatttgattattaggatctgagctatttgattgttatgaatagcgcttgtattcattacagggctctaggcctgactatatagatgtacaggtgtaagcccaaattcaaggaaacccctcacataacgtgggaggggggggggtggaggggggggggatacaacacatactacatatcttgaataattgttcgatattttttacacaaaatgtagtgctgccaggtctactcaaatgtttgttatgtaacatgaaacatcttattgagtctagcaaagaatatggaatattcacattttatggctcagattgctgaaagcaattgtgattttttttactcatatataggcagatgtcctaaatgtctaggccaatgtgtataaattttaagtttaatctcttcatgcaaaggtgatgttatatgttctgacactagcaaatgcaaggtggtcatctttacgtcatatattcgaaataaaatatggaagcgcacaaggcctttctgtatcaagaaaaaacagcttctaaatctgtgcaaagtcaagattcttggttttgagtaatctatggatactgaaaacaactttgaaatggatgtactctaaattgttgtcctgcttgatgttttatagaatgccagtgatctgacttgggccctactattgtagcttaaggccatttgcttagatcaaagaaagaaaactttcttttaaattatattgaattttgaaatgaggtggacaggttgttatgaactcaccaaagtgtaaagtgtcctcatgtcacgaccagcaatctcaatccttggctcgttcgctacttgtgaaggcttgagctcagatccattagtcagttccctattgctgtaaagcactctgagtgatgctgatttgataaatgggtccaagatatccccaaccacattgcctacaacaagtggatcccttgacatagttagctacaattggtattttttcaggaaatgagtagtattgttctggggaggctgagaggctaacttggccttaactgtgaagttgggtgaagtgaagggttcaggtttgtgctctatatatacttgcaatcccaaatgctgaaccatttgtggacaaggaaactagtagctctggacgacatggtatcttactttaaactgtaaacaataatatgggttcccatcaaatgaaatatttcgggctgtccaccctcttggcctacaccattggtaagcagcgctcactgcaattccacgtaggtgaataaaatctgatggatcatactcacgtatcccctatacatagggtctaataaatagttgtccgtagtgaaaaggggattgccttttgacttgccacatggactgatgcatcatgttctttgttttcagctattaaattcccctcctttttcacagtgaagggtttgtagcaaacacaagcttcattcacctaaggctctttatctctgtttacaacttgctgtttatgcatgatagaaactaattatgtgttgatggtattgcagggatgatcattttttctaagtaagatgaattgctaaaggtattttaattggtataagcttggtgggatgggaatactattctgcaatgataaaaggtggcaatgggttttcgtgacaattgtatcaattgttggctgtcttctcttaagataataattttcatgtccctggatcgcacttgtatcaattggatgcttgagatgctagtttgtggtacaagtgtatggtctatatcattgtatgtcatcatccagaattcagaataatgtccagttcatctatcaaagattataatcagaactgtttgttttcacataatgatgatgattggggcatcgacatatatcagtctcctctccaattaactatgctgcaaatttgccactgataccggcttttccatatttctgtcatcttagggaaagccagaaagagaactgtgcctatgtttgtggtcaggtatgggtggacaccaaagccatccaagttttagtcctcttcggtgttgatttggatgcatttctccttaataaaaaaggtaccgacttgtcctattctctctctctcagagtcaggaggggattatattagagtttttcttatgccctaaacacttggaacatacttttaagatctattctgatctaccaacgtaagttgtggataaagtttcgattataatttagccttattctgtaattatgctctctctctctctctctctctcaaagaggtgtcattaaatataaagacatatactccgtcttcatttgcttttgcctccttgaattttctgactagcctatgttctatcagatattataatgttatcctagataaaacaaagcatctttgtagtgttccattcctttaataaaacaaagcatctttaattagtttcttattgatcaacaaccatatcttgctatgatcagctaatgcagtcgaagttaaaatcaccatatcatacttaaaagtttcacagtttcacttggagtaccggttctgttgtctaatgtgcatgtgttgccaatgcacccgcccaatcacaatttactcaactttaccttttctattataaattgatttgttcagatatgatgtttgaggcagtaacttcatgagttcttgtgaacacttgcagaaatttatttgttctttgacatatgtgccattccaattatgtgatcaaatatcattttcaaaagattcttgccaagttgctgccttttcttttaatacaaaaaactgccatggcaatttatatgtacttgagacaagagaggaggtaaaagcatgttagataaggtttacattgattttgactacttggggaccatagaatcttatttttgtatttatagttttatgtatactttattttttggatactgcatgctaccttaactagtgtattctgcatgttttctgctgtgcaagtttcggcacaataatcctgagactacttccacagtttgcagcaagttctgtatttgattagagaagtgccccacacgcttcaaatcaaaggtaactaacattatcgaacctaaatgttgaaacggtcatgccagcaagtaaagttgcaatgcatgatgatggattgatgatgaatactaaagctgatggaatctatggatgtcatttggttaggttatggctttacaatctttgatttttttgactgtggaataaagcagttccgtccttcacgtgggcatatcccattaatccagccactccaacagtgaatggaaacgtcccaaatgatggacaccatcacatgggtttccaaagacaacaaatggacgtttgacagagctcccagaatggaatttacatgaaggagacacaaaggcggaaagtttctttaggggtggaaaaaagaaaaattcctacaagggtgctgggcttattattgcaccggctacagcaaccacgaaaaggaaagctggcagaattttgacatatcactatctaccagtattagttaccacagaaagtgacacggcaaagctgtctactcccctgttgaagtgagaattctggcataccaggagcaaatactgttcaggtaatgctggtacatgctatatcttttggtggcacctacccatctttgtcactgtctgtagtgcaatgctagccactaactatctactatctgccttgatgaatggaggacgtaggctgccatgccatgaccgttgaaccgatcatatgattgcattccaggatctggaatccttccggaaacgactagctgtgtgtgtgcacttgaggtaagtcctatataccatctcttcttatgattggaagcattctgtctcttgctgccagagtagctgctagtagcaagtagatagcgtacgtgcggcattggtacatgtgttgcaagttgcactctgctctgctctctacctacctgcccatcaatggagccagtgtttttactcgagccgagtgccgcgcgccatggatggatatgaacatgatcacttgcccgtgctcacttcatccgatccagaattccagattccacagcgctcgcgtttgcatcaccatcttatcagtttcctgtagacccggagaaacgtcaatgacgtaaaggtaaggctgagaaggagagatcaaatgacaggtcggcattatgacactttgtgctcttctacatcaacgctcaaaaaggccattgcaatatatatatgtctgtgtttttggtttattgttacagttgtgacatgccacaattttttatttttggagcccaattataatatacttatgcttatgcctttttttcagaccttctattaggtaacgacttcgtgttgatcatggcttgacaaggtgtcacaatgttcagaaatgaacctgactatttcataaattggtcttattggctacatgccgaaagtgcctcctatttcccaaaagatgggctcatgatgatcgatagcgtcaactgcatggtaagctaatgtccaatctgtgttgcttttcttttgactggtactatttctggcgtcttactttttgttttttcttttggtttgcgtggttcgacttggatagttgggtttagtttctactctaccttaacttgcttgagacctgtttttgctgctgtccccaaattcctaacctagcagagaagctctataagactagagaaccagtcgatcgaagttttagagatcatggatacacatatgtaggctgcagacttatacttggcttgtttggcacaggttcaacgctcaattttttcggagctgatatttctagctcctaaaattcttaagagttgtagttaggatgaacgagcattattgagcgagatattctgtttggatgttggactagaattagcgtgtcgaaaaccactttattttattgtagaaactatattttctgaacctataagttagacctgtcaaacaccctacgtcaacaaatataagggattgctccatttatccacatatacaagggatgagttctacttttccttcaactgtctcatttaagcagttacaccaaaagatgttatttatcctaatcaagtactccctcaggacggagggagtaaagtttatgggacatcattgagtgaatagctaatttagtccctcaagtttcactgaaggctcaatttggtcttttaggtttcattttatccacataggtcctctaagtatttgttttggcttaaaattatccttgggcccacttaatatgccatatggttatttctagtcaacaattctgttagaaaatgtcccttccgctcttaatttgtatacaactatacactagaaaaaaaactaaaatgaataaacaacattgcatatgtacttcccattatttcaacatgtgcacatgaaacttgagcctaatggctatcgtatacacttgcaagtacttaatttattttgttttatataaattgctgtgcattatctataaaaagaattcattgcatgcaattttttctcttatatatgtgaatgaggggtataagtgttatttatcaagagagttgttggttatgttggtttaaggataagtttaaattaaaataaaaacttgaaggactaatatggataaattgaaatattaaagactaaattgattcttatatgaaacttgaaggaccgctttagccttaaactctactccctccattccataatataaggcatagcatgcatgcatgtaggcaattaactatgaccccttctctattaaattattacttttttaaatactttactctcatgttctctaattctattggatgcatgcattgtatttattaggatgatccaaactacaagatgataataattattttcttgatttttgggttaggggtgattatgccttatattttagaatggagggagtacaaaacagtctatcataaaatatattagtgacttaggattggatgggacacattcttataacttatagcgacttcttccgtcccatgaaatttgtcgttccaagttgtttagcatgtattaaggttagaagaaaaagactataatattccttaataaataatgtataatcgaatgtaggatggtggttaggggtagaatgggaagaaatttaaattgaaagtggttgatgtgacaagtactataaagcgacaattattttaggataattttttagtgctagaaagacaagtattgcgggacggaagaagtatatagaactggatgcgatacatcgttataacgtggtaccatgatatatctatttagatatattttgggactgaggaagtagaatggatgtgagccgccgctccaactcaatattcccttggacggagcaacgaaagatcgcagtccgaacgcgttgccgcttgcatccaaccattttccatagcaatcacttcgtaacgtcggtgtcacagccaaattccgcagttctcgctcccatgcatggttcggtgtactaactggaaacaaccgatgatctccgccaatcagcagcaacttggcaaaggagaaaagaaagcataaagcccctcgtcgcggacgtcatgtgccagtgacatcaccgccaccaacttgtgtgagcgctttgatgacactctcgctgcgagaccgctgcagagcgaagcaacagcccgtggtatttaatccgagcttctgccctattagcatccagattcattccagcagcatcgtgtcctggactcctggcccttgctgccttgcattcctgatacgatctaatcctagatcaaccatcacttttctctctgctactccctccattttatataggggtgaaaacagagctgattcggactgatagtagtcataccatatcctaaaccatattttttaagtggattcgaagcggttgcggatagtgtgcggatacggatacagagcggattggttcggatgtcagaaatggagtggagtcggtgcggaatcggttcggaaacggattaaatttatcggatgttacgtgtatatgcaatcaatacaacatcgagttagcaatgcaatgaataataatacaataattaataaatgacctatcgtaataattatatgcttaaggctaaacaagtaaacaacatgaatacattatgtccataatataaaaaacagctacgtaagtataatatgagacggtgaaagtctcatattaagaaatctaggttaattgatgaattagaccattggatggaccaacttatattatatgtaatagatagagtggttacatgtgttaataatttcgtattatccggcaaacgttctatcggataatccgatagaaaagtcagataatccgcatccatcggatttcagaaataccatatccgcatccgcatccatatccgccggatttctaaaaactcctaccatatcctcgttacggacggattcggagcggatcggatcggatattatccgatccgttttcacccgtaattttatattatggagaaatttaacaatattccatctattatgttgctttgaatcgatcgctagtcaaatttctttaggtttgataaaaaaatagtaatatctataataccaacttagttttattaaatataatataatattgaatatattttgataatatgtttattttgtgttgaaaatgttactatgcttttttttataaatttggttaaactcaataaggttttgatatgaaaagttaaagcgacgatttataatataaaacgaagggaatattacataattaacgtgctgctgtattcttaatctagatcgagcatgattctggaaacgtcactctcagtctgagatatggttcggcctgtaaggaaattaagagatgattatgcactgttaggcacctgtaatttggctctctctagctccaagttgcagaaagctgggcgttcctattcgtaatgcagcattagttttttttttaaggaatgatgcagcattagtgagcagtagtactagattctattctagttaagcctgcatgcagtgatgcaggtcaggtcagttgaactaaagaattcaaagcagccgccctaagctagcttgaagcccgacactcgaataatgcacatatcattgacgagagtgagaggagtgtggtgctatatgcctttctttctttttctgttcctcgctttcagatcgccgggcgtgcattgcatcgaccggtttgcaggtcctttcccaaggtcgcatatcgcatcgatctctcaaaggtgagagatcaaatataatccaagcgtcatactactagtcaaagaacgcgtgcacattcttaaaaaggaagagatcttaagtggtgatgaacaagttgggggcagccagtgaccattggcttcctcgaaacggctaagggcccctttgaatcgtagggtagaaaaaacggaagaacggaaaaaacacaggattctgacaggaattgaagtgtaaaacagaggattgcaaaacacaggaaaaacacaggaatggttatttaattggagcacaggaaaaacgcaggaatcggatgagagagatagaatcaaaggaaatttttcaagagattggagctcttgctaaatttcctccaaaatccacatgcaatgtgccattccatagaaatttcataggatttgaaaagtttcaatcctttgaatcaaacgatttatgtaggaatttcatagggcataaatcctttgattcacagggcctaaatgggcattggctatgatatggcgcatggaaggaacattggccaggatccgtgtgcgcgtggacggcccaatcgccaatcggccgatcactcaggtcgttcggctgcatatgtaatgcccccgtttgcagtgacggcgtaatagtcaccacgtagaaacataaaccagcttccgcggcagcggttttggagtgaagagactcgtggaggtgaagtcgtcctctttcaaggggtgaaattattggatgaaatgcttatgattccctagcttccaaagtgtgctaaaaaggctttttatgtagaagaatgttttaaattcattttcaactttatggtatttatttcatttgtatccctttctttttaaacgaatagcaatagacaacaaagttcatattgatatagtaggagaaaaaaaaacaaaactacatcgccaagaggatataatcaggagaaaacaaaagaaaaatagccaaaaagactcggtcagtgaggccaaacacaaccagctaaccacaagttgaaggagcatagcattgtgttagttatcgttatgtgagaccgattgtcgctaggcgcacaacggaaccacaccacccaacaccagcaacgctagacaatcgaacagagacgtgtgtttccgtttgtcatcccagctttgaattatacagggagagtacaagagagaagaaagatccgcttgtcccttgtataacccattgctagtatgacaacgaggtgctgctcacaaatgccctcatacaaagtcaaccttggccattagttgatcatcgaaaaacgtggactcccggacgccaccataaaagagggttgcagaggaaaagagcgagagggaaaaaagatccactcatccctcctacaaacctgttgccatgatgataatctgagggtgccaacgctaatgagagaaagttgttagagggcgatgcgcaaagacatagcctccaatgaggtcatgataccgagaaatgctatcaccgtcgcccacccaattaatttggacaaggttttcatctagagagtcccatagtggaggagaattaaggcaccgtgacaactagaggaggataatgagttagctcgtctcgtttgagcttgttgttttaatgagccagttcggcttactcgttaacgagctagaaggttgactcggctcgacttgcaagctggctcgttaagctcgttaatgagctatatctcatttaccattttatcatatattaacataataataacactaaatagtaaacaaagaactcactaaatatgaatagttttgatgtaattaaaatactaagcactagttaaaacactaattatataaagatacgatgatatcttatactaacgagctaaaagactagctcaattcgactcactaagactgtaagtttgagccgatccgagacgagctctttacgaaaccaatctaagccataagtttcgagttttttatccgctcctatcgacgacacctccaatggaaatcacaacgcccaaagcgtcgccgttgccgttccggcggacttttaggctcggctttcgctgggagaagacgcgtgggggtgatgattcgtgattacacgaggggatacgcccgtgccgggctgccttactgctacggcccacggcccaaacgctcgggccacgccatctgattagagatttgatcctataccttcctaaacatttgaggatttattcactttccttgtctcactgttatgctcgcgctgcctcacctcccgggagaagtgtgaaaaaaatctttaatatagtttaaatggtatatgttgtgagatcatataatgtcacttgtcaattttcagggctaatttagattgctgtcaaaataaacctttctaaaatttgacaatactaaaattttgataagttggcaacattgccaaatttcgatagaatcgattaaatatgttattgccaaaattctttaggtattatatatgtttggtaataaactaaatgtatccatatgtttatcaattttactttaaaaaataatatgatttaaaataacatcaatctgaacgggctttcaatttaaatggaaagtataggatcaaatttcacccagatggagagtaatctcaattgttgttgttaagcttaaccattaaggcaaggtatcaaattgttctctataagaaaaaaaaaagcaagccacggaattggtgatctggccgtctcactgccaagtgggccatcccacggatgcctttttttattactaattaacgccttcttttcctactaaacgctcccatccctcctcccgttccctcgatctctgcctcctccccccaccgccggagaaggtcgccgccggcgagcgagcgcgcccgccggagttgtagccgcctctctcccccccgcggcagcctgacgccttcacgcagcgtgatctccttccccccctaccgctggcggggatccgtgctctgtcggtcggtaagccctagcccccgcccctcctcgcagtcgcagctcgatccgttcccctccacctccggctagctccctgaacgagcgccgcgcccgggatttcgcggccgccgcggcgctgccgcttgccccgtgcctacgcgtggtggtggtggtcgtgtcggcaaaaaccctcgcgcagctctgtctcggccctcggggttctccctccgggtgtgaggtgtttgagcatggggaaccgtgggataaccgtggctaaaagcacttgaaatcatctagctcagcgttcacttccctgttaatgtagactttataggtgatgaggtgaatcaagtaaaatgtttgtagcatttcacccgttagagtgtattcctgttgaagagtaggagatccttgagattgttgatgtccaatcctttgtattttgtaacttgttcctgcgatacctattgccgagcaatatgttggtgttgggggtgtgttgggtaattggagcaatgcaagctggtctgccagatgtgcaactgtcttgttagactagcatggaaattagtttgtacttttgcacattagccagttaacacgaaacagatttaagtttggcatgctaggaaaatctgcgtcatagatagaggcttctataaccatggctagattttctgaaaatgtccgcatgcagtcggaagcttaaaatgttattgtgggaatccaacttttccctatttgttggacattattctactaatgctttgaatgaactggcaaatgttagagttaatctagcatccactcatgtgattttatcaggttgtactcactgaacatgcttcctgctggctcttactggccccaatgcgattacgcttgcaagctgataggttgccgcctgctcctattgccctgccccctgccccctgccccctgcttgcgttcatggataacagagtgtagactgagatgatactctgttttgtaccattccaaccagagcaatggcaaactggcaatgatagtcttagactcttagtcctagtcccctagacttctgaaacttttttataagaaatggaagaatgcccaagtacaactaacacttacactgggaatgtttgaagaatgatctagacatatgactaagttctttttctctacattgtctgacatccctttgggatttgcagagtgcagactgatcttctaatatttttcatagttctgctaaagttgaaatgtgacagactgacagtgccatggtgctaattttaatacttggacacattttcaagaaaaataatatgctggtatacctttttttaatatatgggtatctgaaactatgcaggttcagttggtggactggtgaactgaaacttattgcttggtgctagtgtgatggcgtacgagattagcgagatcaaaagtgaagttctattctcgaataagacttacatacagcaagcaatcgaaacacttcattggtctaatacttaggacaaatttttttgcaacatgtatctctaaacttttagatcaccccttaaactttggggtaaagtccatttcttaatcttacaaaatggacattttgcgcactaatcctgaggatagaattaataggtcactcaatatcccatgctggttttaaagttggtttttgccaccattcgaccatggatactggcaacaatttctttccaccagttttagaggtggtgttatgtgtgattataaaggaagatggacatatggtttgcagggatttggagtttattaatagtatagtaggtactttgtctacagcaattattttcacattgtaattgttcttattgaaattttaaagctaattgaaaagcatggcatacaagaaaagagagatagagaaagaacttggagaagggctttaagaatagagtatttcagtatagtatctacaatagtaattcaattccagtttcagaaagttgtcacatattcactcctgccgatctcacctattttacctctttcacaccttagttgagtactaataattttttaatttgtctatgtagaaattggcataggcctggtgggctttggcatcctattctcattctttggcgttatccttttctttgataggggcttgttggcgttgggtaatgtatgttacaacgaacaaccccttcgtctgttgtgtcagttaatatcaaataaaactttattgtggtgttacacttgctatctttcttcttttagattttcttcttgactggaatcggcttgttgcttggttggcaatctatgtggcagcttttcacaaagaaggcaaacattaaggtacttgagtcaaagactttgatagatacacgctactatccatttctttcttatctatgaatggataagatgtgacaccatgctacaattattgttttctacttttcttactaaaattagataataataactttgtagttggtcaagttttcaagttgatgcttgtcctaatatgcatggcaatgacataatagttctgcctacataattttgtagacaacaaacttgtttaggtgcatgtattctgcacgagtacaggcatgatcactagcctttaatctgttgcaagattgctatggaacaaagttgaactatagatatctggtaccggtctactggacatgcaaagtattgtagatcgcattctccaggatagcaatttttgtattgctgcaatacggcataattgattggtccaacttatttattgtttctgtgcatcacatggatttctctccacatacatgtccagaagaggtaatgagtttatttgggcagggatctgttcctttcttccttggtctgtttcttctctttgtccgatggcctgttgctggcataataatggagctatatggatcttttgttctcttcaggtcactgtctaccagccccaactttttgcccaatattcatttcttagtagtcctttttggcacttatttcgcttcccttccatttcttgtgcagtggttatggacctcctatccaggccttcctataccagattccagtcattggatggattctgcaatacccattccaggtaaagtttctcttcctatgagagaaggagggcgatcatgatcaaattgatgtttcatggttaatttttttttttatctttattctgccatgagtcctactctattgtcttcagattatggatatgccatatggatataactgatgttgcagtattcatctggtttctgcagctgtttggtcagttcaggcgtaaacgtgcatgacaactcacggcagaaattacccttcgtacgggagcatattttgtgatgttaatacggaaacctgctgtgtaccatctgccacgatgcagtttaattcttgtgtgcatattcatactttcgcctttctaatctggagtttatctggcttttgctcattttgctaactggcagtagtttagtgttcatatatagacgatgtagaggcttcaaatgattgttgctagaaatttgggatctgggtttagcaaaacatgtggatcttttagcctatttctaacaaattgtgagccagtaactattgcttgaaaggtcttacaccgatgattcttccaaagaaacttacgttgtactcccttcatcgtaaaataaataaacttagtatgggatgtgatagtccatatccgtagtacttaaaaaatgtcacatccaggtttatttattttgaaatgggtggagtataattgtactaggtgtctttattgggttaattcaatccatgccactacaatctctttgattttaaaaaatacaattactattcatgccattacattttgataaaaaaaatatatatgccactatatactccttcaatgtattcataagaaaaattggaccaaattacccactcttcttcctcctccctctctctcctctcttacctgggatccaaatgaagccatggtcacggagcttctcgcgctagctgtgttgtggcgtaagagcagtcccaaccctctatctagaatggtgtctatggcattaactacattgccatgtaagacttttagcttatgtggcaatatattaattaagagatagagagagtgaagagaggaagaaactgggtctcatgcaagacacagcttcaacacgagaacatatacactagacactatcaagttttgcattggaagataatagtgtcttcataatagatgaagaataaatatgattggtagagaataaatatgaatgtatttattaatggtccactttaagaaatcatgggttatatggtgtatttctattgtaatctcttattaacatggtaccatggacactgcttatggacactatgggttgggactgctctaatggatgagctgcatggtgtgctggcagttatgcttcggaaccttgccaccggcacaccattggaggtcgttagaccaacgggctcgatggggattggaccggtagaagagatgattgattagagagagagggagaaagaggaggaatggtaatatggtctaattttttctataaacgcattgaatgggtaagtagttgcatattttcattttctattaaattgtaatataatgtcttcaaatacacgaataagaatgatattttgtaaaaatcgaagaagttgtaatggcacgaatccctcgtttattttgcgatgaagacttagagtgcatgtcaggcatatttttcaatttactctttttttgacagcgactcattgagggttaaatgcatgtgattatgtccatactgcaatagataatgtgcatataattagtccctggacctaaccagcgatgatgcgctatgagctcatcgtggatctcattgataatgcatttgcgcctctcatcattgctgcctttgaatcttgcttctttttgttcttttggcagaatttgccgtcttggccagtgccgtcctttgatcgtctatatctatggagatttcgatttgatcgcggtcatctctatccaccgagtcactgtgaccccactagttttagacgttttgtcattagaatttgatgatggcgattggttgctgttagtagcgataaactagtaatttgtttgtttcttttgagtttagcatttgtttccaatgatcgttgcgttgaaactaaaccccaggccctagcagaatttctaccgttttgtttcttcaggtgcttgcctaactattgcctatataccaatcaccaagtttgcgtaggtgtatggccatgatttacctaaccaaactagttagccagatgtgtttttctaagctaagggaaataccatgtttttgctctcctatgtcataaaatatttttgattgttttgtttatttatttttatggcttatctgtcgtagcttaaatgatcagagctactccctccgtccaaaaagaatcaacctagaaaaggtcacccgtcaaaaagatatatcttaggttaggttgattatttttgaaacggaggtattacgcttgaattctgttggaaatttctctcaaatttgtgcctcccttccaaagtagcccttgattgcatcagcgcaaagttgatgaaatagaaaattcctcatcattgcgagagtacaagtatcatttcgtttgaactatacgcctccgtttctttttctcgatccgttcacggggagagccaaaacacttccaattttttcctgccagagccttgcattctcatacgggaccaacggacagcattttggtagagtgacaaatagtaaattcttccgatggcaagggaccaccactggcaacacctgttactgctctgctgtgctcactacggacataactgattgctctgagaataaaaactagattgtttttaataaactagattggtagtcaatttataaaaatctagaaaaactgaatcttttttaagaatcatgaaaagtgggtttactggtttcttgacttctagttggttttctgcattagaacctaggaaagcgggtttctggattctcacctaatagtttgttttgtacattatacaattatattagaatctgaataaaaagctagactcttatgaattaggacatgcgttggagaaactccctaaaccggctctagattttatttactcggcctttgcccattgctcggctacactggtcctctcttgtgccacaagacgtcaaagccaacaatcatcggcagtgctgaagggtcccgcccaattactccgctttccatatgatttctccgagtgggggatagccactgctagggctagatgcaaaacaggaggaaatttcttgaatagtaaaaagaattactcatgtgtatcataaaattctcgcacagctatagtttcccttattcgcggaataagcgaaacaacatatttgcaaacgaaaagtaatttgtaaataaaactatatgcatgttcttagcgatctaaaagcaactgaaaaataaacttcgatgaaaaaaaaacctcgaaatcagctccaaatttaagattgaaaaattcaaattttggttcataagtataagtataaacgaaaagataaggcctttgagaacgggagatgcaattgccatcacaatttccatgtttttccctaaaaaaacaatttccatgttaagggatcaaatgaccattagttgatacactgaattcagaccattgctgctatttgatcgtatggataagacttgtagttggatccttactaacaaatgtcttctaaacgtttactttctggagtatatattaattttctttcatatatgtcagttaagtcatactccctccctcctattttaagtgcagttgttggtttctttgttcgacgtttgatcgtctgtcttaaaatattgcctactggtgttcgaatgagtaggatgggatgtgcttatccccacatgcaaaacgaaatgtctcattagtatatgtttaattaaatattatatataattgttttaaaggaaaatgaactaatatgagtttctaaaacagtttatctataaagaaaatgaagaaaaaacattgtttaattgttcactaagcgtgtacgtgaaaatggagtgagtagaagtcgtcgaacaaagccttgaaaagttgttgtacccaaattttccaaattgttttttttaagataaagtataacaaactgatactccctatgtcctataatatagcaacgaatctggacaggtatctagataggatatttcatataacaacgaatctagacatatgtctagattcgttctactatgaaatatttcatctggtctcaggttgtcacttttctatccagatttatcgtagttatttactactacgtcgtcactatagaagttggtaaacgcatgtaatttacactttttactgccacaaaaaatcccacctgttccaaatcctactcgtgttgtccccatgggaacaaggcaacaagcctccctttgcagcgccagaaagattcctagtcctcctctcctcctcccctgagtcccctcccctccccagctcccctcccctcccgtcacatctccgcccaatgtggcatataaaatcccccagatccagccctccccacctccactcccttcctcattgcacacacgagaaacacagattcacacccacgagtgttcgttcgtgcccgatcttgcaggtggctctgtgttccgttcttgttttgttccggtttcttgcgctaatccatcatgttcgcaggtgggggtggggggttggtggtgatgcctgggcccagtggtttatcgatcccttccctgccttgtggcgctgatccaggagcggcgaatttctttgagagggtgttctttttttttcttccttttggtccttgttgcagccaacgacaacgcgggaatcgatcgataaacctctgcatccagttctcgcctttttgtgttcaagggcttgaggcagtagtactggctattgcttcttgcttcttggctgctcatggggtgtaaacatgtttactacttgtttaggcttgatatatatgtttatgtaggatatgtctctttttaatgacatgactatggtgatagaactgtaaaaatcttttattctgatggttgcatgatttgatatgtgcttctgataggttcttttattctgatggttgcatgatttccatgtttacatggtagctgtaggttttgcactacaaatttcccctggatatattgtctgagacttagcatcagccatactttgaccatgccattgctaatgtgtaaggataatgagatgatgcattgatgcttgatgtaatttgtgggctttggcctattttatgcttccaaagtattttgcaggtgattgtgtggttttgttttgtcttctaatagtgggaataagttccttgctctagagagattagttctcaattgcaatttgtatccattaatggaactacgcgaggtggattcttgttggatcttgcttgctgccgtcatgagtcatgactggaacaggttccagttcatgtggagtgaatcaaatgcagaatacgttctaatgccaatgggtcttcccttgtattcccaatattcttttgcctattgctatggtaaaaaaaaagttgtttgcaataataatctttaaaaaccttttaatttgtacttctattgaatattattgtaggtagtgaatccatctcttgtctctacaatataacccctccccccccccccccctccttgtcttctgtaattatatgaagattagccagcaaagttagatgtaaaataagatactttctagctaatgactgctagaatggagtaaatcggtaaatgctcataatgcattaggatttttaactttgaattttcttcatgaatacctttcaaatctaggaaagctcaggtgattgttgacattattcgatgcttcctacaggaatcaaaaaatgaaggtagccgtccttgattctgtcaattagatccctttattctaacagcgttgcctctaacctaaagaatgaactgagtgcacaatgtctctattgctgaggactcgttctgttcaccaaatcaaaccttttttttgtggttttgtagattttcagagactcagaccgatgcttgttcatcgccaggtgcccaggttttccgttcttcttggtgaagttaagtggatctgccgtttggtggctggtaatattgatctgaatctgatacatatcaattatatgctcggtgcttgttgattgccatcaataataccttgtgttcatctggaaaatatcatgtatagtgtatttaagaactctgtatcagagcagttcgaagattgaagatttcggcaggctactgtggcttgcccaaccttgctgtatcactgttttacaacttcctaataggagatgtgtttatgtaactctgattagataccgttttatttggagggattatataacttactactctctccattttaaaatggacgacgttattgacttaagacatgtcttttgatcatgtgttttatttaaaaatttagtgtaactttgcaaaaaaatgtaagtcatgcttaaagctttaaattacttctaatgataaaacaagtcaacaaaataaatgacacgtgcatttgttttgttttaataagacgaatcgtgttatgtcatgtataaaagttagcagcaccatacattttaaaaactaaaacgaagtttttttttgtttggaaagtaacattgtccgtttatattttaattatccgttctcagaggacgttttgttcgttcgtatgacaatcgtattacattgtcagatgttggcacgttgaaacattgctagctgaggtgactgccagttccatttttcttacaaacagaacaaaattgcctaattcctcgaaaaaaaaaaattctacttactggacggtacattaacgtgcccatggtacattaacgtgcgagggcccagaagcgacggtttggcccaatctggccccaagccatgtcttgtgtatccacgtgcactcgagttattatattcatgaaaatgaacaagaaatatcaacaaatcgagttatctgcatggaaatgaacaataatactcctatgtcaacaggtcagcctgctcctcagtaatcagcacatgcttatcctcattttggcacgatcgtcatgttcggtgatgtatttaggatttttatatggctgattcaacttatataatttttttaaataccctaaatataacaaagttagaagtataaattgatcatatgcgttttaaaaaagtttatttacacatatgtatatatatacattggattagaaatgttttgggtgattccgggaccatatcccctagatccacctatgaccatgtccgtgcgacaattcaccgtcgacaaaagaaatatcatattgagttgaatgcacgaggttaccaacgagcgcaagcatcacaagttcgagcaaactgtcaccttagatgtatataggttgcgtaggacccagaagcacaaaatctcgtgagcagatcgatcagcagcagagcagaatggctctcctctccttttggtcacgagaacggatgcgatcttggccatctcttttcccaaaaggaaaaattggcaagattttgctttgcgcctttgcctttatttttcgccgctcacgtctacatcggcgacgagctttccgggagcatattgatactactagcacagataaggaacctgacagctcaagcactagctgctgctgctgaaattatggcaattaaagagagcgtaaagcagcagcagaagttgttaatcacacttggcacttgcaaagaggggtaatcaagggagagtaagagagcgaagggtgtcatctgcatcccgtgacaatagatcagagaagccaggaggtcaggtgaaaatttgataggaaagcagtggccatcaaatattaatgtaggtggggctggattacaagacgatcagctcgaacacaaccaaccaaactgaactgaatgatgctccggttacaccaaccagtatgataagacaagagaaaattctctcaattcctacgaaaattgaaccaaacaaatcttactctcagtacatttctcctgcatttatttacagtaccatcaagttgtattgttttttgtataaaacttatatttaatttacaaaagggagtgaaagaaaagggtatccatatgctatgcttgcatttcggtttcgaagaaaatattcatacgttagaagtcaaaaaaatacggagaaatcttcatctctccctctgtcactgccggcctccggcgcggccgtctctacggccgccgtctcgccggcggcggcggcggtcgacgcagcgaacgcctcgtgcagcaccttctccacgtcgagcgcctcggcggcggcgcccgcgtcgtcgtcgtcgggcgtcgggatgaacggcggccgcgccacgtggaggacgcggtcccagtccacgccccggaagaaggcgtgccgcttcacgccgtgcgcgccgagccgcct

SEQ ID NO: 4475 - DNA, 3741 bp, Oryza sativa
ccacgatctacggcgccacgtagtcctccgtccccacgaacgagttcgacttcgccgccgccgacgagcagcgcgtggacgacgaggaggacgaggccgtcctggacgtggacggcggggaccgggacgacgaggacgacgacggcgacggccgtgacgccgcggcgcggcgcgaggagaagcacccgaagacggccgcggcggccttcgtgctgtcgcgccgcccgccgcgggagcgcgcggtttgtggcggcggagccgtgtcgggcggcggaggaggtggcggcggcgggagcgtggtggagaggtcgaagtcgacgagcatgatgtggccggagtcctggatgaggacgttctccggcttgaggtcgcggtacacgacgccgaggccgtggaggtgctcgagcgcgagcaccagctccgcggcgtagaaccgtatcgcggcgacggagaacaccctcccggcctggcggcgccgcagcgcgttcaggtcgccgccggcgcaccggtcgatggcgaacccgacgacgctgtccgtggccacgacgccgcggagggaggggagcagcgggtggcggagcgcgagcagcacgtcccgctcgaaccagatcctccggtgcccgtcgccgcccggaccgccggcgacctccgcgcacttgtgcctcgccgcggcgcgggagatggccttgagcgccatgggatcctcgtccgccgtcgccgacaccgccgcggcggcgccgccggcgggcacgacgtggaagacgacgcccctggcgccgcggccgagcacggagagggccttgaggtcggcgaggctcagctgcggcggcagcggcagcggcggcagcgaaggcggcatgctcaccatgggcgcgcgatcgcgagaagcgcgcgggaagaagaagcgacgcgaactatattaattatatttggagggtttgaggtttaggtgtgagctaattcgtctgggttggcttcgtttatagcctcaagctaatcaccgtaattaacttcaaatggaagcttatgaagaggcaaagctacaataatccgtgtattaatgcctgagcaatagaagaaaaaaaatcaagttagcaacagcaacatgcaacataactgtagcttccgtctagaaaattcctgaactaattcacgtgtggtgtgaaaggcaggttaatcagatttgatcatgtacagtgagctgtcatcaacaccgaacaggaaagccaacacaaaatagactggagtagtagtaaaccgacgaaataacttagaaaagttcacctaattctcgtgaaaaaggggggaaaaatacagagctctaggctcgccattgtagtggcatatcaatctgaatcccctgaaacgcaactcacgtgcaaagtcctagtactttctttctctgtagctcatcacattcacatcgctagattggattggaaccctatatactgttcatgacagattgcgtgtactaccaaaaaaaagatccagtaaaaacatagatatttcagtggtaagtttgagtgtccatggagcacaatcacaagttgatactctgatgtaatgctgcaccgtatctaagcgcatttcacagcctttgcattgcatcggttgcatccagtgcaatttgctgaattgaggtcaatacacaggaaatattctgctgtttacgtcagtaagtgaggtgtgactggtagcaagaatctgcagggctactgatactttagcaagttgtgataaaaccggtggatgaacagaataagaacctgattccagcatgaaagggagattccacacggtacttgctactcttctgatttctgaatggttaattggcgaccgatgctgattctcaaccttttccagttgaagccccagcagtaggcatgataagaatcagcacactgcaaatagatttagttcagacaaaaagaacacaggaaaaatttgcttcattgtcaccccggttgctctggaagtgtggattaccttgacagctgggagtgacaggaaatagctgttccccctgctgaatgatttcacatgatagaaatggtgaatttatcgtctctacctgtcaaaaaatactcaaaagactacacagttgatatcagtcaccatagtatttagcacactggcaaccacatatgctctgctgaaaactgaaatgagcagcacactaaatacacaataatagcagaaaccagagcagagtgtacaagtagacatttccgcagatgaacgatctgcagtcaaattgccataacactgaacgttgttgaacaagattacaagcatgagaacttatgaactggacagaaattcagaatttataactcgaacttcactcaaacaaggtaaaattaaaagcggataactggatatatacatctcaagttgttcacaactacatgctcccttttgtggctattagaccacctaactgtgtgcatcactgcatccttgatgacaatactccaattatctgaggcagaagcagtccaatcctcagaaacatgacagtattacagcaaccagatgtgtgcattctgtgaacgatgcaaacacaacagaaccgggtctacacatccctagaaaaacaacagtagaacacttggacatggctcattagctattagatcaagatcacacagttcccgtggccagtgatattaaaaatggaggccaactgattttactcaagattagctgcacacttgagtcactgaaacttatcttatttacagcacaacatgatctcctaattcttcctttgatgttaatattccatccttccaggccgaaacacaaagttccttgccttgcgggagcacagcaaagttgccaatgatacatagaagctagtcattgtgctgatacagaatgcacctagggatacccatccgttctctccatgccagccaccaagccaaccatggcgattgcttcctgccattttcccttctggcatcctagaatgcgcactgcatccttccccgctgcatatcccagggtttccagccaatgctcctggaaacttctgcaacccatcagttgtcggcaaaggcccagataggctattgtaggagagattaagcacctcaagctctgtcatggcagctatctcaggaggtaccacccctgacaactcattatgtgagaagtcaagggtccgtagcttccccatccccccaatacctgaaggaatctgcccatccaaataattacaagagagattcaaatactccagtcccttcattgcaaccaacccgtctggtatctccccacggagctcattcctagacagatctatcccggtagctgcttgaagatcatagcccagctccaattgccggcctgccatatccgtggacactgacacaaacagctgaggtggaagcacagcctctgatggactcccctgaccactgcctccaccattaaggacggcactgacattgaacccaccatccgggatgaaacccacaaacctattgccggacaaatcaatccactgaagtgttgggaacgagaacatccaatccggtagctgaccagagagctggttaccagccagtgataagaacctcaagctctgccatttggccacagctccactgagctcccctgtgatcttgtttcctgacaagttcaccacctccagagatcggcacccggccaacggcagcggaatttcaccagatattcggttgttcgacaaatctaacaccttcaaac

SEQ ID NO: 4476 - DNA, 608 bp, Oryza sativa
gagggcaaggaggaggagggaggcgaggtggtggaggggagaggcgttcggcatgggggggagttggctgggctgggctagggtttgggcggcgcggcgccggcgtggagcggaagcagcgcaggtggtgcaggagaggagcaccagcgggggcgtgtgggcggtggtggcttccgtggggtttatttttgggggaaaggtggcgacggcgaagaatttgggggtggggttttacgagccgggggaagcgcgcacacgtgacagcggcacggctggttcgcactcgggcgtgggatgcactgtagtctgtacgtgtaggggggcgccttccggcgaatgtcagatggcacgaaaaactttttaatggtacggactacggagggcatttcactggtacaatcgtgaatccgtcgggccatctataatatgagccactcctcgtggggaaactcagcttacaatggaggataactgtggatgggctactcaaaatctgaagcaactcaatagagacactccaacccatagtgggtatgcagccacaaaaacccatatatatttttactaccctacccctaatctctctctccagacccttcttttctttt

SEQ ID NO: 4477 - DNA, 4285 bp, Oryza sativa
  unsure (1)..(4285): unsure at all n locations
ccctctctccctctttcccgtcatcggttaggggcgccagatccggcgccgtagtgggcggatctgggccccccgcggctagatcggggaggatacgatggcgggcatggcgccggcggtgacgggcaaggcgccggcggaggaggccgagcaaggcgcgcagtggccggatctcgtcgctgtcgtccccaagcatgacgaccacaaccacgacgtcgtcctcgtgctgcttggccgtgagcacgggcgcctcaagcccgtcgacggcgccgagctcgacctccgcctcctccctcgctcctcagcccgtcgacggcaccgagcgcgacctccgccgcctactcccgttcctcgccaccgctcctgctgcagcctcctcccgctcctcgccgctactcctgccgggtggttgctgtggcggcgaagggcccgagagaggggaacgggcgagagagagaaagagagagagaggagaggggtggaaggggaatctgtcgctggagacatggtggccacaggagcccgtcgctgcaatgcgtcgctcgcctttgtcccctggccgaaaagtagcgagaggcgcgtcccctagccagggcgcgcacggactcacgaggggatgacgcggatggaaagattgacggatggtgctaggggcacgacctaggggcacccgttgtagatggcctcatactactggatacttcctccgttataggggtgggtagaaaaagaccgagatcgataaatgcggtcatcaatttggtcctaggcagggaaataccaaattttgttcagtcaattgttagtctcctcggttaaatgaatagaccgaattaacaaaaaaaatgtctaaatacaacctacaatccactatgttcaataggattaaactctaattttcacgttcctacttcttctaggcatgcaatctaacaagagtctttactcataagcgcttatgatttttttatttttgtgttgaaaatttccattatttctttgcatatatgaaaatgatattgaatttcggtcaggaccgagaccaagacaaaaagactgagaccgaatttgttggtcctgatatttttgcgttgaaatttggtcttcacttttcaaagaccgaaagaccgagaccgaaattttcggtcagaccgaatacccacccttactccgtggtgttggaattggatcgtgccattgcaaattattaatttgaacaaatattactacaattcgcgatatcagctagataccattgaattttttttgcaaaattgaaactgtatcgtcgttgtcagggttatggataccacatacttaatagtagtcgactaaatctcggcaggacccaccacatatcatatcttatacggaaacaaccttaggatataggaggagttccgcataaggaaggatgaatagagttctacatgaaaacgacaaggactactcggattgtatccatattggtctctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcgtcatcaacagacagccataatcccacgtcgcacctgtttccggcggaagtgggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaaaagaggacttttggacacaaggccttggccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccaccccctccacaccaaaatcctaagcagggggaggcgctcgagagggtcgaaaaatccgcagcatcgccagtcgtgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacagagggcgcggcgagcggcggctgttgcacgccattcggctgtcactccctcgtcagcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccactgagtttctccaggtctatgcgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcgtccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtctattccgacgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggaggacaggaggaaggaacgccgtgagggcaagtcgccggcaactccctccggtaaacggcgaagtgaggccaaacaaaannnnnnnnnnnnnnnnnnnnnnnnnnnnnnnnnnnnnnnnnnnn

SEQ ID NO: 4478 - DNA, 617 bp, Oryza sativa
gggcgctccccggcccacccgaaagggaaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggagtacaggaggaaggaacgccgtgagggcaagtcgccggcaactccctccggtaaacggcgaagtgaggccaaacaaaaggcccccgctgttgacatcgatgacggtgatgatgacctaggtttccaagaacctggggccaccattgccactgtcgatgggggagcgtgtgctcatgtctctcgcgggagcctcaaggccatgaagcgagagcttctggccgcggcccctactcatgagacaacgccccgggcccggtggtcggaggttgccctccctttcgaccagaccgaccacccaccgtgtgtcgcccggggagggcagattgtgatggtggtttccccccccatctgcaacgtgaagttggggcgtgtcctcatagatgggggagcggccctcaacatcatttcccccgaggcttttgatgccatcaaggccc

SEQ ID NO: 4479 - DNA, 906 bp, Oryza sativa
accatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttgtgtttaattaagtttataaaaaaatagcaacatttatgatacaaaattagtttcataatttgacgtatattttgatacaatgttggttttacattgaaaatttactacttctactccctctgttttaggttatgactttggtcaaaattaaactactctaattttgactaattttatagaaaaaatagtaatatttttaactcaagacagatatattatgtaaatttattcaattatagatttaacgaaattatactggtattgtaaatattatacttttttctataaagatagtcaaatttagagtagtttgattttgaccaaagtcaaaacattttctaatctgaaacggaagtagtataatttggtcacttaaaaaaattaactaagaaaaaagtcattacaaatgacttgtaatatgaaacggagagtatatatcctgatgtttcccgggcggcgcatgcaggaagctgataggagcaaggtactacgatgtcggcggcgaagcgaagcggcagtcagcacggagcagcgggagctcgccgcgggacgaggccgggcacgggacgcacacctcgtcgacggcgggcgggaacgcggtcaccggtgcgtcgtactacggcctcgcggcggggacgggccaagggcgggtcggcgtcgtcgagggtggccatgtaccgcgtctgctcccgggaggggtgcgccggg

SEQ ID NO: 4480 - DNA, 664 bp, Oryza sativa
ttttttacagaagaagtatgcacttactttatatctaaaatttgtagtactatagtatgtaatatccaatattaattttatttatttcgatacggaggaaatattattcagttctgttttttcaatcggtgaacccaatagacccttaacataccgcacttgactttgacgtgcattacgacctaatttgattttgaattttcgaatatgattttttataagtaattttaggtagattaacaagcaacgaaaatgaacgaaaattactaagtaaaccactgaaatcaatctgaaataaaattttaaaacttatatgaagatttgcctagcaacaccttagtttgatgctgatggcattaaacgggtatgcagatgcccatgctccagagtccagagggctattagtgcgtttaatttccatacctctctgttcgtgcgaatatgatagttgtggtgtagatatttttaaataatgaaataggcgtcatgtgtagtgtagagatatggcatatgtgaaaaatgtgtcaagccgtgctcttggaagtataatcctaatcaataaaaacagaaacttgcacgactgtacgatctccagttctcctttgggagtaactagttggtttgagttttgttttttaatgggtttgatttgattcattgattg

SEQ ID NO: 4481 - DNA, 670 bp, Oryza sativa
aacctcagctgaaaaagaataatagaaatgggaacaaatcagacattccgagtttccgaccaaagttgaacaaacactgtaattgtacggcttgctctgcatttgtgaggggaaaaaaactgtacagcgtgtattgcaaccgatgcagaacacagtaatcactagaataaacacaattcaaaggcaaaccactgaactgaattggtgttcagactgatgcgactctatccaaatttccaaatccgtgacaagcgcacacggaggcaaccaatgacgatttcaaatttccaatacaaagtacaggagtatgacaactatctaagacaaattcatctccagcattcagaccaaagcaaagccaagaacatgaacaatggtgtgttcacatacgaagaggaactttagaaatgctcaccttcttgctgtggccacacttcttcttgcggcagtggtgagacctgatgggaaggcgtgcatagcacctgcatcaggagatggaacagggttgaaatcaaatcagttcatgttagccgcggatgcaaagctagtatcatctggaatcaaagtgcgggcgggcgggggcgtgcttgagttcgtacttgcggcagaacttctttttctctctgtacttgagcgcaagaaccccggaggtgggctcctggatggtgta

SEQ ID NO: 4482 - DNA, 492 bp, Oryza sativa
tgatgttgatcaacgatggcgggtccgccgcgcagaggggagcgcaccaccaagcagcttatgctgctgctgcacagatcgatcgatggaccacaccaccactaccacttcagcagttcagctcgctgcgccacaccacatggatgggcgtcttggctttggctgtgtgcgtgtgggcgaggctgcctagcgtagagacggacggcgagcatttccagcgcgtggtggtgcgcgccccggccccgtgctctcacgtgcgggtcgcgcgggcgccgagcggccggggttggtcgtacgctggcgggaccgaatcccacaacatcggcccggctcttgctccgatgcctcgtcgtcgtcttgtccgcggcttccattccgtttcagggggcattcaccgctgcgcccatctcgatgcctgctgctgctgctagattgtatgtcaataaattgaaaaaatagagttttaatacacgacgcactcagctaaaccgg

SEQ ID NO: 4483 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnnnnnnnncaactgtgtacaaacattcacaccaaataaaaataaatgagatcacatgaatcaaaatccaagaaaaagagcgtacgtggattgaaccacatacacttttgaatcagaatagtgcatcaacctgcctactcaaaataactccaggtacaggttttattttatattttttttaatcgaacaaaacaatcaggcagacaatgtacatcgcgagagcgggctggttacgatcgctttgctttgatcacaaagcgaggccttccttccgaaatgagattctgctacacctgtgcaccgcgccgcttttcacaggcccatcgaccgttttcacgggcttttcggcgtcaattatcgcggtggtattttgtttggagtcgattgccttttgttcctttctgctctccagaacagattcaagcccctaaaatgtgcacaacacagatatggattggcataaagaaaccgaaattacctgaatggaggacaaacatctgcatattaattgtgtattaccttcactgcctttctttcagactgagccaactctgtgagcttgagtttttcattagcttcctgtggaatggagagcatagaaggatcattacagcacaatgagcagtatgagccaaaagaaaagcgaactatccaagataaggcatccttagaccttgcatgcaatcctgaac

SEQ ID NO: 4484 - DNA, 521 bp, Oryza sativa
gacaaaattataaatagtagacatgtaaaaaaaaatattgctgcaaaactgttgtgcttcaggctgccttggccagctccctgtccacagccaccttgaggaagctgccttcctccaccaccatctgaacaggcaggaacccgagcccattggcgacggcgagcatcacctccttcatctcggcccggaactcctccaagtccaccgtgccattgccgtcgtggtcgaaccgcgcatacaagccacggtacatctccacgagttcatcggagctcatggcggcctcatcaacaccgaaatgcttctcaaggaccctgaggctcatgagctcctttgccatctccgagtaggagaggaggccgtcacggttggtgtcgagggcggcgaaccggccatcgacggaggagttgaaggcgccctcgtcctcgacgaagcttctgatggtcttgccgtcaaggatttctacactcatgttgccggctctacaaaatgtggcggtctcagagatgtttttggtgtgt

SEQ ID NO: 4485 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnntcccagaccatactgtgccaggaagcccaggggtcctccccgacaccaccccggcgaatccacatgtctctcggcatcaaggctcccccgattagcaatttactcagccaggggcgtcccattccacccgtgtgatcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcaaccgtcgatactcgcacagagtgcacgaatatcgaggcgcaactagatggttacaagggaacatgatataacaattaacaatggaaggatcagatgcaacaagttgggtagacccaccggtctgcctttcagacggggcaaacaaattaagtgtaatcctatcaatgcataatattttgcaagcaatataattaagttcaaatataggctcaatatgttcaagggtggcttgccttgctcaaggtcttcacgaagcttcatgaatcttcaagatatccacgatcgacgaaaatccggtaaccgaactatgcccaaacagacaaaaacctaaccagaaaaccagaaaaagacc

SEQ ID NO: 4486 - DNA, 535 bp, Oryza sativa
tctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcatcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgt

SEQ ID NO: 4487 - DNA, 481 bp, Oryza sativa
actatagggcgaattcgagctcggtaccccctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaagtgacaagcatgacttgccttgctctgctgctggagaaacctcagcgactatttcgaagtacaccggagcgtcggaggaatcggaatctagcgacatacaaagcaaacattgcaaacaggctataagactactgaaacagggaacaaaaccatttttaatggattctacacatttttcttgatttattgagacttgaatgggcttaaacggagctcggatgaattagttatgaattttagaagattcactatgtttattactatacaagaaaaaccttaaatcatt

SEQ ID NO: 4488 - DNA, 513 bp, Oryza sativa
  unsure (1)..(513): unsure at all n locations
nnnnnnnnnnnnnnnnnnnnnnnnnnnnnnnnnnnnnnnnnnnnnnnnnnnnnnnnnnnnnnnnnnnnnnnnnnnttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgtaattagtgtatgtttaatactccaaattagtgtccaaatatccgatgtgacatggacttggaacaagtcgctggaaatnnnnnnnnnnnnnnnnnnnnnnnnnnnnnnnnnnnnnn

SEQ ID NO: 4489 - DNA, 497 bp, Oryza sativa
cttgccacgggcgtcgtcaatgtcggacagcagctgcgcgaacgcggcgcgcgacgagccgccgtctttccaggccatggccgtggcttccctgtgcgcctcgacgcggtctctcagcttccttccttgctcggactccatgaccagcctcaccttcgccttcaccttgccggcggtgacacgccctttcagccatacctccatctgcacgccgacgcccatctgctccacccatgagcaccttgttcatcctctgttccgcgtacagcggccagcagagcatcggcacgcccgcggtgatcccttccagtaccgagttccacccgcagtgtgtcacgaacaccgcggcggaggatgctcggcttgggctcccagctgttgacgacgaggccgtggccgtaggtgcggagcccaatagacgaaggggttctcaggcacctgggtccaattttagccttagtacttaccccccctattttcatcacatggggaaaccc

SEQ ID NO: 4490 - DNA, 1031 bp, Oryza sativa
cataactacagcacaaaagaacagagacaagctgaaaagcagtaaatctcaaaattcatttcatgttaatggaaaacagtaagatgtatacaactaaatctcaaaattcatttcatattaatggaaaacagtaagatgtatacaacagcaaatatgcattgttacaactaatactattgcttcattaagtgattactaccgaggaaacccagatcactagttcagaattacagtttagcggcattgttaatttttagtcaatataaccaagagagcaagataccactattccaaaaactgctgtacacccctaatctatacagttcatttattgtagcatacaaggaagtcacaactacagcacaaaagaacagaaagacaagctgaaagcagtaaatctcaaaattcatttcatgttaacggaaaacagtaagatgtatactacaccaaatatatattgttacaactaatactattgtttaattaagtgattactaccaaagaaacccatatcactagttcagaattacggtttatcagcaatgttgattttcagtaaatgtaaccaagagaacaagataccactattccaaaaactgctgtacacccctaatctatacagttcatttattgtactacaaaatgagcaccatgtcatcaagacaacctcttattaaagtagcaagaatatttcttcagaacatgctaacagtcaagaaagatcatgtacactggtagcatgccaactcaaccatacaggcccgaactcatccaattgtcatatgtacagaacatctaaagttctgacaaaaaaaacatcacatggacagcaacatatatcacacaagtaataggaattcacaagagaaatgtgctgaatcttatacctgatcatccttgaggtagagggtgatcttagtaccccgtccaagctgctcaccagaggtatcacgtgtaacagtgaaggacccaccggcctgtgactcccacacatactgctcgtcgtcgttgtgcttggtggtcacaacaac

SEQ ID NO: 4491 - DNA, 8124 bp, Oryza sativa
  unsure (1)..(8124): unsure at all n locations
nnnnnnnnnnnnnnnnnnnnnnnnnnnnnnnnnnnnnnnnnnnnnnnnnnnnnnntccatttcgatgagtaaaacaaacaaataaactagcacaaactctacaaatcacgagtcaacgctcacacctcattgatttgaaacaggtctacgccctatcagtatatgatcctcagatgccgtcacgctcacagatcgacgcgtacaacaacagcaaagagcacataagcaagcaccgatttcgattcctcgacgagaggggattaatttcgggggcggcgcaaacttacatcggaggagttggagatgagctcgcggaggaagatctccttgttggagtagaaggtgttgatgatgagggacagcagctggttgatctcggcctggaaggcgaacgtctcggtctccgacgccatggcttcctcctcctgtgctcctgagatctcgggggcgtggagaggacgagaagaaacgagaggcggctagggtttggaggggtttccaagaggacgcgagatggaagaggagggagagtatttaagggatcctgtggttctagaagcatctacacgaacctagaagccggcgaggccgtagtggcccttgactaagttgctgctgggccttttctcggggaagtcacgggccttcaataatctgtgatccgctaggaataagtccacttgctgtccctcagctttacgtcgattttcagttggcattcctaaactgcagtacaataaatgatttttgcaaaaccattcaaaccagatcataaggcagcaggaggcatcgtagtcagaaaaaaaatgattctaaggttttcataggttatgtatgataccattgaccttttgagatacatttgaccattcgtcttattaaagaaaatgtaattattacttattttattgtgagttgatttatcattgaatattctttaaggatgacttaaatatttttatattttcttaaaaatattgaataagacgaatgatcaacgttgattaaaaatcaacaacgtcaagggagtagtatatgccctctgcatctctaattctagtacttgatttggcgaaatattcctacttcctttgatctcctctctcctctactttgcaggttctacatcatgaggttggaggagtgaccgctcaagttctggacgatcacccaccacgcaacgtgccccggtgcctttggctcgatggggttgtttagattgtagccaaaataaaccttatcaatttttggtaatttggcaatattgtcaaattttttgtaggttttcttgtgtatttaccaaagtttgacaagaaactaaatggatgcacatatctaacaactctatcaaaaaaaaattgtatggtttgaaatgacatcaatctgaacaaaccccatgcctctatcggcgacgaagattggtacctcggcgtggcaagccctcgaccatgaaggatggggcacacgagcagggcggtgatgggaggcctccaccgccatggcgcactcacaaagcatgtcatgcctgcccaagatggcaagatcgacaccgtggcgacgctgaacgacctaagcatgctggacatgcaggtgatggcggaggagaagagcgggcactggtggttcgtgggaggtggtccactggtacctcatgcagatgggctcgtcggctgccagccctctctccgccggcaagctgcgagggaagagaggggagaggaagagagatggggaagagagggaagaggtgaggagtcaacttacatgtgaggccacatcagccaaaacagacatctatattatcttagaacttgacttgaacggtcttgcaaagataaaagagtgaagagtatagtattgcaatttagggatgccaaataaactcgatgtaaagatgaggaacaacaaacgaacttattccaatccgctatggaagctgatggaaattggaaatttgggaatattcggtgctaggccatataaaagaaacatttgtacttcttatagatttcttaatattaaaaacaatcaaatcaaatatgaaaacatataaaatcatcaaattaaggcaaaaagaaaaaaggatgtgtaacacattttatagaaaaaaatatttttaatttattttagactatattgtaaaatattttgacgtgacaggaactcttggttaagatatattagggggaaaaaaacataagtggggttattgtgaccggaagccaagtgcacgtttggaatagaaatttttgcaggaattaattagggtaaaattccccagaaaatcaaccaaaacatgccttgaagctacatcctagtattctcataggctgattctacataactagacgaaaagcaatactgtcaagtttcatcactgaactccatgaagatgcatggcaacagatcaaaaataggattagagcaaaagtgccttcatcaaacttcatcgttaaagaaagcagataacctagcgaatcttacattcccacctatgatcctctttacttacatacatgtcgaactatcctagtgtgtgacgtatacatggctgatggctcaaacatttgctcttgattggaatgcgcagctcttgaaaaattttcgtgcgtcatgtttgcattcaataatcatgagttcatgatcctccaaatctgcaggacctctacatatcctcattcctcaatgattcatctgcttgttttaccagaacatatagttatttaccaggaataaatgctgaacggaaaaggatggagaaaaaagtaagccaatactgctttgcctctgatgagggaaagcatctttgatattgcttgactataaagttaagagaaagatggaatgcaggtttggtcttactgataatatcctcatcgccgtcactgttatcgtcctcgttttgagaggtaaaaatgggagtaaggtaatgcttgtccagtaaagcgaaagaagaggtgctgtaatggcaggaaaatatatttaagcgattaggagatcacctgctcctcagcaatactacataataaattatagaaaagtaccactctgcaactaaaggctactactggttggtactttaacacaatgaaattttttaatgaaaagttcatcattttagaaatcaaactaaagaagagcaatgagtagatacaacttcaatatcaaatgtgaactgctgtaccttctctggagctctttgagtttcattgtgaaattgcttgatgttgatgtttcttccccgtaacgttgcccagggtagccagcattgttcccatcaaagttatgctgcatattgtaagtacagcatcaataactggcaaaccaccggaatgctatggtgttaatccatgagctgtaagaaagataaacaaggacggatagtagctacatagttagggtgcatatggcattcagcaacaccaacggtccgttagtaagtgctcttattgaataaataataacccatgatgatcatttaagcataactattatctggttttttgtacgtagaacaagcaggttgcacctcaagagagaaccaattagttttttttttaaaaaaaggaatagatctaattcattatgaacaagaaaacagaaaaaaaatcgtgaccatccaaagattgtgtgtaatacctatctatccaaataagccctatggggagagtgcatggaatgcaatggaattgcatcctccatagaactgcaatgtcatttgatatttaggctgagaatgtccagcaaataaataagattgcgttgtttaactaacctaatggcaaacaaagagaaatataatgttttttgcatgtacttatgatacgcggtgtaagtacttgcctcatatggatggcgatagcgattactatccccaactacttgcagggattcaagcattgttccagttgagcctccaattagaagcacctgcaatgtttgcataaaaagacatttagaatgattcatagaatagcatgaactgatacatacaaaatcctttgcataaaaatagtcgtggctattatgtaacatcacaagaattacaaccggtaacctacagttagaacaacaatagatgtggtagcggtgaaaattgtctcgccatgtccttcaggaagatcatgaatagactgaagtgcaagggcaaaagccattgcccccctaagacctgaaaaagaaaaaaccaacaatattagcagtacaaacatgaaacttattttatgacatttttgggcatacataattacataccactataccagagtgccagctgatactgcctaggtatttggcagtgcaccggtcgtgccaaatttaatatatatgcacaagagaagacatttgcggccctttaaaataagataatatcagaaaatcggcacaattatatagctatggggcttaagcttgtataaatacacagaaagcatctccaaaaactcagcaactagtccaacatcagaccaaaagatagacagttccgttggagaagaaaataccttgcaagtaatataaagatctggatgcataagcaaaagggaaaaaaattaaggaaacaagaagaaattattgtattcgtaacaagcatgggtaagagttggtgtgtaatcaatgcgaaggatacaactgagaaaaaaatgaatccaatatgtgaccagctttgacgctccatcgcaatatcaaatcccatgtatatgaacctgtgtaaatgcattacagtttcagtatttggacttgttaaattattgcacttgaaggtcttgcttacacgaaagcctctgctagtgatgaaagtagatggaaaaaacgagctgtaaaacgctgagaatcttctgataagttatagaaggtgtatctcttcataacctgaaataaaaattcacttcttgtaagcatgtttataatatcttcctgcaaagttgcttatctataatatgtaataagaataaaatctagagaaaatattgtcacaggctaacttacaattccagtaaacagaatagagacaataccagacaaaccaaagccttcagctagcatgtacctacaaacaactggcaattatttacagcagatatttaaagagaacatgaaatggaacaaatttcaaagataggcttacgagaagtaagggaaaaggacaaacaagcaactctccagattatgaaggctggaagtgaaaaaaaaaataaattagcagtttatgtgtggggtactagtttgggcaaatcggaatgtacttacttctcaacacctagagctgcatacttgaagaggtttgatagaattaaggactgacaattgagtctcaacggggataacataatataagcaaaaatgaagttcaaaaaatgcatttgttttgtttttgcaagaattttttaaaattttctttttcgacttattgtcgttggcaatgaagttgttgatctggccatgtacatagcctaaatattgttgcatggtgggggttgccttttttgttctccagagtaaatggaaaacgtttgtaaatagaccaaaaagatgattacacgttaaacatattgaattttcttgtcaaccctggaaaggtaatgctcaaggcatgcaacaataacatattggtttctaagaggatccagcaggagtattctaagttttgatagcaaaaagtgggaattcaggatgattacatagactaaacccctctgagagagtagcatttaactctttgcttgaacttttgtaattgtttcctccttttcaatttaataaatctttaactgtgggggcttcccctacagtgttttggaacaaaaataaattttcaggagggtgcaaacaggtatacatttctttacagatattaaactaatttaatatatgttataaaaaactaggtgataccatcacatacatgtaacaagtttatcagttttactttgtgtaaataaaaaatatacattaggtctctactgatagaaaatgtcaaaataaaggatatgagggcagaaatgaatccaaccccaacacctgcacataaaaaaatggaattgaaatatcaaatgttaaagtacaaatagatactcatatataatcataagtgcaagcgaagtcaagaaatccaatggaaaaagcaaaatacataggcgactcgaaatttcttctgctaaaggcatttgtaaatatttaaggtacagtacctgatgacattgaaccaacaaaattctcaagaaacttaaggatagctagaaaatagttctgtccagaagaacttgttctcagtgaagccatactcctgaaaagttcaaggtgttaatgacaggattctgagaaggagccatataggcagaaggagctcaggcaatacattctcacctatacaaggatatagccaccttaatttccaaaccggagttagacacgaagaaatatgcacatttcagtagaaataaaaaaaaacagctagttttaaatataatagggttatgcatacagcatcattgagaactgattctccaaaaaccagcgcatagaggttcacatcagtgccaagttcctgcgatttgatggacattatgtgatccttttatctcaaaatttgtaaatatagtctgtatagggatatggaaggaacctgaaatatggacagtacagtaacaggatcagttgctgacaccagagcaccaaacatcatgcactcaaccagaggcaacttatagacaatgtatattaacccaccaacgtatctgtgacaaatggaaaaatataaattacatttttatagatgaaataaatatcagcgaataggaatggaggcaatatagaagatactcttacactaaaagaccagtgacaatagaagcaatgaaggttcccaagattgcaaatgttataatggcaccaaaatttgaaaagaatggtttctatcaggaaaaaatatgatataattagctgagaatgatagaatttaaccaacgaagagtagaatttaactaactaagaggatccaagaattccacacttactggtgctaagctgaatccagactgagtaagattcagtcaagtaaaacatggtaaatttccgtacaagtaattaaaaaacaaaatcaagatacaaaaaaggatataatataattggaggaagtaagaaaagaaggaagaagtcctcccgaaaattgaaccatctcctgaattaataaagcaaatgaacaccacaaaatgttcagacttaacagcgatgtcatattttgcagggaaaaattgtatacagtgagtaataagaaatattatcacctaatacttctttgagtgtttgatatcttagcaaggccgccaacaatcatccctgacaagaaaagctattaaataatttcgtaataatatggtgtcatacgattctaacattttcaatgtacctctaggctctacaaactattaaataaaatggtaagatccatcttagctagggtgttttatttccaaggcaaatagtatatgataatccaccggatgatccaaataaaacgtagctagaataaacccaaatgtcacatcacttatcttagataatcagaaatcagtaaaagctaagctactgaaatgtaacggaaatacgcttatctgaaggaaaagacatctgtttgcgctacatgccaactttttaaaggttcattttatcctccaaagccctcacctgttacaaccaatcctcaaccatcgacagtaaattttggaaaagcacagctcgaactagactacagcgcgcgtcgtgaatgcaaaatttgttcgtctgatttgtgcataaacgcacagtcgaagccgttcctcctaatcacacactcacaccgttactgctcgccactaaacatcgtgtgaataaacagttcattcggcgtcagtaaacaacaccaaacacgatcacccccgcatcaaatgcgctagctcaaagcatcgcacggcgtcgcaaatacacaacgatcgcgaagtcagacacatgaatcgataggaccctcagcgacgatcggcattcttcagtttccacaagcccaaaatgctgtaactgggtgggaacacataccgatgaggagggaggcgctggcctcggggatgtagtagaccttgcggcggcggggga

SEQ ID NO: 4492 - DNA, 12406 bp, Oryza sativa
atttcccccgccgccgctcccactccccctcgcgcttgatcgatcgatcgctcctcttccttttcgcctccgactcgatcgtctcgcgttcgctcgcctcggccgcttcccgtgcgcgtcatgcggatgcgggcgagcgagtcgcctcctctctcctctcctccctcccgttgtgggctgggcccaccgcggagacgggcggtccagatgcgttcgactgtggatccgacgggtcagattgggcctggaatcgaggggcccactgggcactggcccggtgcctagaattcgcgggtggaatggaatggaatcggcgggaaggaagagacgggccttccaaaacgattttgttatatatttatcgacaaattttctcccaaaaatttaacagatataattacagtataatcgtagtgtaattatactgtatgctgtgattttttttcttcctcaccaaaacaaatcttgtaatagatttaatgattcaaaattacatgaaacttatatacaaattacactgtagttacatgcaagttacagtgtaattacatataagttacagtgtaattacactacgattgtactataattatatatgttaaatttttagaagaaaatttgtcgacaaatatataggtggtcccgtagcttctggttgataatttgatatagttgttaagttttgccgatttgatcgagtgcatgacttgcggaaagtacaagtagtgtgatcagtaacaccttttgggctaaatcatcatctttatctgatctgtaactacttactagtgacgaagccaggatctcttcaaaaaatcataacaattcacgcagattttagcactgattaagcctttgagttttttttcttgcacaacttcgtgatttgtttttcaaagaacaaggatgagctagaacaaactagcatgtaacagtaaatacttcctccatttcataatataagactttctagcattgtctacattcatttatatgttaatgaatctagacatatgtatgtgtttagattcattaacatctatatgtatgtgggcaatactagaaagtcttacattatgaaacgggggtagtagtctactactccaatatcatcatcatcatcatcacaacattatactccctttgatccttcccaaattgaacatcacataaggaaaatcatttttttttcaaaatgatcattatataaccatgtggacatatggatttcatcataatacaattaatataacatcgtataatgtggtgtatgcttgtgttttagtcgatactatatgcatcatgggagaatgtgtgtatattttgtatggtgtgttgactaatgtagtttaaataatccttagtcttggtgcacaaacattatatgatgatcaatttgaaatgaagggagtaactatctagacactccccatgtactattagaatccagtccccatatactgttactagtaaagtcacaaattaaacagcacggtcagaaaacgcggcgtgtactgatctagcacgatgactgagtgactgatcggatatcaatatctccatctatgaaaaatctgtggttgccgaacaaaagaaaatctgtggcgtggcttcactccttcagtcaggtcaagcaaaacccgtggacgtatatactcttcgtcttgggtgagccattcttcagtatttcttctgctgatcgagccactgaatcgatcagctccatggcgccctctcctgttatccttgttatggctgcactgtttctccaagctgcaacaatggcggcaacaaccgcgctaaccgtatcgctgccgggctgcccgagctcgtgcggcagcatggtcatcccctacccgttcggcgtcggcgccggctgccacctcgccggcttcgccgtcacctgcaaccgctcctaccacccaccgaagctcttcctgcgcgacgccgacgccgctgaggtgctcgagatatccctcctaaactccacggtgatcgtcagcagcgccgtccggtacgacgccgccaaaggcgagggcgcgtggggccgcggcctcgccggcgcgttccgcctcagggagcggcggaaccggctcgtcgtcgtggggtgcaacctgcaggccgtcctcctggacggcgacgacatcgccgccgcgtgcaccaccatctgcggcggcgccggcgccacctggccagcagcggccgacggcgagctcgcggattactcgtgcgcgggcgttggctgctgccaggcttccatctacctaggcctcacgtcgtacggcgttcggctgtcgccgttcggcacaagcaccgggccgccgccgccgccgccgacctcctccgcctcgtcgtctaaccaatcggattcggctctcgtgttcgtcgcggacaacgagtggttcggcgggaacgcgagtaagctcggatcagcagcagcgacgatgcgaccgggcggcggcggcatgccggtggcgctggccgtgctcgactgggcgatcgggaagtcggggtgtccgccgcatgggcccgacgacacggcctgtagcagcagcaacagctactgccgcaactctaccagcacctcgcttggcggctactcgtgccagtgcgacaacgggtaccaaggcaatccgtacgttgcaaatggatgtcaaggtaatttgttactccctacttccctaaatgtttgatgccgttgactttttaaaacatgtttaaccgttcatcttatttaaaaacttttgtgaaatatgtaaaactatatatatacataaaagtatatttaacaatgagtcaaatggtaggaaaaaattaataattgcttaatttttttgaataagacgaacgatcaaacatatttcaaaaagtcaacggcgtcaaacatttagggatggagggagtataagggtgtaaccatgtaagtggagaaacaactgagggtcttctgattagcttcacaaggtggtgggctagctgttctgggttcgatgcctcacccttctatttagtttgatattaaatcatttcctaatattttagcttataagtgtgtttaacggattagtcatttacacttgaagttgcataagtatagcctctcatcgtttgcttgctagattatgagccgcggctaaaatttaaaacctaattttaaagttgattttagttttcttattatagtcaatcttttgccgttaaaattttaaaccgctattaatagttttatttataaattatttttgttcgtttagtatatttttctatggcttaccaaccatagttcaaatgattagtggaatttagaacagaatggtacaaaatttttctaaattctccctttcagatatcgacgagtgcgctctgccagaagaatatccctgctacggtgaatgcacaaacaagccaggatcgttttcgtgcatgtgtccgggtgggacgcacggtgatgctatgaacgaaggaggatgtgaaccaacgagtacatagaaatttctcttcatttcataacttaaatttatccttgcaatcttctctgcaaatccttgcacaaacagggttcagaaatttgaccgtatcttctgctggcagctctccttgtggcgataggaggaaccatcggcataggaattccatccgtgttcgtgataggcatggcaatgacgaacatgatcaaggcacggagggccaagaaactgagagccgtattcttcaagcagaaccggggtttactgctgctgcaacttgttgataaggtgattgctgaaaggatggtgtttaccttggaagagctcgaaaaggcaacaaatcgattcgacgagatgagaaagctcggcagcggcggccatggcactgtctacaaaggcaccttgccagacagacgtgtcgttgccatcaagaaatcgaatattacggttcgtaaggagatcgatgatttcataaacgaagttgtcattctttcgcagatcaaccatcggaatgttgtgcggttattcggatgttgccttgaaacacaggttccactactggtctacgagttcatatcgaacggcactctttccgaccatctccatgttgaaggccctacattgttgtcatggaaaaatagattgaggattgctcttgaagctgcaagcgctttagcctacttacattcatccgcttcagtatcaataattcatagggatgttaagtctgctaacatattgcttgatggtcgcttaacagcaaaagtttcggactttggagcctctcgaggcattccggttgatcaaggtggtgtgacaacagtgatccaaggcacatttggatatcttgatcctgaatactatcaaacaagtagattgaccgataagagtgatgtgtacagttttggtgtcatactcgtggagatgctcacaaggaagaagcctactgtttttgaatcatcagataatgtcagcctaattgcactttttaatttgctaatggtacaggacaacatctacgagatattagaccctcaggtaatttcggagggcatggaaaatgtgaaagaagtcgcggcgctagcatcggcatgcctaagattgaagggggaagagaggccaacaatgaggcaagtggagataaggctggaaaggctgttaggcggtgacattttgcaagggctttcagctgagctgcactgtctaccacctcaactgagcaataccgacactactagcaagctatacaacatggagcgggattttttgctatcgtcgagcttcccacggtgatcttactacatgtgtacaaactacatacaactttaccacttaaagttgtttagcatgtgtttgatttgaagatgaggtgagatgtgttagatgaattgggatcacctgcagtggctatagaaagtgatatccgaaaccttcctgaatcaactcaaaaaaaaaaaaaaaagaaatcttcctgaatactgttcacaaaagacagtaccaaggtttctcctgtaggctgtagctagaactgtagcagataatgtttaaaactacactgtagcgtcggtttcagtcgttattgtcttgatccaaggatggaaaagagtttctactggcaaagttgcagtctctgttatgactgcattggatctttatcctgatcccaattattcatttgacatgagtcatgacctcgtgatgtaatacaaccctacaactacaagcagctctgtagcatcaatgttgctgcctctgccgctgccgcttccacaactcccatggctttctttgttgatcttgcctctagcagtactgaagtacaaatactgcgtaatttcaggttgatacagaagatgttcagttttgctatttccagcgacttgttccaagtccatgtcacatcggatatttggacactaatttggagtattaaacatacactaattacaaaacccatttcataagcttggactaattcgcgagacgaatcttttgagtctaattacgtcatgattttgacaatgtgatgctacagtaaacttttgataattatggattaattaggcttaaaaaaatcatctcgcggattagctcttatttatgaaattagtttttttattagtctatgtttaatactctaaattagcgtccaaacatccgatgtgacatttggtcgagtagatgcctgtgaaaagtacaagtaaagatcaataatagtataataccatttgggctaaatcataatttcgatctgattcgtaatatgaactagataaatactctgtcacgttgttgcgggaaattaagttgcacaatatgtacaaataagatgaaatatgaatattaaaaataaaacaaaatggtacttatgaattttgaggcctaaaaataattgagattacttggtgttatgagagaagaaagaagagacactggtcgtgacactatcgtgaagtcgtgacactggtgacttggataatttggaaggaacagaacaaccgaatcttcaatcaacaacaaaggtcttggaccgaagtggcgaaagcaatggcagaggaggccatgctttggaagtcggctaatcacgggatccccgctgtttggcctttacgaggtcgtggtagccaaatttagcgcgagatattcctatagtttttcatagtatcctgtattggtcccctgcttgttttccttttatcattgtaaataacttttatttctcttaatgaaaaaaatgcgctccttgcgtattcccgaaaagagagaagaaagaagacaatttgaaccatagatctatcatccaatggctaaaaataattggagtgacgtgacttaatgatagaagagagaaataacattaattacacttagtggggatgaactatataagcatataggattccacataaaacaatggtttttattgattaactatgcaggatattctagtaactggtaaatcgccagaatagcagtatgcatgcgtatgagtgacgctttcacgtttcaactttcaagcatttcactaccccacaatttaaaaggcatgcatctaacaataatacaccaagatgagtaaacaccaatgatgttgggacagtgaagaaacctataccttttgacctttcactcttagtttgtactaagagtttgtactaaggcttattcactttgctatcatttttaactttaccaagttttagcattgctaaatttagataaggttatcaaaattttggcaaggttgccaaattttggcaaaatttcatatgtacttactaaaatttgacaacaactaaatgtagccactttttgggtaattttgcaaaaaacaaaaggtaaggttgaaaatggtagcaaaatgaacaagccctacaattaagtggatgcgcgcaacaaacaatataaggatttagtatgagtgttaaacatataattttacagagaacatgcaaacgttgaaaattatacttatgaacaaacaactcatttgtgagaaaaaagtcagcacacaaaactacattcaataagcgagaaaaacattaagttcatgaacatgtatgaaccatcatagcaacgatctggcctatcatgaacgcctggtaacccagctgctttcttaacaaaatgtgactgggtttaaatctacctaataaaaaaacacttatgtgtttacatataactaagacaaagtgatttctgttagaatatgatagccattttcatttagtgcatatctttgatctatttaaatatttttttctttaaacattatatattaatctagggctcttataatgaatatagcaagatatgatttcttttagtattctttttatgaacaataaataaattgcccacacatctgcataggcttcctctgtagttgctaaaaaaacctccaaagtgtttgggccacgtcttttccccctaaaacgtaccccttctagccttccgtctcataaaaaactcaatcctaactacgaaccttgacacgcatttattcagattcgtagttaggatttattttttagacaaagttgtatatgctaatgtcataactaaaaattatttttcaagttaattttgatgttgttatcttacttttttttctaacgttggtgttaaagtcattaagaatacattggtaaaagttttaatcataaattattttttatcgttaaaatgttgtttggcgtatcatttgcaattggccaaccaatgacaacctttatctttcaaaacttttaattttgtttccgtcggatttatcttccaaaacaaaaaggaaaaaaacaaatcagtttttatcttccaaaactttcaattttatgaccggcgacattcgttccaggagaaaacaaaagggaatcaaaccctcgaccagcaagttgcaaagttccatctctagccatctggaaatatggttggttttaattagttatatgcgagttacgtataagttacattataaatagttaaaaaatataattacatctcatttacactatagttatatttgaaagttttttttaccccaaaattatcaaatgtttatatagctatttgccaaagtggttaatctctatatatcacgtttagagttatattaccatgttttgccactttcatcgtattgccaacatagaccgaggatggaaaacattctctttgtcccgtcttctccatcatcttcttttcaatctctcctaatgcacaactgatagtctaggagagcaacggagaaccagttgcctcctctcctctagctcctccatctcttctctctcatgcgtgcgcattgctattgtcgtcgtctcaatctttatcttgagcctcttggcgtcctcacaaggtggctatttgagcagtgtaggggagttattggggtagggcgtggtcacagtcgtaagcgaagagaggagatgaggcggccgctcgagctcggtgccgccgcgtgcacaactcctttcccgtcggtcgtcggcccccaaccactgaccgctgcccttctcctcggcgtgtggccgccctggaaagatggggaagagcggggaaaccaataagacaggtccttgacatgtgggggtgacatgtcacacgctgactcagcctcgccatgttagtcgaaatttttaagttctatacaaacttataacttatgctatactaagtcggatatgtaaattatttttagagtaaatctcataaaactacaattactttagccaaattatcagaaaactacaaatttaacatgatgtatcacaaaactacatatttaaccctaaatttatcacataactacatatttaagttggaatattgcaaaactacaaatttagtaacaaacttatcacaaaactacatgtttaatgtcaatttgatcgcaaaacttgaatatttataacccaaacgtaacattggtgctaaggatttaaaccgaaaatctatagttttgtgataattttattattaaatctgtagttttaaggtaatttgaccaaagtatctataattttctaaaatttactcttattttcgttataaaaaaatctagtttgtggagccaccaaataagctctgaaacacagctagacccgttagacacttcaacgatcaaacaatagggaagtctccatttgtgaaatctgtggttgccgacaaaagaaatatgtggcgtggcttcacttctcaagttttagatggcggggcaggagcacttaggccgtcggttggggaagagaggtagaggggaaggaggttggtcggggtggggggagggggggctcacctgcatcgttgaccccttcctgccagccgacgaggctgggtactggcggagtgtggggcgggacggcgaaggcatcgcacgcgcacgagctcgcgagaggtggcggcggtgctggaatgatgaggggggaagggggttagggatagaaatattacacacgaaatcagaaatcttaaaatggtccaacggtctagaatttgtatgatttgtgagatgtttttctgtcatatgtcatctagacagtcccatatttcattagaaatacacaagtgctctttcttgcacactgatgtgtgtgatctcactctcagatggtgacaacgaatgggctacgaactgtatgctttccatccgaccacgttattgacccaaacaggtcccctttggccgccgccgcggcgttcttgccggagaaggacacctggaaacccagcttcttcacgctcttagtgaactccagcttgccgggcaccaccttcacgtccaggccggccggcgccgcgacggcgacggtgtaggtcgcctcctgctgcgcgccgacgttggtgacgacgcggctcaccgtcctggtgccgccggccttgccgagccccgtgacggcgatcgacgggtagttgaggccggagatgaggtccttgctgtcgctggcgttgccgccggcgccgcagctgaagccgccggggagggaggcggcgaccagcttgatctgggacgcgtcgtagccgtagtcgcagaggaactggaggtagtcctcctcgccgagctcgtacaccagcccggcgtccagcgcggcggccgggttcacctggcccgcgccgtggtcgtacggcgtcgccggcgaccccgagtcggtcgtcacggccgccccgtcgttgttcagctgggccgccgtcgtcatgatcgccgaccggatcgccgcagggctccacgccgggttccacgccctgacggcggccgccgccccggccacgtgcgggcaggccatggacgtccccgacacgaggttgaactgcgacggcttctcctcgccggccgggagcgtcgacgtcgggatccatgacgccaggatgttcacccccggcgccgccacgtccggcttgaggatgttgggcgtctgcggcgacgggcctctcgaggagaagtaggcgaccaccggcgccggcttgtactccgtcacggtgatcgtcggcgtgatggtcacgacaggctcactttgcagtttaattgatcaccatgcacggaagagagagtgatgtgatgagatcgatcgagcttaattaattctgccactaattagggtatacttcatccatttttttaatatataacaccattgatattttaagatatatttaaccattcattttattaaaaaataatgtaattatcatttactccctctgtcctaaaaatataacaacttttaacatttagaatttgtctcaaaatataataacttatataccagcattttcttctcaaccaattacaatcctctaccatttaattttctcacataccttcacttctcatctaatcgtagcctaatcctatttagttatatctattttcttaatagttgtgttcaactctaagaatatatgcttatattataggagagagagaatattgtaatgtaacttgatttattaccaaatgttttataaatataacttaaatatttttctatttgaaaaaaaaataaaggtgaatgattaaatgattgttaaaaagttaacgatgccatatattaaaaaacggaggtagtatataatcgctatagtgtgaaggactacgtatagtacctggtggaggagatatacttgtgaatgtcggcggcggcgttggaggtgatctccgtgacagggaagtcgatgtaggcggtggcgacggccttctcaaggtcgtcgacgaggacggcgccaaccgcgccggcgctcttgagctccccgaccttctccgtcttgggcgtgtcgctgttccgcgagtggtgacacagcacgatcttcccttttatcttgctcgcatccagcgtccccggctcacagtgactacaaattattttgtggttatgatttgatttttgggcatgaaactacttactcagattctgctgaaactttctgttaatttaattttgtttcgttactaagcttgccttgtagtacgtaccttgctgactcggtatcagaaactgagctggacttggctgattcaccggtgatcaatggatattttggtgatttgttcaagttggagaagtttatagctccaccctacagattccataaaaatggggtagttaagatcacaagagagtgctcccacaaggattttagacggatgagatattagaaatagatgagattttttctaatacaacgaatctgggaaaaagaacatgtccagatatatttaattttgtgatatataccttgacagcggtgttgttgccgccgagcacgacgtccgattggaagtagcggtcgatcgtgctcgccgcgacggtaaggatccacggcgccgcgttcacgacggtggcggcgtccggccctgcgttgccggcggagcagacgaccatgatgcccttggccacggcgtggaacgagccgatggcgatggggtcgtcggagaagtccgggcggaagtagggcgacgcgccgagggagacggagatgacgtcgacgccgtcggcgacggcgtcgtcgaacccggcgaggatggccgacccggcgcacccctccccggagcagacgcggtacatggccaccctcgacgacgccgacccgcccttggccgtccccgccgcgaggccgtagtacgacgcaccggtgaccgcgttcccggccgccgtcgacgaggtgtgcgtcccgtgcccggcctcgtcccgcggcgagctcccgctgctccgtgctgactgccgcttcgcctcgccgccgacatcgtagtaccttgctcctatcagcttcctgcatgcgccgcccgggaaacatcaggatatatactctccgtttcatattacaagtcatttgtaatgacttttttcttagttaatttttttaagtgaccaaattatactacttccgtttcagattagaaaatgttttgactttggtcaaaatcaaactactctaaatttgactat

SEQ ID NO: 4493 - DNA, 15765 bp, Oryza sativa
  unsure (1)..(15765): unsure at all n locations
nnnnnnnnnnnnnnnnnnnnnnnnnnnnnnnnnnnnnnnnnnnnnnnnnnnnnnntttagaaaatgttttgactttggtcaaaatcaaactactctaaatttgactatctttatagaaaaaagtataatatttacaataccagtataatttcgttaaatctataattgaataaatttacataatatatctgtcttgagttaaaaatattactattttttctataaaattagtcaaaattagagtagtttaattttgaccaaagtcataacctaaaacagagggagtagaagtagtaaattttcaatgtaaaaccaacattgtatcaaaatatacgtcaaattatgaaactaattttgtatcataaatgttgctatttttttataaacttaattaaacacaaaagttttaactaagaaaaagaaaatcaaatttctctggcataggcgtcggcgactcaccggttgcagctggaggagttgaagtcatcgccggccatgcagacgcccttccacctggcggggacagggccaaagccggcgtcgtcgaagctcggggactcgggccagacgccggagtcgaggaggccgatgatggtgtcggccgtcggggacgacgacgtcgacgctgatgctgcggcggcgcgggcgcggggcgagcggcggcggcggtgggcggagccgccagtcttgacgtcgacggcggccgtcgtctgctgctggaggaagtcccatgacctggtggtgtggaggtggtagacagggtcggcgaagacggagacgacgccgggcttccggcggagcgcggcggcctccgccgctgacagccgcgcggcgaagccggagaaggcgtacttgtactgctgcaccaccacgctctccactggctgccccctgttcgcgtagtgcacacatgacacggttactaacgtgtggcacaatgacgtcgacgtgacgtgacacacgcaacacacgtgttgcgttggtgatcactttgtgctactgaggtttccttttaccaataatatgcatcccaatatctttgggcataaaattcagaaccgtttgacgaaaattctctatctccatatctacttctttatctttatctttattttttctattatcaaaattgaaaataaatttgtcggtactttgatacgttatccgtgttttagtcggtttttaaatttatttgcttttgaaaatatagaagaagtcatataaaaaatatccaagtaaattctcacattttatttcaccataattaagccatataacgatagtaagattaaaataatcttcaaccattgaaaatagttaaagagaaagacaatgttaaattaacaagaagtgcaacactgtagcaaagtgagagaagtgtacacgggtttttaaattaacgtaacaatgtctgcttattttaatttatatggagtttttttttagaaaactgctacctctatttcacattataagatgctttgtttttttaagtcaaatcatatatgtttgatcaagaaaaacatataaatagtttttatactatacaatcgtactatattcaatatttggaaaaacactagtggtgtggtagcggagtcgtgagtgtatgattctactaaccagggttcaaattctggtgcccacgaatattatgcacatgcatgtagacttttaatagaattttagtgagataagggatatgtcgatggtctgcatgtgctttttaacaggatttttgttagatcaaggatgtgccgttggtttctatctcttagagcatatgttaggggggggtccatttgtgagggtgtgagtgcggtgctgcgtatgtagtggcgtgtgtatgtctatcgtgatttttttttaaaaaatcagtatttagattgaatggaactaacacagtatcgtagaacttgttacatttttccgtaaacttgaccaaacgtaaagaaatttaactttaaaaaataaaacatcttctaatatataaagaaatttaactttgaaaaattaaaacatcttctaatataaaacggagagaatatatttaatgccatgctacaaatcggcaaactgagcgagtaccttcttattgactgacatgcatgctactgctagctagtgcaacttgagagacattagcaccaacaggaagagagttaaaaattaatttattttacgatggaccttttgagcacggcgccgatgaggcggagatgggtctgctggaggatgttgggcgaggtccgcggtggcacggcgcccaagtacaccacgtataccccacgccgctcgccgccgccgccatttcctcctccagccgcggcaccaccaccaccgctggcgccggcggcgagcagcaaggccaagacgaagcagatcagcggcagcaaccacatgattgctcgtataatttttatttgtactgcaccggccggtcagttcaagctctgctctctctctctctccccctctctctctctctggccacgaaacgatcgcactatgtatggctgcatttataagcgcgcgcgtgcgacgtcgtcacgtccgtacgtgccggtgaccggaggtaataagagcagtataaacatacgtgaaggagataagagagaggagagaagaaaaacgggttatagatatacatcgctgtagcacgaactttaaaatgtatgtgtatatatatgtgtgtatatatatatatatatatgatatgtaggaccaattatcatggtgtattatatatttgtaattaactagtataaattagttattagatagactatagatgatttagagttagtagttggctggagtatactactctttctgttttacaacgtaagtcattctagcatttactatatttatattgatattaatgaatctagacatatatatctatttagatttattatcattaatataaatatagaaaatgttagaatggaagtattgaggtagtggtcgcctggtgggatcggatcggatcggatcagccggcgcttgcgcgtgcgtgcgcatgatatgtggctgcgagcgcgaggggtaggttaattgtggatcgggtgcgccgtgatggtgcgtgcaccactgcgctgcgctggctagctactcgagtagagtagagtatagtatatcactagtcttggagtgcagccgcgcactagtgcgcgatctcaccttctctcgagcatgcgccgagcctaaatagctactagtagtatagacaaagttacctagttgcattctagtaccatccacatattttttgtcaggattcagtaagttcatcatcatatactccgctaatgtctgtaccaaatcctaagtgtaagcaggcttatcatgtttgacatccccaactagtgacaacaataatatcacaagatgaatagtatctttcaagttagtttggaaacatcaatgacttccccaaacctaatccaaaataagtgttctatctctcctttacgttccttgattcaatcaccataattcgtcctactttgacatgaacaaggtttgacacaacctagtatatgcaaaacagattattttacttgcccaacacaatacggagcatggacatatataagcgcatttgccatgacactatcgttcatcaccaaagaagagagggaaaagatgggctcacagagctgttgccatgttaaagcactattcaacagaatgaagcccagatgccttcaagaggagcagcagcataacaagaccagaacagtcaaggcagaaataaggcaaaacactcttcaagacatcttgtattctcctcagagctttcagggggaggcaattggagccccatcacctcggaggcactctccaaaggtttgcccaattaacccggattgttcttatgaaaataattctcctaacatccgggacagcttctccatcgatagaatctctattaggagccaaaacagcatgaggagagttagcttcagattacctgatgaatctgacatattcatcattcccgcacgcgaagatcctgaaagttgctccactgatgacgaatctgttgaacatgtaagtgaacaagacattgatgcaaggaaaatccgttatgctaaaaccagatactagcagcactgccactgctctcatgtacctagcaaaaaagaatacaagaaaagaagcttcaaagaacaaactcattggttgatctattccaaagaagatactcatgttatgcagtaatattagtgtgtgcctgcttgggtgcttgttgcttctcaaggattatactgtacgacacttcagaacaaactcgtaacttatctatttttcaagagaacgtactcatggtacgcagtacacagtaatagaagtgtatgcctgcttgttgctttcaaggatgaaactgtacgatattttacaacttattggatttcatgcagatgtatgcgtttcatgatttcagtttatttggccttcagattctccaacgtattgtaatacccagctttttacaccttttcttattcttttttttagacggttaaacagcagaataggctcctactgtgatatattaaaatataatatgtacatgagagagatagtacaagggggggcggggggaataaaaaaacagcagaaagagagagattttagctaaccttttcttattctggaagctggagagtgtcaagaaaatgttatgtatgttactgaatcacctttggcatgtataatatagatttttccatcacaataatcatttagttataatgctatataaactttattttctaatatagaaagataggagatataaatgccacatacaaaagccaaacagcacaaacctattaattctgtccctttttcctcatgaatggccaattcctagtgtaagtaactcaagttattctcagcaagtaagggtgagaagcacagctgacctacttctatacactatctatagtcagatttgaagccttccgtcagtgcaacaacctttgaagataactttgactgtagtttggaaacagcttgtctaatatcctacaaaataatcatttgggtcagattagtctagaatccgcaactattatttttaggaaacactggattcccaatgatttataggttagtgattacatacctcaagactatatcgatttgagaaatgtgtcagtacaatggctttgtttctaaaccattgggagtgctccattatctgtagacgacataccagatttgcattaatgcagtaatactttatacagacatctcatttaactatcagaattgtcccaaagctcattagaatcatagcatggcagggagaaagtgacaagtgcatcatcatttacctcagagagatgcatgtggccatgctcccgagcatgatcaacatcaatttggtcatctaggaaggttgcctgtgaaaaggtcaaataatgttggtgccaaagcattcaatagggaggacatttgaaattattttgtcatgtttcagatttgatggaccctctgatcaaataaaaaggaagttcttttgttattttacagtctgaagatgtgacaaatcaatataatagggtggttttacttagactgccttttactgttctctgatatttcaagactatagctgtattatactactctcccaatcccataatataaggtgtggtcaatgttggcacggtctccaaaactaatctttagcttataatttctcatatactataagatttgtagcaacaaaattataaccacatgaaagtaaatttagatctcaatctaatgatgtaatctttaacaaacaaaattcattttcatattatattaagtgttggtcaaatgttttaaaggttgaatcttgaaattcgtgcgcgccttatattatgggatggagggagtattatacttcacaccctttttgctgactttgacatgtcccatgagaatgattacatctctaaatgtgactgattacatacagctggaacaaatacttttgacaggcttgggagaaagggcaataatcaaggaaactaaaatctaaagccaatacctcagttataaggacttttgctctcagggcatctgcatttcgtgggtcaagaataaaatcagactttgtgtcacctgtaaaggcaacttctggatatagtatagtatctgtaatctgacagaaaagaaggcagtgagtaacagtgcagaatatatttcttatatagaacagattgctagctgacctcagcgcctgattgcttcattttcattatttgattacccttcaagtgagcatactgttttttcaactttctccgaacagagtagatgacataaccctgtgaatgtacacaacccgcacaaggggcgaaatagttattaagcactaaattgtccaagaaaggtgagaactagaacttttggcttgctaactatacttaaattgacctagggagttatacctggctgggtatagcatggtgagtctcaaatggtctggcaacaaggtcattacgtatttcaaatgtctcccctgaatgcaatcgtagaaacattagaaataaacaaggagagagaaacacagaaagaagaggtgaaacgagctcaaacccaaatcaagcgcaaccaattccactttaaggtcgacttgactcattctacgatggatttgaagtagatcctcaacatcatccttgatacatggtggtacaaatacaacgggtggcttcaaattatagaggccacgagttgctatgtacattgggagaccaccctgaacaatcaaaataacaaaactgaggtggatatggctgcatttatgttgtgattctgttagagcagcaaatggaaaaactgacagtgaagcatattcgtcagtttaaagggaaaaacattggaaaattctcccgttgctatgcaaaggagaaatatgttggcacaatcatgattttcttgacaccgctccaaagtaaaagcaggtatagagcaagatgagactatttattatttaagaattacacgcagactaacttaggccaacttatcagaagaattggtgataaaaatcctatccatcacgaattcacgatagcatgttgttgaacaaataaactaagcagacatttactaaaggccacagtccaaatagtaaattaagcaggcatttccccggtgacaattcccttgaaattactgaatcaatccccttacatcagcttttctatgaaacttcaccgatggcgcacccaagcttagctagaggcgcagttgcctctacacgaaattcacgaagcacaagcagcacaggaatgaatcaaaccaggacagggctcggggcgctcacgatgtggtcgaggtgggcgtgggtgatgaagaggtagtcctggctcacggcgaagagcggcccgcggccgatgtcgaaggcgacgttgagggacggcacggtgacgcaggtctcgtgcccgccgacggagaccccctcgatggcgtacccctccacctccacgcccttacggtgcacctgcgcgcgcgcccggcggtactcctcctcgtccgccatcgcccggtcgagcaccgacagcagcccgccgcccgctccacgccccccgccgccgccctcgccggtgcccgtggcgacggctgccttcttcgcggcgagcgtttggaactgggagcgggaggctggggcggacgacgacgcggggacgaggaggcggtgggtgaggcggagcgaggggagggagaggagggaggtggccgccatttccggcggcggaggcggaggcggagacgaacggtggcgacggcgtcgtggggttttctgggttttggggggaactcgactcgaggataacggagagtcatttttgcggggtagcccctgtcttatcctaaaattgtttttccaattggaggaggaggaggaggaagagagtcactgacccctgattactcaaggcctcaaggagcttcctgtaaaatgccaaattctatttgtttatttatttattttgatagtgtaaaatgtcaaattcagctacactgaaaataaagagagatcagtttgtgtttacaggttcagtgaggcagattgcagtgataatttatatcttaccaatacaagaagtcaggaattgatactggaacgatgatacatttccagattatggttaaatacagcaaattcagcatagattacagaactgaacactatacagtggagtgtacatttttttttttgacagaacgtgtacaagtatattgccagttcatttggaagaattgtgggtacatcacaaccaacccaccatttctccagtatagcagcagcctatttctacagttctatggttcctagatttacatatgtacaactcctacggttatttacaaaagaacattatacagcagaacgaaataatgctaacatgttgaggaagtagcactacacgttccatgggacatggcgatttctgatgctttgctgattgagcaacaagcctacttcttgccagatgctttcattggcttaaatagggagtatgacctccgatgaaggcaacatcagagctaacaattattcttgactgggaagtgaggatgtatgcatcgctgatggagaaccccttgatgataggcaatgggaagcctcttttgagatatgaattcacatagggcacaaacaattttttcaacaagatctgcatcacactctgccaatacaaaaattagaatcaattagacattcagaagttaagaaacaaatgttcaccaatgataataaaatacatgtgcagctccacaattaacaacttcattcagaaattaggcctttccgctatactaggtaaaagaactttatgaagaaggcattttcaaccgaaattacttttttctttccaataggataacgcatgtcttagttagcccctcagagtccctcttggaaattaggcatatccataaatataggatggagattcccaagctcacctcttttctattacaccatcataaattacaaactgtggaatgtcattaaatcgtataatacaggccaaaatacctgaactatgaaggtatgaagtttgccaactttgctccacttcaaggtgaatgagaaataatctaactcgactcttccagcaagattgttcccagaaaccactgcagctccagagacagtaactgactgtggaaacaatatgcgacaacggtatcaaagaggtggaaattgcacgtgtttcctcgtgtagaaatgtttatgtataatggaagtccaattgtaaatcaacggatgaaacaaaaaaagaaaacatgaacacaactcaatgtgccatagatttcatttctaaaattctcagtgggagaaaatatgaaatgctgaaggtcaaagacaacacggacagtatacaagtgctgccagatggtgcaatactgttacatttcaatatgtttactttccataagtcaagcaactagcaatgaaatcaaatgaaatcaggaaaggaaattattagaaaaatctcaccactgatatgcacgccactggaactatctcatcaaaatccaaaacattaactgtgacatctaagtcaactgcggcatcaatcctacccacattaatcctcacggaaggaggtgaagtagctgaaatattcagcagcatatcatcattggggtacttctgatataaccttggaatcaaaaacctccaactagcagtattcaggaagagctgatcaggaattttatccaccatacgttgtagtgaaccagcctgaacaatccaagtatcatatcaattagaatatatatttttacagctattagcatatttgttactccctccgtcccaaaatataacaacttttagccctcaagatttgtcctaaaatataacaacttctccaccaacattctcttcccaaccaatcacaactccccaccattcatttttcccacctactaccactacttaaccaatcacaaccctccaccctccaccattcacttctacctactttcttagtaaccatgtccaactctaaaaatgcttatattctgggacggagggaataattgtttccattcaaacatgaacacgtgttcaagttagctactctagacggacacaatcaacaaaatatatatctttcttttgggtaatatatatatatatatatatatatatatatatatatatatatatatatatatatatatatatatatatatatatatatatcttttgacaaaagcaagttcagataatccttcaactttacacatctgcagtaaggctttaatcctttaaccatgataacaaccactttcttatgaattctgatataccttgaaatagagagctgaaacagagttgaaaacatcttcatccaatgaaatccatagcatttttgaagagctaccaagaggtggtacatattttacacctctaaaatgcatgtgtcttgaaactgcagttttatcagatggaatgaacagtccatcgatatcaaactccacagaggaactcttgaagagtggatcactaacaaatgtcacattcatagcagcgatgctatcaacatcgattttctttggaaggcttccaaggaatgagtcaagctttgatgcaccctccattattttcttcgtaattgcattttctactgatgatctgatatgattactgaaaccatctacaaacctagaaaaggtaagaggaataatatcaatccatgtggggtcagataaatatcaacagcattcaggaatatatagggcaattattttgacaaaaaaaattgcatgatattctaaccacagatataaaccatgtttcctatatatattgctgatgtacagaaaaatagaattagaatgggcatggctacccacatcgggcaattataggagtcatattttgttttgtattgtgccaccgaataagatagcgagaaatcagatcaagaatggaaccattggaacctccgacagtacaagcccttgttcgcttggttctggaccagcctttcttctcacttgataacagatcatctagctctcttttatagtatagtcaaagtctatctgggcacggaagctaagccggcaaagaaaaaggcttaataagatgagtggggaagaaaaagtatcctctttcaggataagggctggaggaagcagggactgaaccagggcttgttgacagagcagatatcaaaagcctatgttatctcattttcagggactgagcaagggatgagcgccctctgatctaacgaccaaacaagcaatttacagagcaacctcagttaatttgacaagtttttgcatatgtaaaattgtgaagcacgtacccctgataaaaccaagatgctcctccgttcagtgatatgtccaagctcttcatattacagccacattctgtaacgaacagcttgagagacccattttgattcttcatccccatggaaatcccaacatccattccatcaaccttagcgaaaaggaatcatgaatacatcttgtaccttcgtatatatacatgtcaagggtgtctagtactcaaataatacaggtaaataaggtgtaagtgccataggtgacattgtttcggtgtaaactttcaaaaacacaactgagacgtttttactttttaaaaaagaagcagcttataattccaacaaattaactgaggagcatataggatatctatgttattgaaatgttgcttgcctgctgcaatgctgctatttaggtgcttagaattgtaaactccattgagctaaaatgatctagagaaaaagttaagatcatcttgaagtaaatcctaagcacaaatgccagctgctcctaataggcagcccacatgtcaccccaatatgcaccgtgcaacaagtaaccagctattgtgcctatcaatgtaaattactcatgtaccaactaaagaactagatttgaaagtgtcttcaaagctactcaatttcataacgtgctggattctactttacatacatgtttcattccatacatgccaataagcgcaaattcagacactaaaccactaattttgaacattaacttgtcaatcatggaagtccccctccaatctagcatcatctctcgaactgtgaaaaaaacaacaacaattgaacgcatgaataccgcgacccatacctgaatcgaggcattaccgctgtcagagatcgtgacgacccaggcgctataggagtagctccaccccatagtaagattaacgctggacagcgacgcggccaccacgatcccgtcgtccccgacggcgacggtggagtcgtcgaccgccacgccgtggaggacgatgccggaggcgaccatgtccacggtgccgatgaccgggatgctcacggacctctcgatgtcgggcacctccaggggcacgatggcctccgcggcgcgggacacgaggaggtccttgacgaagtcgaggcccgactgggagatgacggcggagatgtgcggcgacgcggaggcggcggagaggaaggtgaggagcagaagtagaagggggagggtggggagaggggcggcggctgccgccatggcgacgccggcgccggcgaggcgagagaggctagggattggggaggagaaggtgaaggcggtggccggagtgggagtggcgtgagggagaaggcggcggcatgggcgccgccgtcgggtagtcgcggcgggtttgaacggtcgtcttccccggggagtggccgtggtgacgtggcagagacgtggctaggcggggaacagcggggtaaatgcctgtccatgggctcatgccgcgtatatcctcttgaaaaataggaattcaatatttcatgattgaggctgtgtttagatgcagggtgtaaatttttagtgtgtcatattggatatatgaacacatatttaaagtactagcaaaagtgtccgtacgttgcaccgggtgattacggagtgtgtatattaaccaaaagtgttgtttggtttagcaaaagtgcccgtgcgttgcaacgggaagcgtacatatcagaaaaatatgcaattaattaaaatacaaattcgctgaaatatttgatatttttaagtaggtatatgtgtataattaaataaatttacaagtaaagtaagtgtgagaaataactataattgtaatgcttctgaaaaaatgagcactaaacatgaacttattctctctttttttcggcccgagggacctaaaatagacttattttcggcccttaccggtcggcccacggccttttgcgcacgcgtgggctcacttcccctccccaagccgcaacctgggcttgagccagaaaagtggcctcactctcgatccctcttgggccgatttcggcccggatgacaccggccgtccgatttctagggttttgatcggacggccgagcgtcgatatcggggaaacaaaacccccttcctctcagccgccaaaaccctagcccatttccctcccctccctcccatttcacttcggcgccctcccctccgtgcccccgagcggtggcggcacccctccccccgtgagcgggggcggtccgcggcggcgccctccctcccgagcagaggcggcgccctccccccgcgagcggcgatggcgtctcccccaccactggcgggccggcaacgtcctcccccaccaccggcagcgcggtggcgttctccccaccaccggcggctcccggggaggtgatcctctcagtcaaagccacggcggcgcccctcctcctctccctctcgggtcggcggtggcgggttggtggcggccgcgacagatccgagggtgggggcggcggctccctccaccccctctagcctccctcccgcggcagatccggtggcggctggggctcccttctcccctctcgcctccctcctgccccagatccagcggcgatggcggtgtcgatggcgtcggcgggtgagtccgtcggcggtggcggcggctccctcctcccctctcgcctccctcccgccctagatccggcagcgatggatccggcggtagtggcggcgtcagcggcggcgcgcccaccccccacagcggcgtcggcggcaccctcccccaccaccggcggcggatctagcgggaggagaggtgccccgcgagcggcggcgatggcgccccttctcccgcgagcagcggcggcggcggagtcctctcccaccaccgacgacggcggcggccctctcccctaccaccggagagcgccctccgccgccaccgccggcggatctaacgggagggaccggcggtggcggcgctctcccctccaccggatctagcaggagggaagccgccggcggccagccgtctctgcgacggcaatggcgacggcggtggtgacccccttgatctaatttttggttttggtttggatatatatgtgtacatgcatcatgatttgtgtgattgaactccgattgtgattgttatttttttccggggtttgattggattcggattgggattttgggggagggggggcgacgaagcgggacgaaaaaccagtgtgacgaccggaaaaattcgaatatttatattagttatagattaaacatagactaataataaaataaattacagatttagcctgtaaactgcaagacaaatttattaagcctaattaatccgtcattagcaaatgtttactgtagcaccacattgtcagattatggagcaattaggcttaaaagattcgtctcgcaattttatacgcaatctgtgtaattagtttttttcgtttatatttaatactccgtgcatgtgtttaaatatttgatgtgacatggcgaaaaattttgctagaggatctaaactttttcgtttatatttaatactccgtgtatgtgttcaaacatttgattgctaaggtgatttttgaaactcatacagattaagacgaagcttaagtgtttatacaaaacgagattgtattaacgtataattaattgagtttaattaagtattacaaatttaaaaaatatatttatctgatattttagaataactttcatataaaattttttttacacaaaacataccgtttagtagtttgaaaagcatgtcatgaatatccaaattttcatccaaccattccaaagcttacttcaaaatatggatcttttgaccacgccattccatccaacgtggcaatataacatcgacacgtcaccacaacgggcgtgatagttttatcttatcacgttagtcagggtgacgaggccaaataacattgtcacatccgttaggccggcgtgaccaaataacgatggaacattaggcagaccggcatgacagtatgcgtagctaaaagattcaaatttttaaaataagttttttcaattgtttttttaattaaaaataaaaaggttcaagacataacaaaaaaatccacgctcaggcctcacgcagtaatgccgtggtacgtgcactgacttggcattctagagcacagcgtggcatgcgctatccccgttcaaataccccaatgggtaaatccggtccgtccacgtgtaaaccggctcgggtcgggctcgccaaaccatcgacagaagcgaagccgggtccaaccccaccactcgcccagttgtccggcacccctctgacgtggtcactgacaggtgggcccgagagcggtggggtccacatgtcagtcaccacgttccttcgccttcgccgtcagcttttccctttccgaagcttcggcaatctcccctcctctctct

SEQ ID NO: 4494 - DNA, 25500 bp, Oryza sativa
ctccccctcctcctcctcctcctcctcctcccgctttactatattttctagcatcgattcgagatgcggatcgccccgctgtgttctgatcctgatgcggtggtttttggccggcgtcgagctgcagggttgacgagctcgatcgtgctgcggaatggccggctatctgacgtgttggcggagcttcaggtcggtggattgcctgatgtttcttgagtagagtagttggattctgggcatctaattctgttgattgcttcgcgttatcgatcgtaagttgccaatacgctaatataggcgcgtcagtgttgcccgtgtgtgtttcaagcgatgttgtgatttatatatctgtttgtgggactccaatttatcaaatgcattacagctacatttcaccgatcaaacgttgggcgtgcacatgggcataactttttgtcgcttaatttcaatgtcgaatcatttcgatgcaccaattggaatgtcatgcctaagttaatcacccaatggctatgatgatgcgttcttcatctataatttgtagtaactcataaaatcgcagatgtttattgaagtagatggttttttccctgtttttaggagcttatgaaaggtgtaaaccaaggagaaggttcgagtgcctatgacatcgcccttcttcaatctcaggtatgcatcgtttcatatttttcatagaatcaacagttgaatggaagttacaatgcagacttcaatttcaataaagttgccagtttcagtaaaaaccactgcagtttgttgtttttattatttgtgtgctggcgcttgactgcagattcgaaatttagcacaagaagttagagatttgactatatcaaggcctattaccatattgagtggcaactccgactctggaggtttgttcttgtttgatcctctcctcgttctgttttcagtttcactcttctagcagtcatgcaaagagtctatccatataaagcttttgttacatctttttacttagattatttgtcaatcttaaggtttagatagacaattattggcttgtatcagctcctctacaaggctaccaccccttggtgaaaaagtggtcaatagtcatatttttgctaaaactcgttaaagagtgtcaatctctattctctaattcaatattgagtaattcatgaagctgaaatgcttcagcgattacagtatgaatcatgttgattggtcaataatagcaatgtaatgacaaatgggataggaatgctggtacattcagctgtttctcacaacattcatgaacatatctcactagctacttgtccccatgtgacatgtatctttttcttatccgtgttgtttattcactagcatttgcatcccttttgcaggcagtttatcctcctacatactgcctgcagctgcagttggagcaatgggttactgctatatgtggtggaaggtaaaatcaggaatatacaatgccactttgatctatcagcttttatattctgatttttcttccttgctttctttctccacaaacactccttactatccttttccttttattatacttacagccttcaataaattagtaactgaatgaagagagtaatatgatgttccccatttgcttgtttaccttgtttcttgtagttatatgtcttaagaactatgctacctaagtctccctgtaaagtatttccatgcagtcccagtggttctatgtggatccaagtatccaactttgatatataattggcatttggcacccttgtatgtattttgagacatcatgaataaaccacattcttttttttttgggcgggggattaaattgctttcttagtcatgtaataacacctctctgattctgtgaccaaatattctatcaagaatcacagtttcgggttgagagactcttttcatgatccctaggccctagtatttaagtaaaaccatcaaatctgtcttgtcctaatggtgtttgtagactaaattactagtacaatgatgaactgtatgtgttaaacttttcttacattatagtatcttcctgcagggattgtccttatcggatgtcatgtttgttaccaaacgcaacatgaccaaagctgttgagagtatgtcgaagcaattggatcaagtgtcttcagctttagctgtatgctttacatgctgaatcgttacatatttgaagtagttttccttcgcatatgctgactagtgttttctaaattcaattaatttcaggcaacaaaaaggcatctaagtcagcgcctggaaaatttagatgggaaaatggatgagcaagtggaggtctccaaaattattagaaacgaggtttgttgatttgtgatgctgctagcccttcaactttttacacatggaaatttttgaagttcctttttttttttctctggagcaataattattgtttcatttttttcattacatcaagtctaattagcatctgataactttattattaaattgtgtttctacctgaggtgcataactcttattagtttgatttgtgtagtcgcatctgaaaaggtggatcaggattttctttgtcatgccaatattgtttcaagctaaaaactgtgccctcgataaagccaggaagcacttgacatggctattataggatatgcattgaaatatggtggaattgttggcttttactataatcattgacagcatattccaagtgatcgatcttgcccataaaccataaaacaacatcatgaagccaagaatatatacaagcgcaagcataagcataatgatatttgtcatcaatgaatggtctttagttgcattaaaatataccttcttaaaaatagctactgtaaatctgcaagtactcatctatggaaagataaattttacagcatttttcattttcttctcgaaagcagaaaagttttgttcttcccaatgttatgcaaaagacatgattctgttctctatgcacaggtgaatgatgtcaaagatgatctgtctcaaattggatttgatattgcagcaatccaacagatggttgctggattggtgagttttattagtttataacccttgagcatgaacctgtgtcagaacacttctttggttatcctgacctttatgttctcctttgacattatcaggaagggaagatcgagttgcttgataataaacaggtggctaaacatacccatcaatatttaacgtgctgattttttccttttgcctaacctcttgtgtttaccgacaggatgcaactaatgctggtgtatggtacctctgccaaatagctggaggtctaaaagatggaataaatgccaagttttttcaggtgagtagatatcatttataaaggttcaggattgcatgcaaggtctaaggatgccttatcttggatagttcgcttttcttttggctcatactgctcattgtgctgtaatgatccttctatgctctccattccacaggaagctaatgaaaaactcaagctcacagagttggctcagtctgaaagaaaggcagtgaaggtaatacacaattaatatgcagatgtttgtcctccattcaggtaatttcggtttctttatgccaatccatatctgtgttgtgcacattttaggggcttgaatctgttctggagagcagaaaggaacaaaaggcaatcgactccaaacaaaataccaccgcgataattgacgccgaaaagcccgtgaaaacggtcgatgggcctgtgaaaagcggcgcggtgcacaggtgtagcagaatctcatttcggaaggaaggcctcgctttgtgatcaaagcaaagcgatcgtaaccagcccgctctcgcgatgtacattgtctgcctgattgttttgttcgattaaaaaaaatataaaataaaacctgtacctggagttattttgagtaggcaggttgatgcactattctgattcaaaagtgtatgtggttcaatccacgtacgctctttttcttggattttgattcatgtgatctcatttatttttatttggtgtgaatgtttgtacacagttggttcgaaacattccttgtgccattgtgagagttcccttcggcctgcatgcccttgtcccatatgtccatatcaccctgtgaatgatgccctctccttctagtccagatttgcaagcagtctggaactctggatgatcggattttacttgcagacaggcacagggccacggtagtccctgtcctggataaattctgctctgttcgtgtacaacattttcttgtttgctgcacaaagtgtaagccgtgaagcataaacaggattacatgcactagttacgtacacggtgaaaaacatggtcctcactcctcaatgccgtatgccgtatgcccgtatacaccaattactacacatgtacagcaaatcataggtactcacgaatcacaagctggtgacaatcagcacggaagaagaggatcttctcgcctccctggaatgagatccgtacccctttactagccaggacgcgataagatgggagtatatatgttcctttggatgtcagatttgtcggttccgtttgcctgtcgatcgtacgtacgacaggtgaaaaaaagaatcagatcttccgtttttttacagtcgtcaagcagctgcttcttgggttgcattctgtcacggtgtcaccgttgtgccgattcgagtaaaaaccctgtgtcctttgatatggaaagccaaggcgatctagcatgggccatgccctcatcaaaccggatacgtatacgcctccagagacgcacactgtacgttgctgtactaactgtactggtgtacgtgtacctagcgcattactcacactatccaaaaaaaaaaatcaatgttaaagaggcgtgactcctctaccataaatttaaatagatgaagagatttgttgtattagaagggatcacatttctcttctaagtttagttttttttaataaagtaagccatagccaacgtttaaatttaaattattctatgtgttttttattgtcttctttagtctttgcctttaaatcctcaacagcatgtacaagtctaaaaataaaacctaacttttattccattgtcacgcttttttacgggttattgaccggagcgaaataatggcgtacatcttcttctctttcttcttttttctttgttttttttttcaaaaaatggtgagtagctagctagttgttagggtgatcacctttcttcttcgccgtcggtcgctaatataaaaggtggttggctgattatgagacagtcaagattaacaaggcatgataagatacagactcttaatagaggtatggccatttcagtttattcttaattgatgtttgagatatcgatgaagatgaacatattaggtgtactaactcatgatcaacgctgcacactgacagtctgacaaaagcacggatccctatcagtcccaaattaacatggccacgcatggatcatcaaaccaaggagatcttacgcctacagatgcaggcagaaagtcaatgtgttgcgcgaagcaagccgcagatttttgaaacaacagtgctaagctataattaacgaggcccatctgacacagaacaccacgagatactagaataatacatgatggattaagaaataatgaagcagctgagatgcatacaaccgaagtattcaagggctagctagctatctgaacgatccaaacactgttaatatttcattttgtgtatgtgttttttttactgatatcataggagtatctatcctaaaagctagcgtcaaagctaccaaccattcaagtctcggacaccaattctcatgacatatatctcggtgccaacaaagtcaaaaccagcagctcaacaacacagggggcacataggattagatagcttgattaaagaaatcaatggtgacgattatagtagtaatagtatagtatgatagtatgatgctgtgtaaagctagctaattagctaaaccatatcaagttggagtaacgatccatctttgttgctgggagtagctaatttcgctgtgccgcacgcatgctcgggaaaaagaacggatcccgaggccactgaattccggacggtttggtcaaatgcctctttggttgggcctgaaggtttcctaccaatgccaaagcgtgcagccattggccatgggagtattggattatggccgtgtttagatttcaatttttttctttaaacttttaacatttttgtcattagacacatgcatggagcattaaatgtagataaaaaacaattgtatagtttgcatataaatcgtgttataaatcttttaagcctaattacgtcatgatttgataatgtgatgcacagtaaatatttactaatgacggattaattaggcttaataaattcgtctcgcagttgacagacggaatctgtaatttgttttgttattagtatacgtttaatacttcatgtgtgtatctgtatacttaaaaaaattttgacacacgaactaaacacagcctatattgcttcataatgacaccatcattatatatactgatatgtgtgataataggaggtagtgacccacataccaatgactgtaatgatgctgatgttatgatagatgatcctcacccgtattggacataagagcaagtttaatagtatagttaactactagctccaattcatctatagccaatctaatagctcattcacacaatagttacatactacactattaatacctggtcccatctgtcatacacactgcgtcttggagtccgtgctacaactagctacaaatctgtagcccgcttctcttctctcatctcatttatcttcttaaaatatatttgcagctggtttatagtctgctattatacctgctctaagcttcacggtcacagtaaaaaagaagtttcttattggtctatagaggctctttgaaacaaacacaagtatgttaaaaacgcataagaaagggataaatgtacgagtagaacgccatttccaacttgatctataggactccaacacgcataaataatatttggagctatatatatggagcacatgattttctttagaattagtttattttcaatagtaaggaaaaattcgtaagagcagagagagtgagagagtgcattggggttatgatatgaaaaattccgtacggaatggaggtatataaaataaacttttaggattttgtcaatcatattctctcgtgcaaaaggacgatctgaaaattgaaaaaaaaagaatgaccttatagaaaaaaatcccaaggattgaaatcgtccaaattaaatttctgaaattcaaaggagacctaaaattgtatacatggctctaaaagcatgtcctaaatataaaatttggtagtactatttaagaatttgcatgcttcatttggaaggaaattaggttttctttagggttcctttggagcgtatgaattcaaaaatacagaaacaggaaaaatgtaggaagacgtggcatactagctagttgatccataggagttttagaatgcagaaattgtgtgtaacttgttgttggatgctccatagaaaaagtataggattttgggagagagatagacctgagaaaagttctcatgagatccaaccctcatgttaagggccacattgagggctccttcggattgtaggaattttgtaggaaatatggatgatttcaatttgtattgtatttggcactattcgcttgtttggaatgaaggatttgggcataggaaaggtagagggaaattttcctttgctagagattccatatgaattcgaacatctaccaagccctatttttttgttttcatttattagctaagtccaagctaaataaaataatgaaagctctaaagaaccataatttgaggataaattgaccaacgacattatgattcttgtgttttactaagttcatatttgttctaaacaatctatcttactccctccgtactcgtaaaggaagtcatttaggacaatgtttaaatcaaaccataggaatataaatcatgaataactctcaagttgttgagtttgaaaatataaaaattatatgaatagatttgtcttgaaaaatactttcataaaagtatacatatatcacttttcaataaatatttttatagaaacaagaagttaaagttgtattttggagaccgtgtcgctgtccaaaacaacttcttttacgagtacggagggagtatatttttcctacatttttcatctatgttttatatttatacatgcaatcctatactccctccgtcctaaaaagaggggtttataggttttagatttgtcccaaagagtgtctttttagttgtgggtccactagacctcttaataccatttcatcctttttatttatattctgactttctataacaacagtcttattggatgaagttttttttcttatttctgtgttttaaaggagccataaatatatgatttatgaaggatggcaatgacccctgcatgtacaaagcaccgtaccgacactagagctagggcatccctttcaaatttcaattcggagctttttctctcatgtcattatcatgaattcgttgattgccaaagagttagattctgttcacggtacaatataccacgtgggataaggctccaaatgctcacaggctcacagcaagatatatggtttttaccccctaactatgattagatcaagtgatgctattttggtgtagccttgagattaaattgtaatcctggtgtagagaccaaaagtagttatataccttcaatccttcattattagaaaaaaaatgcaactaaattgaatatatacgcgtattcgtacaatgtattactcgagtatgcagttaaagaaaccactctaatggaaaggattcagaaaattttggagagcaggcaacattcagcaagcagtacagaagaacacagcagaattgtgtccaggcctaggcgcctagatactcatgcactagaatgaatatataatcaaaatcaacaagtaccattaggttggaacttggaaagaaaaagaattgcatcaaaagggtgcaataatagaaagtacgatacaaatatataattacactcgagaattgtagtagcattcgtcaactaccaccaaatcatgaacttctcccaactgaacatcaatggtacgtggtaccggggtgcaatagtcaagagcgaaggctgcacgctaaaggcacctcaaaaatccaatgacaaaaaagaaagcaaagacagattggaacacaagtaccagaatatatggcagtactaccacatatttttgctacattaatggttctttcaaggacaattgatccatgaaccatgatgaatctaaatgcagcaccgcaaaatctgaccggaactgtccatgatctctgtaaattatctccttctctgtgcgttaattaattaactttctgtcagacgaacatactagcactctgagtgcttaccgacaccgaaaagaaacagtagtagtgactgtgcaaaagcagggattcgaacaacaacaacaacaacaacaaacacagatgatgagatgaattggacatacattaattcttccaatagctacgtattggttagagagagagagagagatctgaaaatgcataacaatctagaaggaaggaatcaatgcagatatacagtgtgactgtcgtcttagcatgatcttcattgaccatctgtagcagaaactactactagttaacttgcctagctaaaaaaaccgaagtaattaatcaacctcaagagttaattaacaacagagaaaacacatgaataatgcaaccgtttcttttttcttccatggagaggaaagctaaaggaaaggtagtacttggaacagcagagaaaatgcctggctttcccttgtatgccgcattgcagcgccggccgtcgaccgaaaacccaccaccaccatcaccatcaccaaaactcccctccatatttcttcgcctatatatcgatcctccctatatcctatcttggattcagctcaccggccggccatcccagtgtcgccggcgactcctgcgatcccaacgatggcattgggccgttgctgctgctgctgctgctcctcctccacaccctcctcatccttgctcatgagagtagcgaggccgtggaagaagaagaatggtctctctctctctctctctcggtttctctgcgattttatgattgctgctgctgctgcattggaataatactcggctttcagtgggttataaagaggggggagaaaaaaccgggcgcgagcgatcgaggtcagcagcagctgcacgggggcatgtcctcgcgcgtgccagcggcgtcgggatccggaccgcgcatcaatgcgtgcgaacgaacgaacgaacgcacgaacgaatgcgtgcgcagcgtgcgtggttgtcaaacggaggccaacagccacgttaaatatcgtagcgtgacaggcaggggcagggcaggggcaggggcaggggtggattattcgcggaatgcgcgtacgtcgtacaccgatcgataggttcgtacgcgcggggcgcatttggtagagatggatcgatcgatccgtcggtgggatgagaagattacgtttgtttgccacatgagttggggagtacgagtacgagtaccgtggaggtattatgtactgggtaccgacgctttgatttcgctgcggggggattaaagagccgggtttacatggggccacgttaataaagagagagggcgaggaggaggggaaaaaaaaacgccttgtcagagaatgaactcctccaccagtgaaccgtgaggtcccctttgtgagttcggctggaggcagcgggtgagatttgagggcttggtgagcggagctgtgtgatcttgatggggttaggcccctccaagacgatgagacaaaaaatatttatacaggttcgggccgctatgaagcgtaataccctactcctgtgcatgattgattgaatgtagaacaccagtgcttggggttgcgagacccaagcgccagttcgctcggaagtccccccctccaccactaggcctggacctccttttatacatcaaggggttaccacatgggtctaacaacctaacctagctccggtggagaagtattataatatttgcattaaatgcatgtcttgtctcttgacttgggaagctaagcacacgtcatcttgatgatggagcctgttaaatcttgccgcctgacacgggggtgcccctgtcagtcaccatttaatgggtgaagacttctgagctcctattacaccgggaaacgggagccttgcattgaccagagcgggaggaccgactccggctgggataagaggatgagaacctctcaccatcattatttgatgggatatgtcgggctgcacgtcgcctgacacacacgatggtgcgcctgacatcttggtccccatcattcattcgatcggtcacagaccggttgagtgcactgcataccgcattaaatgcggcgtggcgcgaccgcttggaatgccataaatccgggtaggtgggcacctggaggcagacacctaacccaccgtacgtggtgacctagagagggggtcgggggagcccgaccctgttaacagtgaaatttggtaagcccggagtagtcatcggcttagagtcagcatcggcttcgaagtcctgagattagccgatgagagttgtcaagtcgtcagttgtcggattcttgctatattcggttaaggaaattgatctactaaaggaagcttatccataagaaaccgagttcaaagagaatgcggcatggcaagttatctattaattaggaatagtttgttagtttccttttatctttaggaaagtgtgtttagtgtcctataaggattttatcttttccttttatctttaggaaagtttctttcttgtccgacaaggacttgtatcaacccatgggtataaatatgtatactcggggtctatgtactttcttatccgacaaggacttgtatcaacccatgggtataaatatgtacacccggggtctatgtagtttatcgctacgatcaatataattcggcgcatcgccaccctttttacttctacttttgttttttacgttccggcagaacttggcacccaacgcagggctgcatcgtcttcgatctccggcgaagggataagtccaatgttccgtcggtccaggcaattgtctcatctacatcggcgtcgttcaaggctgcatcagtatattcgacctcttggattgctctggtttggatgatatatttgcctacctatttatcatgtctctgttaatctagtcttagcatatcaatttagctctatcggctgtctctcgctttagggtttctgccggtatcggctaaatcgcgttgctatattagattagcctaggcatttaccaccctgaaaatcagtcaacgacttgattgtctagatattgtgtttcttttcatacttagtgttgcattagttaagtttgatctactaagtcgtgcttagaaccataatctctagcatgcttattgattgccaataagggattcatcggggtttcagccggtgagttatctggacgttgcatcggctcataaggattgcatatacatataagttggatttagccgatggcaacaaaggtttcattgtttaatctaatcttgtggatttcatgacatcggacctctagccgatgggtgctttaaccttcggatcaatacttgttctactatatcatattgttagccgattggtttatacaggattatattgctatattacatcatcattagccgattgcctttatatcagtatctacatttgacatatagccgattgcttaaaccctatcgctatcggctggtatcggcatcggctattatcggctatcggctggaactactccatcggcttgtcagccgatcggctgtttgatctattatttgcaaatcttgtcagttgcaggattaaactgactggcacgcccgcatctcattaatctttggacctgcacaggagctaagcagatctcccaggccggtgtgttcgattttttcttcaacagacccctagtcatgggagggggcggccgacgcccgacctcgggcctgatcccccctcggggggggggggagccacgtggcgcctggggcgggcttctccctctagtctcggccagggagtggccggcgccctaccttgggcccgacccccctcgggggagtaccacgtggcattggagggcagcctcctccatccagtctctgggaaggagtggtcgccgccctacctcgggcctgactccccttgggggagggccacgtggcatcggagggcagcctccttcaactagtctttggggaaggagtggccgccaccccaccttgggcctgactcccctcgggggagggctacgtggcatcggggggcagcctcctccctctaaacctgataccccgggcccatatcaccgacagtagcccccggcgttagccctgaccaaaacttttcctaggtggtcagggttgacgccactctgttagtcaaatgacatgtgggcccgatctcttattctttctttgctggcactaggacccatgcgcctttttcgccctagcctgagggcgattcgctagcccgtaccttaggctgtgaacttattttctgtatatattcagcaaacgttgttagattctcttgggcccgtgtctttacgccgcgtacctcgcttgctcctgccatttgttaatctctgttcatgttctacttcatctattcaaacgattattttcgcgagtgtgaggactgaactttccctaaccagcaatcttcactcgcgatcaagctaagctgggcgccgtagccagccggcagggccaaagccagctgctacggaagagctagcatagggggccccaggcgtcgacggtacccagagctcgacacagggctaggatagagctaggaatcgtagcccccgcactttaagcaaagaatcgtttgaatggatgaagcgaatacaaactttttgttaccaagggaggcaagccggcgcgcgacacataggtaccgcgggaccgtgaggaagagataggcgagagataaatataagcaataataattctatgcaaacgattatcttcgtgcgagtgtgaggactgaactttctatagccaacaatcttcgcctgcgatcaagtgaagctgagcgtcgtaaccagctgacggggccaaagccagccgctacggaagagctagcacagggggccccgtgcgtcgacggtacccagagctcgacgcagggctaggatagagctagaaatcgtagcccccgcactttaagcaaagaatcgtttgaatggatgaagcgaatacaaactttttgttaccaagggaggcaagccggcgcgtgacacataggtaccgtgggaccgtgaggaagagataggcgagagataaatataagcaataataattctatgcaaacgattatcttcgcgcgagtgtgaggactgaactttctatagccaacaatcttcgcctgtgatcaagtgaagctgagcgtcgtaaccagctgacggggccaaagccagccgctacggaagagctagcacagggggccccgggcatcgacggtacccagagctcgacgcagggctaggatagagctaggaatcgtagcccccacacttatagcaaagaattgcttgtatgaatgaagcaaacacaaacctttagctcgaagaggaccccccaccatgggttccgaaccatcttgggaagcctgtgaccacttagcaaacgaggtcaggttcccacgagcctgtgtccccacgctacacattctgtttgctctttcctttcggtggcctgcttccaatctcttttccttctacatggacgattactttcgcatgagtgtgagagccgaaaactctagagccagcaatccccatccacagttgagccaggccgggtactgtagctagccggcgggaccaaagccagccgctacggaagagccagcacaaggggtctcgggcatcgacggcactcggggctcaactgaaggctagaaaacttagcccccacacttagcgaagaatcgttcatgtagatgggagagaggttgggctcttaccaccgagggagcaaacaaatgcgcaacacgcgggcgtcgcagggccatgagaatagaatggggggaaacaaatataagatttcaagctaatgaattgaaaaattgaaaatacttgaagcttgaaaggacgatcagttgagcaggccggacaccgtagccagccggcaggaccaaagccagtcgctaaagaagagccagcacagggggtcccgggcttcgacggcacccggagctcaaaactgcaagagtcctcctaggagtgaaccgaggcggcagcaggttcatgggccaaccccgcacttggcccctgagggccatggggaagacgttcgccatgacccggtcgccacccctcgccgcctctatgatcgccatgcagatctggagggacttggaggggtcggcgccatcatcgtacttctcggtgaggtagggctggagctttgggggccctcggacattccgaagactcgccacaaagacctggtagccaagcttacccggtggggatgtggggggccttgccccctgcctggggtggcgcgacactccagaggatgctgcgccttcccccgtagcggcggtgtgacactcaccacgccggcgctcgaaaaaacctcaaaaatcacgaacgcgccccctacctggcgcgccagatgtcggagaatgaactcctccaccagggaaccgtgaggcccccctttgtgagttcggccgggggcagcgggtgagattcgagggcttggtgagcggagctgtgtgatcttgagggggttaggcccctccaagacgatgagataaaagaggtttatacaggttcgggccgctatgaggcgtaataccctactcctgtgcatgattgattgaatgtagaacaccagtgcttggggttatgagacccaaacgccagttcgctcggaagtcccccctccaccactaggcctggacctccttttatacctcaaggggttaccatatgggcccaacaacctaacctagctccggtggataagtattataatctttgcattaaatgcatgtcttgtctcttgacttgggaagccaagcacacgtcgtcttgatgatgggtcctgtcaaatcttgccgcctgacacggggggtgcccctgtcagtcaccatttaatgggtgaagacttctgggctcctattacaccgggaaacaggagccttgctttgaccaaagcgggaggaccgactccggctgggataagaggatgagaacctctcaccatcattatttgatgggatatgtcgggctacacgtcgcctgacacacgcgatggtgcgcctgacatcttgggtcccatcagtcattcgactggtcacagaccggttgggtgcactgcacaccgtattacatgcggcgtggcgcgaccgctcgggacgccataaatgcgggtaggtgggcccctggaggcggacacctaacccaccatacgtggtgacctagagagggggtcgggggagcccgacccctagtcacgggagggggtgaccgccgcccgacctcgggcccgatcccccctcgggaggggagccacgtggcacctggggcggccttctccctctagtctcggtcagggagtggccgccgccctacctcgggcccgacccccctcgcgggagggccacgtggcattggagggcagcctcctccatccagtttctgggaaggagtggccaccgccctacctcgggcctgactcccctgtggggagggccacgtggcattggggggcagcctcctccgactagtctttggggaaggagtggccgccaccccacctcgggcctgactcccctcgggggagggccacgtggcatcgaggggcggcctcctccctctaaacctgatacccccgggcccatatcaccgacacgcctctttatctgatctccgtggtggataaaaagagtgtccaaaccggctgtaattttatagcccgcttctcctctttctcctcttttttctcctccaccttagcatttagctggcttatagcctactattatacttgctctgagtgatgggaggctactgcgtggactagcgaagcaccgaaggctccttcgaacattaatactgctggtcgcctaggagatttggaacaaaaggaaccgcagggttttccagcaaaaagagctcttgacgactagcctaacagccaaaattaaggaggaagcgataaaaaaacatgaaccttggcgggcgcgaagcatttcgaccaaaggccttgagcctgcacattttttttattcttgcgtcttgtgcctgtacaattttactcatgtattccatgaaattggcggttcgccgattcgttaaaaaaagagaatatgatgaatatgtcaaaaatcataaatctagaaacaaaaacagttgtaaaatctaattttgattcattgtagctcaatgtaagtactacatccgtcctaaaatatagctatttctaacacagtgtcttgtcccaaaatgaagctatttttccacctacctcctcctatcaaccaatcacaaccattctcattcacattccttttcttttcaactaatcatacacattctccaatcattctcacatacttttttaatacccgtgccaacctaaaaaatgtctacattttaggacggaggaagtactttgtaactaagtttaagtgctctataaccaagtatataaaagtgctctgtataggaacacgaatcttgatgtaaaggtgaaaaattgaaaggcaaaaacctaaaaaatatatcgtactaggtaaaatagcaaaaacgaaaacaaaaagatgaaaaatggagacggttcgttcttacatgtagacatgtagtactagtgtgtagtgtaggcttgtggtgaactggtgtggtgacctttcgtccctgctcatcaaaatctttgtcctggaaaagcgtggaaaagcacgcgtggggtgatgccgtacaccaatccttaataccctcccaatgcaagtggagtactgcatgcaaagttgcaaaaaccactactgcaccagacaccagtacccgaccatcgatcgccaggataaatctctttacctccccactggaccattcattgtctgtgtttgcttagctctgatgcaatatccccacacgatccatcgatgatgacaaacaatggcccgggctttgtttgatgattagatagcatcgcgccccagttgatgttgatcaacgatgccgggtccgccgcgcagaggggagcgcaccaccaagcagcttatgctgctgctgcccagatcgatcgatggaccacaccccctctaccacttcagcagttcagctcgctgcgccacaccacatggatgggcgtcttggctttggctgtgtgcgtgtgggcgaggctgcctagcgtagagacggacggcgagcatttccagcgcgtggtggtgcgcgcgcgggcccggtgctctcacgtgcgggtcgcgcgggcgcggagcggccggggttggtcgtacgctggcgggaccgaatcccacaacatcggcccggctcttgctccgatgcctcgtcgtcgtcttgtccgcggcttccattccgtttcagggggcattcaccgctgcgcccatctcgatgcctgctgctgctgctagattgtatgtcaataaattgaaaaaatagagttttaatacacgacgcactcagctaaaccggcctatgccaaggaaggaagaaaacaaagataaaaaacaaagaaaggaactcgaatttgctgctgctgcagcgctgctactagcgagtgcaacagtagtacaacctagactaaccataggagaaaccatttcagctacagtaagggtggagctagaacgaaatgggaagaaataacactcacttgctttactctattttaggctgagcttagtctgatatgagcgtctgagtttagattgaaggggtacatatatgataaaaatagatgaactataattttaaaaaaaattaaaaaaaattattgatcaggttcctgggcaccgccactcttcaatgtagctccgtccctgagcagtggtaagctgtatgagagaggagagaagaggaaaggagagacaaagtgagagcggacgatgagcattggctttgcgagaaaagtgatgagtgcagagggagtgaactactctctccttcccaaattgattattatactatatattatgcaccaagagacaagaccaaggccctgtttggttctatgggctaattattagcccccaccttttactcctgaattagccctcaatgatccaaacaggtgggctaatttgaggctaaagtgaattagccccccttaaaacattagcccctccaaggggtgctaatggggctaattttatgtggggaccataaaaagcagttctctctctccctctgtctccaccttttagccttgaattagcccatggatccaaacatactaccctagactaatgtttagcctaccaattcatgactaaacattagccctgggctaatcttctaaacaggacccaataattatttaaatcatatcaattaagacatcatgcacacattctcccataatgtatgcatcgattaaaacacaatgccaatcacaacttagcatgcgtatatttttccatgctacattaattgtattctgatgaaatatgtgtccatgcggttatataataattaatttgagaaattttgaattccattatatgatgatcaatttagaaaggagggaatacatgtgtgaaaggaagcttaagttatttaatatgatgtgaagttggtgtgccgagcattattacaatttacttattgtattcataagttactaaaagagttacatgtgagttggataaaattgaagcagctgcctactctacgagtatcgacctcactctacgagaggctggaattagaaaacgagccgagctatacaatagagaatctggtaagcaaccaaatctttccttttcacggagcagcccagccttcccttttcctccgttttctctaaggtgtatgagaaaaaagaaacatactcaactaaataataccccactgtaaaataaaataattggatgtaaaatatcctactactctatccgtttcgaattataaagcgtccttatttaaaaaaaatcaaaatcggtgacttttgactaataatcaatatctacaacaagtattacatatgttaataataagattgcattttaaaatactttcatgtaatattaactttatagttgttgatgatataatatgaaataaattaatggtcaaagtatgtcgttgaagactgtgtaaaaaatataggccttataatttatacttcctccatcccaaataaatacagctttacactattcatgtttaacgtttgaccgttcgtcttatttgatttttttttaagattagtatttttattgttattaaacgatagaacatgaatagtactttatgtgtgtgtcacgcccggaaattcactagtaatttttgaacttatttgtgcgtaaaattctcatccaggaatcagccgagctacacaaactgacaatttaatatataaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaaatgcacaaggataccaaaggatggcacaatatagtctcatttgcgaaagcagcatttagcaaagagttaagagtagtaaaacagtagagtaattaattagaaattttaatcaacactgaacagcacacccatgctgcacaggcccaaccatcctgaacaaccatacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagcttgcgaaccggtccttaattgtcatgagcacgactctcaaaaccatatgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacctagtgacattcgaaaataaatgcacagttgaaataaagagagaatttaaatataggatcaacatgctcaaaggattgtgtttaggatctatgtgactttccttgcaataatcggtcttcaattaatcttctgaacactcccgacgcactcacgaaccttcgcaacgatggaaacaacaagctaacacgcaaaacgaagaaaaagactaataaaaaccaaataaacagtacaaaaacaagcataaacagtacatataaagtaaagaaacatgtagatcatgattttagatgaatttagcaacttgaaccactcaaaaccgagttacgatgatttagttatgaatttccgaagattaaatcggattaaatcctttatataggttttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccggaccacgggagacgacgacgatgacgtcagcggtgacgtcatcaccggcgacgactcgggcacgcatgcccgccggcaaacgacggcgcggcggcgcgaaaggagagcaccaaaacgatgcgggcgacgcggcgaactcaccggtgaccaaaacaacggcggaagatcaacggacagcaacggcgacgaggaagaagcggcgacgaccttcggcttgacgacggcgatggtgttccagcggtcgacagcgacggcggaggggcggacgagatcggcgacggcttggtgtcacgccccgaactagtcccgaccggaactagcccgtgacgctccaaattaacctgttaatcgataccagtcgcagggaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagtaggatccgcttcatcttcttcagcaactgggggggaaattatttatatagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatggcaaggcatttccaaagccgacacaggtttaccttatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccatacacccggtacgtttcccggtccgcggttttggaaattcatttagttcgcaagcaccgacccaggtgtcgggttttccaagtcttttgtaaaactccagttttacgcaagttgttactcagattttaagtttgaaggcgaccgtcgatactggcacagggtgcacgaatatcgaggcgcaactggatgattacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcgaatataggctcaagatgtccaaaggtggcttgccttgcttgagatctggagcttgatcctcgaaatcctcgctctgcgggtcttcgggctccgaaactatacgcaaaacgggacaactcaacaaacggcgaaaataaagccctattaatgacctctaagcatgccattagatagatctcgagatttgagaaattttggaatttgaacggagtcaaacggatttacggttgggaagatattgaatttctaagattattggatttttggtctaaaggaaaaggatttaattaaatccttttttttttggaaaagaaaaagaaaagaaaaggggagagggagggaatatagacttccctcgggcggctagggcgcggcccgagagaaagggcggctcggccgagcttaacgggccggccggcccaagaaggcggcccagagcggcccaagacgcgcgcgcgcgggagggaggagagagagagccggtggacagggctcaccatgcgcggtcccgggtgggacccgcttgtcagcggctcggctcaccgtgcggagggagtacgcggctcatgcgcgcgggcgggggagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgatgacccggccgcgaatggacggcgggcggcggcggcgagcggcggagcgaaccacggcgatacggacaaaagcgagcacaccgggcggttgctcgtgatgaggggagacgagccaacggctcggatttgccggaggaagcttgacggcggcgacaaccggcggaggggggggaagagggaaacggcggcgaggccacgagggatcgattcccggcggtgagagcatctacgcggtttcgggaactcgatgctagcgtcggattggacggagctacgcctagcgaggctggcgacgtgtgggtgctacggagctcgagcggcgacggcggcgagcacacgacgagcgacggcaacggtcggggcggcgccggctaactacggggagtctactcgagctactaccgaaagctagggggaggagatggagcgaggaggaagaacggagggaggcatcacc

SEQ ID NO: 4495 - DNA, 2863 bp, Oryza sativa
cgacccccgggggaggcaaaatagacttttgcggaggaatttgatttgaaaggattggattcgggattggactcgacgatagatcggggattgagatcttgagatggcacggacactagacaacaagcaaagaaacaaatttcacaattagggtttttaagagataattttcccgctaggcgccacgacggaacgggcgctacacttggcgatcccgatggcggctttcccgagcgacgacgacgaccggagcgacagcggcgcacggctggacgaacggcggcgacggcggcgcaaaagctcacggggctagggcgctacagacggcggcgggctaaggcgagagtggctgcgggtagaggggagctcgggggtccttttataggggcaaggaggcggcggcgaaggcccacggcaaccggcgatgcgaaggaaaggttagggttcagagagagagacgaatccgattcgagatcgaatccacgagtttccaaaccgaattaggtgatgattctaaaagagaaaaggtagaggagatcgagaagatcatttccgcaaatactctcccgaggcatcgagtcacctacacatgaaacaaacaaagaaactgtcacatcctgatttttgtttcaggatttataaattatttaataaattattattagaatttatattaaacgttcattaatttacaagtgaagttaaatgtgggaaataaaatttcctaaatttaaagcatggatggatttaatttttattaaattctctatgattaagtatactctctgaaattttctcggattttttggagctcaattcctaaatgatacaaagaacagttcagtaattatttgatcattaatgatctaattataattgttaagagcttttcttgtttgaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaattaaaaaaggtttttaaaagtctcttttggctttgggcagaaagccggcccaaaacctctctctccctcggcccagtcggcccagtccggcagcagccacccgcgcgcgcatccgcccgctgacaggtggggcccacctgtcagggctgtcttcctcctccagccgtcgcccggccgaaccctagccgagccgcgccgcgcgccgcctttcctttttcgctcgcctatttcccgatccggtgaaatcaatagaggggaaatgatcttctcgatctcctctaccttttctcttttggaatcatcgcctaattcagtttggaaactcgtggattcgatctcgaatcagattcgtctctctctccgaaccataaactttccttcgcgtcgccggtcgccgtgggctttcgccgctgcctccttgcccctataaaaggaccccgaggttcccttctaccgcaagccctttttgcattcgccggccactgtctgtagtgccctagccccgtgagcttttgcgccgccgtcgccgccgttcgtctagccgtgcgccgccgtcgctccggtcgtcgtcgtcgctcgggaaagccgccatcgggatcgccaagctgtcgccgatctcgtccgcccctctgccgtcgctgtcgaccgctggaacaccatcgccgtcgtcaagccgaaggtcttcgccgcttcttcctcgtcgccgttgccgtccgttgatcttccgccgttgttttggtcaccggtgagttcgccgcgtcgcccgcatcgttttggtgctctcctttcgcgccaccgcgccgtcgttcgccggcgggcatgcgtgcccgagtcgtcgccggtgatgacgtcaccgctgacgtcatcgtcgtcgtctcccgtgctctggccgtggaccgatagatctcggccgttcgttttggttggatcgatctcggccgttcgtttccgtgagccgccgccatgcacccggtccaccatgaacccgacccgctgacgcaataatcctcttttccttttcaaaaataattcattattgcgtcataattcaattaaaatctatataaaggatttaatccgatttaatctttgaaaattcataactaattcattgtaactcagtttaacgtggttcaagttgcaaaagttatataaaataaagatctacatattaaaattatccataaatagaattaaatttatttaattctttttaaatgggctttaattagattaaatcttgtaaaattcgtaataaattcatatgaagtcagaatgaggccgttcaagtctcataattcatctaaaattatgatctacatgtttgtttattttttatgtactgtttatttggtttttattagtctttttcttcgttttgcgtgttagcttgtcgtttccgtcgtttcgaaggttcgcgagtgcgccggaagtattcaagaagattaattgaagaccgaatattgcaaggcaagtcacacagatcctaaacacaatcctttgagcatgttgatcctatatttaaattctctctttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattggg

SEQ ID NO: 4496 - DNA, 4238 bp, Oryza sativa
gccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtatagccgggtatggttgttcaggatggttgggcctgtgcagcatgggtgtgctgttcagtgttgattaaaatttctaattaattactctactgttttactactcttaactctttgctaaatgctgctttcgcaaatgagactatattgtgccatcctttggtatccttgtgcatttgcatatttgctgtgtggcttgttaagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacatcagttgattcctggatgaggattttatgcacaaattagttcggaaattattagtgaatttccaggcgtgacagaaaccatattccgagaccaagctattcccaacttgactcattagtagcaaacaacagtattacatacgtatagaatccatctagaaaccataaccatgaaacaatcacggatatccaaagaaacaacccgaaaccgaaaccgactcagcgtcggccggtcagaccgcgggcctggccggtctgaccacacacatagcaccggtctgactggcaacctccacccggtcggaccggtcacataaaataacagtgaatccgatcatcacctgaaaattgattatctccaaaacatgccaattgtttatcacagaataagaattaaaacacacattgatcttatagcgttttcttccgtgtttggtttccgatgtgattttggagccacttttataacaagtatgtccatacttattatactatgttttgtcacatccaattctaggtttgtttttttacagaagaagtaggcacttactttatatctaaaatttgtagtactatagtatgtaatatccaatattaattttatttatttcgatacggaggaaatattattcagttctgttttttcaatcggtgaacccaatagacccttaacataccgcacttgactttgacgtgcattacgacctaatttgattttgaattttcgaatatgattttttataagtaattttaggtagattaacaagcaacgaaaatgaacgaaaattactaagtaaaccactgaaatcaatctgaaataaaattttaaaacttatatgaagatttgcctagcaacaccttagtttgatgctgatggcattaaacgggtatgcagatgcccatgctccagagtccagagggctattagtgcgtttaatttccatacctctctgttcgtgcgaatatgatagttgtggtgtagatatttttaaataatgaaataggcgtcatgtgtagtgtagagatatggcatatgtgaaaaatgtgtcaagccgtgctcttggaagtataatcctaatcaataaaaacagaaacttgcacgactgtacgatctccagttctcctttgggagtaactagttggtttgagttttgttttttaatgggtttgatttgattcattgattgtgatgccctttaatcattgtagtcttataatgtcgtcgtactcacccgtgtttcatattagacgtcgtttcaaccatttctactaattattttttaaagtttcatcaagtttaaaaatatatagcaatattttaaacacaaaacaatgatattattaaaaatatattcaatattacatttaattaaactaacttagtgttatagatgttgctaaattttttctataaacttgattaaatctaaaaaaaattgactggataaaaatagataaaatgacttataatatgaaacagagatagtacggtgtactttactcctttagatgttttacagtcatacttccatgcggatattttccttgtaaaattcatgttgagcatccaaacaactcatttgacaaattacaatgttttaaattttcatataatagcatatgccatgacatttaattaatatgtttttcttctttttttgtgactttctactcatgtgttcgaaaggagcaccaaatcaaacagtccgcaccgcacgttaatactgctagtctcgcgagggatttggaagtaaatgaatcaagaacctttcagcacaagtagctctgggcaaccggcctagtcacaaagatcagggagaagcccaagggcctcagaaaattggctacttggttgactagtcactagctgggtttaaggatctagcttttacttttgggagtatctaaaataccgccgcaaatttttttagtgaagaacttttagaagtaactatagtataatagaaatataactgtattgtaattatactgtaacctatataaaacttgtatttaactatgatttgattgactatcatcgggattttacacgtgacatgtgtgataattttttctagcaattttttctcagtatgtacaaatctcgaagcgatccgatgactacaaatctgcaagctttgagagaaaacttacggaagttttctagcaattccgttactttttctccttttccttactgtacagtttgtttatattgacgctcctccattcgttttgaaaaaaagaaagaaagaaagaaaggagccctcaaccggcaacggatggttcacccgaccagcccacggcccgcgcgtgtcgctgcctctgatcccgcgcgcggcagtgataaacttccgggagtttgcacatgggcctccgttcgcggacgccacaggccacagcccctgtaacagccacgcaccatcatctccgtccctttcgcggaaaaaaggcccccacggcctcgtaaccgcgactgtctccgcgccgcgcgcacgacaccgccggtgtgcgagtggatgcacgaggcgcgactcgcgagagacggctcggcgccgacgaccgaagagtcgacgccggtgttcgcttgcttgcttgctgctgctggtggtggtgatttccgtagtaaagttagtatggagccatcgtttcatgaaacggtatatttgtaaacgaaaaataattacttacgtattcatagcgatccaaaaaaaaaaggctaaacaataaatttcgatgaaaaaccttagaatcaactttaaatttaagattaaaaatttaaattttggctgataagtataatcataagcgaaaagcgaaaagataagtacctagagttataagggcttgctgtagtaaagttgacttgagaaacgtacttcccgagtgtttcactgactgactgctactaacatactcttactccagtagagaaacgaacacatgttcaaaaacttagactaataattcacgagtcaaatggggatcgaaccgaagatctgaactagtgagaacattaatttctcaccggaacagaatctctggacacgcaaaaaaaactaaccgcatgtgaggagacgagcacaccatatgctcgtcgcacatggttggcctctaaatttctacggacgatcgacacgccaaaggcaagcgaagaatccttcaaaatttcgaacataaactacgtgttcctatagtcctatctgtgaatctttcaactcggcacaaccactcgccaatgacggttcatctcacacttgttgtttatgccaagatggaacaacctcatcaatcatcagtgtactgtagtagactgaacatatcttaccatgacatggctcacgtggctggtggtggtgagcatcaatgggagtgatttgaaatgaatcatttcgtacatggaagggactgattcatcaaagacctacactgtcggtcacaacggagtactcccttcgtctaaaaaaaaaaaagtaaccgaagatatccctccctagtataacgaatttggataaattactaggagacggagggagtagtagtgatcttcctttccttcttgaaaaatcaattatagtagtacgtagttgtttttctgaataatgaactagtgaaatgtcatcgtcaaacagaggagcagaagagatgtagtagaaatgtaagagaaa

SEQ ID NO: 4497 - DNA, 8803 bp, Oryza sativa
ggtgaggttcagcgtgtacggcgcgccggcgaacgtgttcaccgggttgagctcgctgagggtcttgaactcggccagggagtagaacttggggaacgcgtggtacagcagcagcgtcttgagctggtcaccggtgaggttggaaaaggtggactgcttgatggcggcgaacgccgagtccttgggtacgaagatggtaacgccctccttggtcttgttcgcctggctctggaacgtctcgatgacgttcgtcttctccaggtagttgaggaacgtgtggatcggcccggccacgctgaggagctcgccaggttgaacgtagttcggcgccggctccggcgccggagccaagctcggtggaagcgaccccggcgtcggcgccgccggcgggctcttcttctgagccaatgccggtgacggcgacgatagaaggacggctacgacggcggccgcgaacatggctgctttgaactccatcttctcttctcctctgatcctgatccctgagatcatttaagcaatgtacattgtacagtgatcaatgcaagatgaattttcttgatcataaaaaccaaaatgtttgtttgttttttggctgagatctatctgtatttgaactgaactgcttagtgacatcacgatcattagatctagtttaggtggtcacattatagtagtagtctgatagtgtcacctaccaaaatcaggacacatgataaactggttgcttcaacaacaaaaaagatacttatgtcttttagatctcagcacagcacaaagacaaaaagagaaggaccaactaccaaagctgaacattcaagagtctacaccaagcatacacaacaatcttcgcttcgacttaaagaaaaagagataccctcatgtgctaaaaaaaatcttaatttctcaagatcattcaagaattacatatgaaaaagatcaaaatataccataagcataaaagtacattcaacaataagtagccccaagctattaaccacaatgactcaatgagatgaaactatgaaatttgcaaaaggtaacaacaactccaaattgcattgcaaatgcaggggagaattcagattctgcaaacctgagcagagcaggggaaggagaagagaagagaagaagagggcaactggacggcaaagtgttgagacttgaggggaggggatgctatatagaaaggttggtgtttgtgtggaaaggaagagaataaattatgagattcatatggggggtggcggctgttgcggccattgcattgcaggtcagtaggcaccaccacgaccacacctctcaaccaagaggtgcataatgaaagctggccaggtattagctgcccttttctttctgtcctagctttcttccctccctgttcttgagtaaattgcactgcttgtttagtgttagtaccattattaagtgcttgtagaattagttttaagtttttgtacctcgtgcatatcgtgtacggatcaccgatacataagtgtacacgataatttccattctgtttgtttcgatttatttgagagaaatagggtagcatttatctcacatttactgataaattcctcttcacatttgatgtttgtaatgttttgccttttcttggtgtatgtaatatgggaacaaatggcgcaaacgtgtatttttcgcactcttttttttccctggagtgtgtactgtctggccaagatactagttttaatgtaaagtccaacttgtaattgtgcagtgttgtatttctcgcaaatctgacttctcaaaaccaacttgcaggctttggcattttttaattgttcttgttcaaaactgtaagatgactaatgtaatttttctattcactgtctggcacctagatccattagacaaacaaaaatattttagcatattttgcaagtacagatgcatgcaggacaaagaagattgcacaatgtactgagaagtaagggtgtgtcctcaaaggtcagagcacagaaattccaatttgaagtactatctgcagtgaaagggaatcactctttgctggagctcagaccatgtactgcaaacttcagaagacactgatgagtatagtatagaagttgattatcaaggctatttctcggaagaatccaattcagcttaggccttagggtatcatgtgtggtttataaatttgacaacgcaaccaatgctccatttctatcaaggattcccccaacttgcttgatactcaaagtactaagaccaaactcattttttctccttaaaggaaccaaacatagaacctttttccatgaaaaaatgtggcaaactgctatcagctagctttttttgcttcccgataatgatatttccagaaaagaaaagaatacatctcttgaatagagttcatgttaaagtataatcacattaaaaaggtacgatagcttccatttctagtcaccttttcaactgcaccctatgtgtaactggcagcttttgttgcagattaaacagaaaatgcccggcgacaaattaaatattgtacacttttaattttcatagagtattgttgtgattaattgtgtacttctttcttgtgaacccccccccccccccaaaaaaaaaagcagcaaggataataaaatatactgaacatagtatataaaaattggattcgaataattggaaatcataaccgaatgagctatttgagctgattttgtagtgtcggtgagatgaccacttgactcgtgtgatggcctgatgcagcttgtatctggtgggattaagcatcttcccttgcatcaaatgtagaataataattgttcagcggtaggtaacaactcgttaatcatccgagaaatgaaaactcatttcatgagctgtcattgccaattaggctttaagaaaaaatagatttcgtaccgcttcgtcatttccaatcaagtgagatccttaaaatccattgactacaaaatcgacggatctgacagcatattggaattttcatatctatatcgatgactcagttaaaaattactaccgacagaatgatttttattcctatataaaaaaatataactttgtgtacagactatctccaatacatttcaacaatatcatatcttttgtgcatatcaagctatattgagctttcttaattaatatatcacattgtggaaataaaattccttggaggccagcaggttataattaatgaaaccaatccaattttcaacttgtttttctcctttccaagaaacgtgaacattggttaaaatatactatttcttccatttaaagtcattctgccaagaacagagcccttgtttttgtttcttctagaactgcagtaagcaatgcactactccttaatattaaacaatcaatgcctacttcaagattatactagtactcactactcagtagcataaagtcaccttctcctttcactacctctgacttctctaatgaacttgaatagaacagttgttttaagtggttgctgcccttatggatcacttctagttaacctacccccttaaactgtagggtgatgcaatccctgagaacttcgcatgtaaccttctttctctttttgactatccccaaaatctttaacatcatattcaggtcacattacggccatcagaaggaaacaaatcactaaacaattactacatctcctaaataatcgactctgcattttcgtagcagggatgtttgtccacatgaaacatgattccttcccatcacaccgaagaaaagcattgcatttgatagctttgtttaatgaatccaagaccagaaaaaataaaaaaaactaatactatgtgtttccattcctgcatgcagatgacgatgccttattcttcagcatggcaggagatgtccctggaatgcaattattgtggactaatgacacgataaccaccggaaaatgaacacgggaaaaggagaggattgacgtagaacggggagaaatggttgtcacgaagcacacgctttgctggacaaacatccacatctgccgccatcgttcaaacaatgcatccatccacgcaaagaaaaaggcaaatcgaaagcaattttctttctcttgcaaggcatgccatgcctgtcaattcagacttcagagcatcaaggaagcaggctattgggctcacagatttttgggctttggggacatgggcttttgcagtccagttctatttagtaggccgtgtccgaggcctacgcaaatgcattccaaatttccaatacagcccacgtgcataaactttcgtggcccatttgtttcctgcccgttttccctttcccttaggaggcccgttggcccatggaatttgagtgggtttatactagcctaacacgtacactactaatttttgcataaattttatacattaaaactttatgtataaagggctggtttggtttgtggcctaaattggccttaccaatttttggtaagttttggtatgactaattttgagaaggtaaagttgtatttggattgaagccaaaatagcctaagttaactattaaaatggcatattttcttaggcatgccaaaatttggctttaaaccaaatagacactaaacactattgaaattgccaaatattggtaagccaaatttaggcttaaaaccaaaccatcccaaaattatttgatatatgcactttgctaatgaattttagaagaattttaaaacaatttcaaaaagaaaaaaatatattctatgaactttctattgtggcgtctaaactaccctacgcacacttttagggcgaaattgttttaggggcaaactgtgccaaaaaaaaacaagatgcgtggtagacatttcattcattggcatggtttaatgcaaacaattttggggaccaaaatttaaaccgaatattttaaatataaaagtcaacttgaaacaatttttaactgaatatgtatgcttttgaattgacaaattgtaattttatgccaaaagcacatcctatcgggacccacaaacaaacccaaaacgataaataatttgtgaataaaacttttacctacgtgttcttaacgacctaaaagtaaaggctgaaaaataaacttcgatgaaaaaaaaatctcaaaatcagctttaaatttaatattaaaatttaaattttggttaataattaaacataagcatacataaaagatggggccgtaggagtcctattcgttggtcaccgtatgggcctcacatgatgagagtacatgggcatcatagaaacttcttgaaatcgagagaaaccagtggccgatcgaggtgatgtctgtcggcagaccaaccacaaatcggcacaagtttaaggagtaaggaccatcggtgtggtaaagtgggcttggcacatgctgtttcatttcatggtatcctctatctcgaccaacttgctgctgatgctgctgcttgcctgcttctgccggacgcctttcctcaaagtgatgaagttgccaaacctgatttgagctacggaccaaagttagcttgccaattactccctccgtcaccacaatataagagtttttaagtttttgcttacaatatttaaccacttgtcttatttaaaaaatttgtgtaaatatgaaaaacgaaaagttatgcttaaaatactttggataataaagtaagtcaaaaaaaataaataataattttaaaattttttaaatgagttaaatggtcaaacagtataagtaaaaactcaaaatcccttatattatgggacgaagggagtactatttggctcaactgcaactgcacgtactatattcacatgctaacataagctttgcgtaagtgcttggttttacaacaataaatgaaggaaaagttcttcgcttcttctgcctctgcagcaatgctatgtttaatttaaccacgcacagagcaaggcgcagattcgccgcgtcctgtcaatgatattccaactcactgtcactgtcatatgatctgcaacctgcctaaaccggcccgaatccatgggcttcctctccttttctttatacaacagctagcgtatctccctcgaggcgaacaagaactttgcttacgtttagcatttcttcacttggcgaaaaacaactcgtcaacattggcacatcccacagcatattaccaggccaaaaaccatgcgcaataatctgattaattaacgcgttgtagacacgcggattcgacagtataaatagcggcaactcgttctcacatctcgtcaaacacctacaacacctgaaccagctgagagctagccaagaattcgatcgggcgagatgagcgtggagattttggatgggaggacggtggagagcttcgtggaggacgagggggccttcaactcgacggtggacgaccggttcgcggcgctggacggcgaccgggacggcaggctgtcctacgccgacatggccggtgagctgatgagcctccgcgtgctggagacccacttcggcgtcgacggcgccgccgccacggacgccgagctcgtcgacctgtaccgcggcctgttcgcccggttcgaccgcgacggcgacggcgccgtcgaccgtgaggagttccgcgccgagatgaaggaggtgatgctcgccgtcgccagcggcctcggcttcctccccgttcagatggtcgtcgaggaaggcagcttcctcaagagggccgtcgagagggagctcgccaaagctgcctgatcatcgccatcgccatcgccaggcgtcagagattctgcctacagatttgcaggtgtatcgagagatttttgtagtatttacagagtgtatactaatcaagtgcgtactgtcctcttgctgaaatggcatttcagcctttcagctatgtaatccgggatggaaaattttgtttgatctgaattatttggtgtcagcaataaaatcaacgtttcgatgaaacgatttcgagtactacaaacatgatttcagtgggaattgtgaaattattttcgtgttctaaagtggagctaaacgctgacactactctgcttgccacgggcgtcgtcaatgtcggacagcagctgcgcgaacgcggcgcgcgacgagccgccgtctttccaggccatggccgtggcttccctgtgcgcctcgacgcggtctctcagcttccttccttgctcggactccatgaccagcctcaccttcgcctccacctcgccggcggtgacacgcccttccagccatcccttcatctccacgccgacgcccatctcctccacccatgagcaccttgttcatcctctgttccgcgtacagcggccagcagagcatcggcacgcccgcggtgatcccttccagtaccgagttccacccgcagtgtgtcacgaacaccgcggcggaggatgctcggctggggcttccagctgttgacgacgaggccgtggccgtaggtgcggagcccaatagacgaagggggttctcaggcacttggtccaatttttagctttagtacttaccccccctattttcatcacatgggaaacccctcggcttaaattggtgcatcacccgtgacctataaccagtcgtgaaaggtctaaggcccatgaaaccggcgcccggtttttttttttttgggggggcctactgaaaagcgagacgacgcctcgaagcgtcaatcacaaccacgccggcgccgcacaccttctagactcccgtttttcgcttttgtttctttctttttcctaaccgcaatacggcatctgtacggctgtgtgtctgtttgtctttgatccaacacaatctcctctcgccactgctcatcgagtcgccgtctactcttgccactcacactcaggcactcatccgttggtcgtcgactcaccattgctcgccatcctggcctgctactggtcgccctagccggccgctggcagcattacaactaggaccgtatatctgatttgataccttaaaacaaaaatttttgccatctaaaccgagcctaagtcaaggcatgaaccctgaggtgcctcctcttcccgagatagacacactcgttccttctttctcactctttcctgactttctcattccttctctctcactctttcctgactttctcttgtagtagctgacgagggtgtcgtccaccactttaagctaacatgcgagttaaaattcaacttatataattctaaacaaaaataataaatttgatcgtgaattgcacgttcacttcatagtcaaatttgttatttttgtttccacttgtataaattgaatttaaatttgcatgtttgtgaagtggcatatcacatattggtctatcctatcaaatcttttcaaattttttgatgactttttaagtgacatgcaaaaatgagaggatttcccattaaggtatgatttgagttttccggattcctgcatgatatcgttctcaccctgctcgattcaagggtgcagatgtaacgctccgcttttcgtgagacgttaaaaactaattcggcaaaatcctaattgcgaaaatttcgttctttgagtgtgagtttaagtcgtgccatggatctcaattcaatctccatcgttgttccctctcgtcgccatcaaaatcgcccacctcgagattccaattccgattcaagtctccaaatcaaattccaaaattcaagtcctctctttgaaatcctcaccaaattttcgcccgacccccaaaatatccaaaatttccccttttgatcatttcctagacccttcctctcatccagatcccaatccagaagtccaagtcaaattccatgttcaaatcttctccaaatcaatttcttggaagaagtctattttgcat

SEQ ID NO: 4498 - DNA, 12206 bp, Oryza sativa
tgcatgatatcgttctcaccctgctcgattcaagggtgcagatgtaacgctccgcttttcgtgagacgttaaaaactaattcggcaaaatcctaattgcgaaaatttcgttctttgagtgtgagtttaagtcgtgccatggatctcaattcaatctccatcgttgttccctctcgtcgccatcaaaatcgcccacctcgagattccaattccgattcaagtctccaaatcaaattccaaaattcaagtcctctctttgaaatcctcaccaaattttcgcccgacccccaaaatatccaaaatttccccttttgatcatttcctagacccttcctctcatccagatcccaatccagaagtccaagtcaaattccatgttcaaatcttctccaaatcaatttcttggaagaagtctattttgcatccctctattttggatggaccaatttcgcgcgctgccgctctgccgctgcacgccgctagcatccaaaaccgggaggcagagacctccgtggtcaccaccggcgtcaccccctgtccgctgctccaagtcgcgtccttccaaacaatggaggcagagctcctctccctccctgtccccaccctctctccctctccctctctctctgtttctctctctctcccgacgaactcccctcggcgccgattcccgctgctgccttttcgaatttcgccgcgccctcgcgtcgcgcacgcgctcgcccgcgcgtggccgactgctcggtcgccgccacgttagccctggctgcctgcgccgcgcagcagcccatgccgccctgccactcgctccacctgtgcgcgcgtgcgtccaagacgtggaggcagagcctcggctcccctctctcatgcgctctccctcctccctctgctcgcccaaatcggcaaggagccgagctcctttcctctcccctttttgctttttccctctcagcccggccacccgtgaccacctccactgccgccgcttggccgctagctccgagcacgactgccagccgagctcccttgaccacctaagtcggtttcctcccccaaaaccgacttcccgtgcctataaaacccaagccaagctcctcctcctctctatccctctcgtcttcgcctgccgcgccttgtcgccctgctcggctcgcaccgtcgccgttcgtcgccaagcacaaggaaggccggtgcgtgcatggacgtgtgacgaggagctccgggcacctcttcttcccctttcccggccgctcccggagagcttgctcccgcgccgccgtcgctcgtcacggcgccctgtcccgaagcgatagccctccgttcctcttcctcgctcgccctcctcctcctttaactcgcgtggtagctcagttagtgtaacgctccgcttttcgtgagacgttaaaaactaattcggcaaaaatcctaattgcgaaaatttcattccttgagtgttgagtctaagttgtgccaaagatctcaatttaaatccctcccttgtctcgataccctgttatcaaagatcgtctcctcaaaatttccatcccaatgtagtcccgaagctcgattccttctattcggaatcccctcctggaaccccatccgtgaactttgtcgaatgcccgaaccctaactccgtccaaggattcaccttcgcgtcataaactctctccttggttccttcaaaccgattctcaaattcgaattcaacctcttaggttttgattcatctatctttctctctgtattggttcatcaatctaccctgttttctttctcgaacttctgacccaagtctgaatatgcaaatcgagatcacttccacccttgaactctaaatcccaagattcaatccccttcgccttgagttctccccaaaatgatttccgttccgaaataatcttgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatcaaccccgaaattcgaatctagactccaactctaaaacctcccaattaaatctctctgtgaaagtctatttaacctccctcataggttggattccttctttctttttccgatccacctcttccttctcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccatttttgaaatcctctgaaataatccttcgtgccgccaaatataaatccatcccaaaaataccaaaattcccgcttttgaagccctttcttgacccctcccttggatccaccttgaaccctcgtgtacaaatacacaaattgaattcaaattcaatctccacatcaaacttctctccaaatcaaaccttccagtaaaagtctattttgcctccctccaactcgctcgggccgaaaccatcctcggcccatcctcttctttcgccagcctctccatcgcacgtgtgccgcacgtgactccctcagagagcgccctctctctctctctctctcggcgtcgcttcccgccgacaccgcccaaaattccggccgcctccttcgattcccgcgcgcccgtgcgagtggccgaccgcctgggtgccgccatcgccaccctcggtcgtcgcctgccccgacgaccaccgtgttcgcgcttgccttcaaaccgtccccgtccttttgcagtcatcgccggcgtcatcctctcgggcccggcgccccatgccgcatgcatccaaaaccgtgaggcgcggctcgttctcatccctttcctcccaaaccggaaggagcaaagctccctttcctcctcctcctttcgctttttcccctcccgggtagcgagctccctgtcacaccccgaagttctcctcccaagccaaatttaatttgtaaacaaccccaagaaaatgcaggtgcaaatcaagagaaaaccctaagaaagtaatgcaaataataatcggattgggcatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctctttttttttcaaatgggccgtcggcccattttttttcccttccttccccccctccctgctgggccggctgcaggccgaggcccagccaggccggccgccgccctcctctcccggggtcgccgacaggtggggcccacctgtcgggtccttcccccacctccggtcgacgccgcgccagcaaccgccgcgcccgaaaccgccgtcgcgttcacgcctccgcctcctccgggccacgtcgaccacgcccgcgcgtgcgccgcgtttcccgcgcccactcccctctctctcccgctcgcgcccgcgcccgagatggccgggattcgattttcgaatcccgcctctctcgcctcccccactcccccacgtcggccggcgattcccgcctctcccggccacgtccggccctctctctccctatttaagctcccccgtcgctccgtctcgctttttccccatttcacctccctctcccgagctccccatcgctcccgcgctgtgcgcccatccgccgccgccgtttccgctactccggtcgcctctagccgccgctacactcgccgccgcaccgtgccgtcgccgccgttgggttcgcgcggccgaggtccacctcgtccacccctcctccgtagagattcgccgccggagcccaattgatgacgtcagccctggaatatattgcgcaataaatgatttaaggtttttcttgtatagtaataaacatagtgaatcttctaaaattcataactaattcatccgagctccgtttaagcccattcaagtctcaataaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgctgaggtttctccagcagcagagcaaggcaagtcatgcttgtcacttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctgggcttgtagtatagctttcctctagtcgacgcatccaggcaagggtgggcgtgatggagcggggcgggccctgcgacggcctctgtcgcttccggattcacctaggcacgagagggggctgcccgttgcccgctggggacgggggtgaaacctgaggtgtggtgtgcttggctagagggggttatgcgaagggtcctgtcacggcctctttctgatatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttaaaattggatagtttaggtggatggttgggcctgtcgcaacgtgggttagcgttggacagtggatagttgatattgtttaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctatttttcccaaccccagagtttgagtatgtgtcagatggaggtgtctctgaggagtaggcttcgtccgtgccgtcgaggatgcctgtggagtggtgttcccactgcagttctagtcaaggcttagctcctgttgtctttcgtttttctgctgcatttatgtaagacttttatgatgtttgtaagacgtggatctgaatgtcaacattgtcgtttgtgtaccccggctggtcctggacgggattttaatgcacattctgcttgaaattctattcgggaatttctgggcgtgacaagttggtatcagagccaggttgaccgtaggacaagccaaatggaaaaacctaagagccctctgaatccttttcattgcatatgttctttgcaattggattttattccgggaaaattgggatctgttcttgtggttcaaggaaaaaaatcttggtcgctcgtttaagtgagattttttttcaaaacaagtcagtccagggttttagtaaaactgttgagatttattcgtcagtcagttgggatctgatgggtgaaatgcattaggtcatagctcaggaacatgggttgcaaggtatttatgctttatttgttattattagtatgtatctaatttctcattattttatcgttatgtgagtccgtcttatttattcgctctcatgtaaaatgatctatgcataaaaatttcgctcttattcgattcccttatttgagtcttttattgctttatttaaatttggattgagcatgcattgatcctactcctttgtcttccctagatggccggccacccacccaaccaccgcggagaaggcatgatcgactttgtggcagagttggcatgtatgacgctggtggtaggctaccccaacgcgccagagtacacgacgattccaccgctcagtggcgagcttcctcaccgtgttcgtctggaggtccacggctacgtgggtacctgcctagctaacatggtggtggaggcatctggaggcacagcagatcacgcctgtcaggaggcagcatacctgatgatggccagactacgggagcgccacaactacatcttccacgacacggcgtactggtttcaccctcgtcgagccagcagtgatgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaagagggagaacgctcagttaaagggtcttcccgcgccaggaggagtccggatccgcaccacgccccgcaagacgacgactgcacccgtgcgcatccagcttgcgcccaggaacccacctccatcagcagctcccgcagcacctccagttccgcccgcagttcctgcaactccagctccagctcccgcgtccgctctctccttcgctccagcatcagccgccaggggcccagccagaggcaacggaggttggttgtctgctactcccagtggcagccgcgatctcagcagcagcagctccagtggctcagagtcgggcagcggcgagacttatctgccagggtccggaagtcgctcagagggacctggtgacgagcaggaggacgccttcgattccaccgaccgcaggagccgttccgagcattaggctcgttttccattagtttaccgactgtctagcttctgcttgttagtttgtgtgtttaggttgcttgtttggggttagtcgacggtcgatatcatgtgcctatgatatggctgtcttaataaggatttttgcttgctctttaagtgttttaattcagatcagaacaattgcagtttaaattcctatgtaataaagcttagttcctgagcatctgtttttcttcttttcccccgtctgcttttccctccagatggtctacaccaggaatggtagccgcgcaacaggcgagggcagcaacagcgaagagcgcactgagggtgtgcatcccaacagcaactccggcaatggtccgccaccacttcccgagaatccgacgctagcccaagtgatggcacatcagacacagatgatggcagccatgatgcagcagatgcagcagcagcaccagcagatgcaccagaggatgctgcagcacgccgaacagcagcaccagcagtttggtccccctccccctcagtccaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgctagacggggtcgtggcacaaaagaagagggaatttcgggcacttcatcagggcaacaggactgtgacggagtacctccatgagttcaatcgcctcgcgcgatatgcaccagaggatgtccgtaccgacgccgagaagcaggaaaagttcatggcaggtctggatgacgagctaaccaaccagttgatatctggagattacgccgatttcgagaggctggttgacaaggcaatccgtcaggaggatcaacgcaacaagatggacaggaagaggaaggccgctcagttcagggtacctcagggaagtcaccagaggccgcgcttcgctcctgggcagcagggtggacctaccaccatgatcgtccgtcagtaccgcccgttcaaccctagcaactttccccagggcgccggtggcagtcagacccaccatagaggtcagtcaaaccgcggtgcagctccacgcccaccaatggcaccggcacagtcaggcccgcccgcgcaagccaagaaggagactggagcaaaaccagggtcctgcttcaactgtggcgagcttggccacttcgctgacaaatgcccgaagcctaggcgtgccgagccaaggtttatccaggctcgtgtcaaccacgcatctgcggaggaggcacaagcagcaccagaggtcgtactgggtatgttccctgttaactcaatccctgcaacagtactttttgattctggtgcaacgcattctttcatttcaaagaaatttgtcgggatgcatgggttaataagagaggaacttagcacaccaatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaagaggtctctttgaatcagattgaagcggaaatcccagtggacaccgtggagaagagtttgaggaaattggaagatatacccatagtctgcgagtatccggaagtgttccccgaagacctcactaccatgccacccaagcgagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaaccaagaacaaatatcctttgccgcgaatcgatgatttgtttgatcaactgaaaggagctaaagtgttttctaagatagacctgcgatcaggctaccaccagttgagaattcgggaagaggatattccgaagacggccttcaccactcggtacgggctatatgagtgcacggttatgtcgttcggacttaccaacgcacccgcattcttcatgaatctgatgaacaaagtgttcatggaatttttggacaagtttgttgtggtgttcatcgacgacattcttatctattcaaagtccgaagaagaacatgaacaacatctccgtctagtactcgagaagttgaaggagcaccagctatacgccaagttcagcaagtgtgacttctggtcgacggaagtcaaatttctgggccatgtcattacagctcagggtgtggcagttgatccatcgaacgtggagtcggttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacagctgagtgcgataagagttttgaggagctcaaaaagaaattagtatccgcaccagttttgattctacccgaccagatgaaagacttccaagtctattgtgatgcatcccgtcacggacttggatgtgtcctaatgcaagagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaacctccgacaacgaagatggttggaactaatcaaagactatgacatgggtattcactaccacccgggtaaagccaatgtggtggcagacgctttaagccggaaaagttactgcactgccctgtgcatcgagggtatgtgtgaggaattgcggcaggagtttgagcatctcaacgtgggaattgttgaacacgggtttgtggccgctctgaaggcatggcctacgcttgtggatcaagtcaaagcagctcaagtaaacgattctgaaatagcagagttgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctaggatcagacaggcgagcgtcaattgttcgggacagaggtattagcgaaagcggaagagaaagtcagaatcatcagggaaaggttgaggattgcccagtctcgacagaagagctacgcggataaccgttgaagggagctcacttttgaggcaggggattacgtgtatcttcgtgtcactccgctccggggagtacaccgctttcagacgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttctcctcccaagccaaatttaatttgtaaacaaccccaagaaaatgcaggtgcaaatcaagagaaaaccctaagaaagtaatgcaaataataatcggattgggcatgtggaatttttcttgagttctacatgtcgaaattcattaacaggatttttagtggaattttcagagctctagaaataactttaacgaattaaaattgagcaagcaatattttaattccagggaaaatcctttttcctttttctttttctttttcctctctttttcctcttttttttt

SEQ ID NO: 4499 - DNA, 873 bp, Oryza sativa
ccctggaatatatgggcattaaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgatgctccggtgtacttctgtttataaatgctcgctttatgcaaatgaaccacttcagctcttctttgatgattccctgcatcatacccctattccggtatgacttgctgagtacagtgggtagtactcagtcttgctctatttttcccaaccccagagttcgagtatgtgtcagatggaggtgtctctgaggagtaggcttcgtccgtgccgtcgaggatgcctgtggagtggtgttcccactgcagttctagtcaaggcttagctcctgttgtctttcgtttttccgctgcatttatgtaagacttttatgatgtttgtaagacgtggatctgaatgtcaacattgtcgtttgtgtaccccggctggtcctggacggggattttaatgcacattctgcttgaaattctattccggaatttctgggcgtgacactccctgcctccactccttggcttcttgttcaaaaggcagagccgctgacgccgctgcagcgcctcgccgcccccaccttgaccgcacccgctcgccccgcgccaatcctcccgtgctcgcggttcgatttccaccacacgatccaccgcctccaccaccctttgcatcctcgccgtagctagttctcacggcgcccatgaacac

SEQ ID NO: 4500 - DNA, 4635 bp, Oryza sativa
gaattcgagctcggtacccctctgccgccttctccctcaacctcggtcgccgtcgcgcggccaaccccggagcatcgccgccttcttggtcgccgcggccaagaacgccaccgccgcgaccaagggcgccaccgcacgcctccgttcccttccccggcacgcccgccgtgacgcgatgccgcctcggcatcgcgttcgtcgccgtgcgccgctgctcgtccatgcgccgccatcggccttcccatcctcaactcgccgccgacgccattacctcccgtcggtgagctccccacctccctttttccgctgtcccagcactcgcgtagctcgcgtcgcgcgtgctctgtttccgctgccgtgcgcaatcgagagccgccgttggcctccctctcggcgactcctctagccaccgccgttcttgagttccctctctacctccccaagccgctgtttcagccgccggcctcccctctcgccctcgcgtcgcgtcgcccgatccgccgctgccgcgctcggccacttccgctgtgcctcccctgccgtcggcctccctcctctccttgattcccggcgccgccaccttcctcgggcccccctcgacctccccaacccctccccctggccgccgaccttcctcctcgctcccgcgccgtgccgcccctcccgccgccgcaaggcgccgccgcgagccacagcccggcgaccatcgggtcccgcgtcaccgcgtgtgcgccgcaaccccataccgcgtccactgagcccgagcgcgcgagccgcatcccttcccatcgcgcatccacgtcggcatcccggcgagcttcgccgccgccgccggccgtcgtcacgcgtcgtctccccaatccgagccgtggaatcggttcgccttgacctcctctagccaccggtgttcgtcactcgcttcggctcgccgaagttcgccggattccgccgcgcgccgtgagccgtccgatgccattcccgcccctcccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaagtccgcaattgctccctccaattgctcctctctctctctctcaccttcttattggccccactcgtcaatgagtcaaagataatcttgagaatgtctttccaatattccacaaatatttctctcttctataaattcagtaaatcattttatcttattccgtgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcggtccaatcgtccgattgaccccgttctacttccagtatttccgtaaaatcgagatctatttaatggcactattatttagtctaaatagggtctttttcttggtctcttgtttaggtttttgtctgtttgcgcatagttgcggttaccggattttcgtcgatcgtggatatcttgaagattcatgaagcttcgtgaagaccctgagcaaggcaagccacccttgaacatattgagcctatatttgaacttaattatattgcttgcaaaatattatgcattgataggattacacttaatttgtttgccccgtctgaaaggcagaccggtgggtctacccaacttgttgcatctgatccttccattgttaattgttatatcatgttcccttgtaaccatctagttgcgcctcgatattcgtgcactctgtgcgagtatcgacggttgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgatcacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcccttaggtcaccagacgtggccgttctacacgggctgggtgattcgggttagtaatgtcgtgtgggtaaagtgtaccccctctgcagaggttaacaaactgttcgaatagccgtgcccacggtcatgggcggatgtgaggtgattccttagcatagtttttgttttaccctgttttatgaaaaggtgttaaggtttgggaaacctaatgcttgggaagcatttagctgtccgggggacagtgggaccgggtgtccctggaagtgattggtcgtttggggaccactattatcgggaagtttggaaaattggtttggtttgggaaaaaccagatttgaagccaactctgggagttgtgcaaatcttgataaataaatttgttacttctcacctcccgaccaagctgagacttgtctcgctctggttgtggaaagcacacacttagattgttgaaaacttgaaaacaaaattgtttgcaaataacagccttcccttgaagcctgcattaaccacctaagtttccctggcttgctgagtacgaaagtactcacccttgctctatataaatatatatatatagttcctccgtcttgaagaaaagatgaagtgaagcgaagattagggtttcgtcctggttcccagccgtcgcctgtggtgttgggtgttagttcgttggttctgctactgctgctgctgctgttggtgtttcctcgtccgcgtcgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagccttccagtggttcgtaggcgccgctccaagccccgccaccgctcgccatggccttgccgccgtcggcgcccgctcccggaggccgcctctcgtcgccggacctccacggcgcctccccaccccatccgaacccagaaacgaaacccttgagccccggagatgctcccatccctttgaatcgaaccctcgtcgtctcgtcgtcgtttccccctttgctcgccgccggttgccgccaccgcgattcgccgtcgccggctaccctccggcaaatctgagccgttggctcactctctcttgtcctccttgtcgttccaatgtgctccccgttgccctcgccgtcgcatggtgtcccggtgaaactgccgccgtccgccgtccatctcggcctccccttcttcctcctcccgccggcccgcgtggctgccacgtaggcgccacgtcggcgccacctcggctttgaccgaaccgagccagtcagccgcctcctccctcccccaccctcgcgcgcgcggtccacagtgcgccaaccggctgcgcgtgggcccgccgcatctctggtccatccggtgcacgcgcgtgaaccgcgctcacccgaaaccctagtgccaccctcatgcgccgctcccacggtgagccgcgccactgacaagcgggccccactcgggaccccgcaaggtggactcagcccaccggccctctctctcccccactctccccgcgcctccttgggccgcctctccgggccggccggcccattagttcggccgagccgtgcctctcctctcgggccgcacccaagccgcccgaggaagtctaaatcatatccctccaatttctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgaagcttcgtgaagaccttgagcaaggcaagtcaccctttgaccaattgctcctataattggaaaatcattattattttgtttgcaacttgcattattagaatcacacacttaatttg

SEQ ID NO: 4501 - DNA, 19886 bp, Oryza sativa
  unsure (1)..(19886): unsure at all n locations
nnnnnnnnnnnnnnnnnnnnnnnnnnnnnnnnnnnnnnnnnnnnnnnnnnnnnnnnnnnnnctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgaagcttcgtgaagaccttgagcaaggcaagtcaccctttgaccaattgctcctataattggaaaatcattattattttgtttgcaacttgcattattagaatcacacacttaatttgcttggcctcggtttgcgtgccaaaccgatggacctacccagtagtcgcactaactcctgtaggttgtactaccctgattccttgtcgctccacccttgtggtacttcggtatccgtgctctctgagcgcgtgtaccaaatatcccacatacaccgttgattgtcgaaaacttaggaaatgggtttgtgaagccttcaaaacccgacatgtggtgtcggtgtgtttgaaaataaaatgaattgtgaaaactcgcgatgcgggagccgtgcctacgtggcgctgtcccgtattcgcatataaggaccgattcctatgggaaactcatcgagcataatcaaagtgcaatcacaaggtggaatgggacaccctggctaagtaactagtcggttcagggaaacctcgcatgccaatagttgggaacgccggggcggggtcggacaaaccgggttcttggtaaggcaaggacaagaagcttgctcacttaccgatcaaggtggttggagataatttgtgaacgcctaaaatggcctatgtttacgtgaggatttgatccttctatgtggcatgaggtattcctgggtcggcttgggaaaggctttgtcgcgaacctcttacaccggccagtgtctggagtaagttcgtatcttgtgggtaaagtgtacccctctgcagaggctaactaactgttcgaacagccgtgcccacggtcatgggtagatgtgaggtggttcccgttgcgtagatttgtttgcctgtgctttgtgaaaagttgttgtggattgggaatcgtaaccagaatcagcctatgtggcagatggatgacctgagtggtcagaaacgaatctgtgtgattcgggatgtctgcgggcatcatagactaggcttcccgagtggaagcggattgcttagctgctgggcagctggactctgggagtctgcaaaaatgaaaaaggctctgggagccgcctaatcaagtgaaatggctctggaagccgataagtaatgatctgacccgggaggtcggtacattaccatttgagttgttgaaaagcatctcttaagtcgatttgagacgcaagtctcttttcgacccaaacttaaaaagaaataaatcacttagtgatttcaaaaatgatttcaaacaaaggatttgcaaaacaatcttgcctctcttccaagcttgcattaaacacctaagttcccgtgacttgctgagtacgaaagtactcacccttgctctatataaatatatatagttcctccatcctgaagctgaagatgaagtgaattgaagaatagggtttcgtcctggttcccagtcgtcgcctgtggtgttgggtgttagaccgttggttccgctgctgctgctgttgctggtgtttcctcgtctgtgtcttcggttgtattctcaggctgtcctgagctgtaacctaagttaaggtaaataagtcctctatttattttaaggatttgcaatgattcatatttgtcaccgtggataccagcactatatcctgggactggtaccgagatcgcggttttgtaggaagcggttcgcgccgttttttctacgacacgctcctattaggtgccgttgtacggtggtgccggattggggtgtgacagcagagctggcggggtagctcgtgccctactccctccttgctaatcgatttagagtaggtacaatagaaagctatatgccagctataaacacatatcgaggagacgaaagaagagagagatgagcagcgggctacaaatttgtagccaactacaggcagcataggctccaagacaaaatgtatttatgacgggtgggaccatgtactaatagtgtatgaattggttattaaattaactacaaataatttggatccagtagttgactatactattaaacttgctcttaggtgcattctcctccgctgtatctactcgccaactccctatcatccactttgctacgagtttgctttttctctaattcaacaatttatcatccactttgctttctttataatacgatgttgactgtatcaactgtttcttcattcgtcattgaattggataatttaaaataaaacacttaaaacacccttcactacatttatagtatatggttgggcaattgattgaccaactaacagttttgaaaaaacaaaacttttgtgcaggctcttttacacaatgtagaagtttatgtttgcgtttgaggaatttttttcattttttaaacgatgacagctagccagcggccagcagattagcacaataatactatgaaaagaccaaagtgacgtgaccaatggcatcatacagtaacagcacaagcacacactacacgcactcattgttgtacggctaaagaggtgcactggggccgactgggtatgcgttgcccacgggaataaacagcacgacgacatgggtgcctgggtgcaccgatccatgggccctcctagttcccacacccacacacccacacccacacgtcaaagacccacggtttccaaccgagaagattcatgcgcggctgcccactccgcatattccgcgtgaatcctctgctctcctcgccccgttctgcccattttgcagctatcaaccatcgcaaaccaccggcccagagccgcatcatcgtttggcttggatccgcatcactgattcactgcacttcgcccgccgtctgcaaagtcaccgatctgtttggtacttacttgtacctttgctcacatggtcagacacgctatgttatgcgccgacttgcaaaaattccactgctacgtagcacactcacctataaattgcattcacccgcttcacactttcgccaaacaaaaccaaccgaaaacaaacattcctctgataattaagttatattatacttccaaagaatcatcgccatcatgagtgtggagatcctcgacggcaagacggtcctgagcttcgtggaggacgagggcgccttcaactcctccgtcgacggccgcttcgccgcgctcgacaccaaccgcgacggcctcctctcctacgccgagatggccaacgagctcatgagcctccgcgtgctggacaagcacttcggcgtcgacgaggccgccatgggcgccgacgagctcgtggagctgtaccacggcttgttcttgcggttcgaccgcgatggcagtggcgccgtcgacctggaggagttccgggcggagatgaaggaggtgttgctcgctgtcgccaatggcctcgggttcctgcccgtgcagatggtggtcgaggaaggcagctttctcaaggttgctgtcgacagagagctggccaaagcggcttgaaatatacctcaaccggcgagcaaattaattttcacatgtccatttacgattttggattgcttcttattgttcttacttcttgcatttgttgagctatactatgtatcgttttgatatttcagatgaaaacggtacatcgatagaacacttgaaaaatcctgtaccatttttatttctatttcattattataaataatcggaacacgacaactgattaaaaaacgaaaatagtatttcctccttgtcaaaatataagaatttctgggtttcaaaatataaaaattactagctataaatctaaacagctgcatatcaagattcttgtgaaaaattattatatttttgaacggagtagtaagatacaattgggaaattccatactattttcaaccttacacgttgagtaattcagacatgagacgggcaaacgcgacacgcgacgagccaccatctttccaggccatggccacgccatctctgtgcgcctcgacacgctctctaaccttccttccatgctcggactccatgaccagcctcaccttcgtctccacctcctcggcggtcaccagcccttccagccatccctccatctccacgccgacgcccatgtcctccaccatgagcaccttgttcatcctctgctccgcgtacagcggccagcagagcatcggcacccccgcggtgatcccctctagcaccgagttccacccgcagtgcgtcacgaacgcggcggtggcgcggtggcggaggatgctcggctggggcacccagctgttgacgacgaggccgcggccgctggttcttgcgaagaacacctccggtaggagcgcgtcgaggtgttgggtgctggttgcccgaaccacccacaggaagcggtggccggacttgtccaggccggcggcgatctccttcagctgctggtcggactgttcacatgcgtcggcgatgctcccgaagcagaggaacatgacgctgcggtcgggttgtcagtcgagccacacgaggcactgatgtcggctgctctcatcaccggcggcggcggcggctttgtcgaccagtggccccacggcgtacaccggcgggattaccacgccgtcggggcagcagcgcgggtcggcgagagctcgcagcgcccgctcctccagcgacacggacgtgttgatcaggattccgtcgaactccgcctttatgcgcgcaccggcaaaaatcatggcctcgaaatccttgttcacctcgctaatcggcccaaaaaggccagccaagtgagaagccgacatgggtcgaacacccaagaactcgacaggactagtactatctcctcccagatgcttcttgaacccgtcaacaagcagaggagcctgcaagttaacggcgaggtggccggcgttggacgggtagaacatcaagacagggactcccagcttcctcgcggcttcatgggcatgggcgcacgatgcgtcgatgaccacggcatggaggccccgcacggagcggaggaagtcgtggaggtgctcgttgtggcgtcgcacgaggtcgaagtagttcttgaagaactgatcgttgaaggcgagcgagggagggtccgggatgcccgggagcgtgtggaaggagatggtggagctcttggaggagacggcgcgggcgacggcggcgtcgaggttggcttcgttctccatgaccgacgggtcgatgagcgccacggcgacggcgtagccgtggtccaggaagacgtcggcgagctccatcatggggttcaggtggccgacggcgaggccggggtagagaaccaccgtcttcttcatcgcaaacgcaccgaccgggagggtggaatagctcgtcctttcttcgcggcactgaagcgcaacctctcgagttctctgttcttacgaggaactgatgaaatatgactatgagagaaagtgcatcctgatatcctcattatgtaggttttcaggcttcagcaaattttctttcaaaaattatcgaacgtatacagtataactagttgggcggcccacgcaattacgcggctagcacccaaacaaaatcatatattttttaaatatgattttacttaaaatttattaaatagctatcccattgttttaagactttgaaagaccaaaccttatcattctcgtctttctaattatatagtttttaaaagtcacaccagttgctacctcttatgtcatcttcttctttatttgcttactcgatctaccactatttctattcattcttctttaaacctttaaaaattagattttatagtttttagagtttattgtcacgttgggttttatttttataatttttagatgtcccatcaaacgttgccattatactcctctacggcatgtccactatttcttctctttattgtcattgagattttaaaaatcaaacataattatcgtttgggttcatttgtactttctagaagtcctgccaaaccgtcagcggctttgccattgtactcctctacggctcgcccgctgcctcccttctttattgtcgttgtgattttaaaatcgaacatgattattattgggttttttttttactttttggaagttccgaacctttaaaaattagacttgtagtttcattttttacaatttttaaaagtcccatcaaacgatgccactacgcccctctatagcccgtccgccgcctactctttattgtcattgtgattctaaaaattgaacataactatcgttggaattcattttttattttctaaaagtcccgtcaaccgtcggcggctctgcaactatactcttatataccccgcccgctgcttcttctttttattgtcattgagattttaaaaatcgaatatgaatatcaatggggtttttttttttactttttgaagtcccggtaaccgccttacttgtttgcttcacggcctgcctgacgtctctccttttaatcgtcattaggattctatttggtgttttattaaaaatttttatatgtcatatcaactgccaccactctacacctttataggcctgttacttaatttatctcatcatgtgttttagatgttcttttctttcaatagtctttatttttatcacaaactagctaggtggcctgcgcaattgcgtggctagcacccaaacaaaatcatatattttttagtatgatttttacttaaaatttattaaatagttatctgattgtcttaagactttgaaagacgaaaccttatcatcctcatgtttctaattatatactttttaaaagtcacaccaattgctaccccttatgtcatctccttctttatttgcttgctcgatctaccattatttctattcattttttttggaacctttaaaaattggattttatagtttttagagtttattgtcacattgggtttcatttttataatttcgaaatgtcccgtcaaacgttgccattatactcctctacggcccgtccactgtctcttctctttattgtcattgagattttaaaaatcgaacataattattgtttgggttcatttttactttctaaaagtcccgccaaaccgtctgcggctttaccattgtactcctctacggctcgcccgctgcctcccttttttattgtcattgagattttaaaatcgaatatgattatcattggttcttttttacttttaggaagttccaaacctttaaaaattggacttgtagtttcattttttataacttttagaagtcccatcaaacgatgccactatgcccctctacagcccgtccgccgccaattcattttttattttctagaagtcccgtcaaccatcggcggctctgcaactatactcttatataccccgcccgctgcttcttctttttattgtcattgagattttaaaaattgaatatgattatcaatggggttttttttactttctagaagtcccagcaaccgtcttacttgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatgctcttttctttcaataatctttatttttatcacaaattttagttatttataaattgtattcctaattgaaatcttatttttctttttcgaatttcagaattttttttataaaatagttaatatcgtattgtgttcttttaatgtttttattttttattttcaattttagttgttttaaaattgtatttctacttgaattttcttttaattttttctaattttagatattattttatttttattgtcaattttaattaatctcgtattgggttcttatatggattcttctttcaatattgcttatttttaattctgaatttcagctaattttaaattgtattccttcatgaactcttcttttattttcttttgctaatttcggaattatttatttttatttcgaattttaattaatctcgtattgggttattatatggactcttcttttattattacttatttttaattccgaatttcagctatttttaaattgtattcctacttggactctcatttccttttctaattttggattttatattatttttgtttttaattttgattaatgtcgtattagattcttatatggaaacttatttcaatatttcttatttttaattccgaatttcagctattttaaattgtacttctacttggactctcattttctttttttttcttttctttttctctgattaattgtggaatttctagcacccacagtgaacgtggtgcctcctttcaaagctgttttaataatataatagatattagttatttataaattgtattcctaattgaaatctttttttttctttttctaattttagatttttttaaaaaaatagttaatactgtattatgttattttaatgtttttattttcaatttcggttgtttcaaaatcgtattcctacttgaactctcttttcatttttctaattttggatattattttattttttattcaaaattttaagtaatcccgtattgggttcttatatggattcttctttcagtattgctttttttaatttagaattttagctatttttaaattttattcctacttgaactcttcttttattttcttttgctaatttcggatttatttttatttttattctgaattttaattaatctcgtattgggttcttatatggatacttctttcaatattccttattttaattccgaatttcagctatttttaaattgtattctaacttggactctcctttccttttctaattttggattttattttatttttattttgaattttgattaatctcgcattgggttcttatatggaaacttctttcaatattgcttatttttaattctaaatttcagctattttaaaattatattcctacttggactctcacttccttttctatatttggattttattttatttttattttgaattttgattaatctcgtattgggttcttatatggaaacttctttcaatattctttatttttaattccgaatttcagctatttttaaattgtatttctacttggactctccttttcgtttctaattttggattttattttatttttatttcgaattttgattaatctcgtattgggttcttatatggaaacttctttcaatattgcttatttttaattccgaatttcagctatttttaaattggacttctacttggactctcctttttctttttttttctttttcttggattaatgtgggaattctagcccccacggcaaacgtggtgtctcctttcaaagctcttttaataatataatagattgtgaaaactacatcgtaactacctactgtataatataacttgcatcgcatgtactctgatctccgtttattgttatttatcgctttgactttttctattaagttttttcaggtttaatcaagtttatagaaaatgttagcaacatgtataattccaaattagttttatttcatctaacattgaatatattttaataatatatttgttttgttttcactactcaccttgacattttgccctttccggaccgctacctgggtttccagtcatttcggctactgccaatatttttggaggaaatagccgttgttcctgatccttctagtcgggagcttcatatcttcaaggattgggtggagatggcgtaaacaggaaggaaaaaggaatttgaaatccgtcccttcccacggaatcatcgggcttgactttctttactttcccagccccgctcttgtaaaaaaaactcttttgttttgagactagctagtctctatggtttttggaaaactcttctcactctggtctcacttcgaggaatttctcgaaaaataatgctacatttttctataaaattggtgaacataaaaaatatttgactaagaaaaaagtcaaagcaacttgtaatatgaaacgggggtagttttatatataattttaaaccgttagattttgctttgagatttgtataagcgaaaaaaagaagcaaatcatagcgtatgcatacgcgagggagtttaatccgacatcttcacaatgtatcacataattttaaagttatatacatgttacatcgtagttacgtataaactatgtagatgtactgtaataaaaaaagtgactaccaattgatttttcgatagatttgaagcttgaaatattacataattttcaaccaatgaatacaaaccattttaataacaaaaacagaaggacaaccatgtcaaaaatcataagtctagagacaaacacaattgtaaaacctaattttagtgtattgtaactgagtgtatgtgctctataactaagtttaaatgtttaataatcaaatataagtactctataattgagtgtagctacaagttgaatctcaagtaacataaatcttcatgcaagatcctacggataaaagataataataaaaaaacagtagcctaagatctatcactctatggaaagatgtggagataggcccttgtattccttgtctaaaatatacgactaaacaaatttaggccctgtttggtagagctccagctcccaactcctaattaacttcaaactccaactccactagaagctagctccactgggagctataggtggtctaaaagtgtttggctaacttgctcagctccagaaatcctgaaagagaggatagggggtagatagacaatactacccttgtgttttttcactgttggcttaggattaactagtaatttgtccgtgctaacgctacagttatatttagttttatttggcaagtcatataaatggagttttagcaatgacacgaaatagatgtggggtaccataatgttcaacttttgtttcagcaatatctaaatttctatccaacttttttttttagaaacgaacgggaccataatgttcaatgattcatacaaaacaacataatcctgaagctttgctttctccttgagcatgatctaaataacttttccccatggcctccgcttgcctgaaagattgaacaatttaccattggtcaaatgcctacctgctgcaatgttatctacaaatgacaaacaactatattaagcagggatcttgtaaatgctaccaaacacatattttaccacaacttcgatttgagcaaagcgtgtagagatggacatgggtgcactgtaaaaacagtaataacttgagtgccaaacgctgcatttgcagcaagtttcaacaatagagtatatttttttctgaccaaatctttctagaaatctaagtgcagtgagaatatggttgaagtataaaaactaaaaatcaagcaataatagacacacagatcgggagaaattttaaccaacatctaggtaatcaatccccccaaaaaagaaccagatttgagggagggagtctagggtttggggttaccttcttcttgcaccaaatctgctaccccgccgccatattatagctcctgccgtgcgcctcctcgctgtggggagccactcccgctgccaagtgccgccgtgagttctcagccgccaagcccaaccgtcgtgcgtcgccctaacctctgcccaacgccgcccaaacctctactcggcgccctagccgcgagagaggaggcagccgccaccaccgctgccgtgcaccgtgtgccgtcactgctactgccgccgccgccttagtcctcccttccccttctctcttcgcggccttgcggagaagaggcgatgcgcttgaccacggggatgcgcaactcggctcgatgcggatggggaacgaaggggtagtgcggtggcattctgcgtgtaatttctttgaaaaataatgggtagcgctggaaccagttgagagtgaagttgtggagttgcgtttttgccgctccaccatgctagtgtaattttttggagcgatccacaccgctccgctccccgttttgatgaatccgaactgtttagcacaactccagctccaggtaagttggagttgggagctggagctgtgccaaacgggacattaatgtggagctagattaaattttattttaataatctgcacacatctatctcaggtacgtcatgtttattcccaactggaaagatttggactgtaatgaacataactttctagaagtaattattgacactgaatctccatcaatctccatcaatcgcggatgcagccgctttgaatggccttggttgtttgcttgatacggcttatagaaactgagtacaatttttcaagaaccagtcgttattaaagtcataaaacacagagaaaattgtgtgatcttgtagtcatattcaaaacaacagtcctctgtaaaacatttttgaaaatatttcaacgtactggtaggctgagttattttgttaggccctgtttagttccaaaaacatcacatcgaatctttggacatatgcatagagtattaaatatagataaattttaaaactaattgcacagttagggtggaaatcgcgagacgaatcttttgagcctaattagcccatgattagccataagtgctacagtaacccacatgtgctaattatggattaattaggctcaaaaaattcatctcgcggtttccaggcgagttatgaaattagttttttcattcatgtccgaaaaccccttctgacatccgatcaaacgtccgatgtgacatccaaaaatttccttttcgcaaactaaataggcccttagcttttccaactcatccctcttattttccgcatgtacgcttttcaaactactaaacgttgtgttttttaaaaaaaaaattctttacgaaagttgctttaaatagtcatattaatccatttctaaacgaatactccgttgtgtgtgatgattgctgagtagctaatagttaattgatcatgtgctaagtagctccattgcgtgtaggaggcattagttcccaacttccagtaccgagcacaaccttaataacttgactagcataacatctcgtcatctatgcttgttgacttattgggcgcaaaatttaactttttaagttatttttagattttaagggtttagttaatcgaatacttgactatattcgtttatttttctaggactgatcgataagccataacttaaccaattatagctgagctttagcagttactagtatttttatacttgctccgtcccataatataagtgattttagatgaatgtgacacatccacccgacaatatacttgactctttgcataaacatgacatccatcgcatatgaagcttagtgtcacaccccgatctggcaccgccgtgcaacggcacctgaccggagcgcgtcgtaggaaaaacggcgcgaaccgcttcctacgaaaccgcgatctcagtaccagtcccaggacatagcgctggtactcacggtgacaaatatgaatcattgcaatccttaaaataaatagaggacttatttaccttaacttaggttgcaactcataacagcccgagaatgcaaccgacgacgcagacgaggaaacaccaataacagcagcagcggcggaaccaacgaactaacacccaaacaccacaggcgacggctgggaactaggacgaaaccctaatcttcacttcacttcatcttcacttcaaggcagaggaactatatatatatttatatagagcaagggtgattactttcgtactcagcaagtcacgggaatttgggtgtttaatgcaagcttggaagagaggcaaggttgttttgcaaatcttttatttgaaagcattttgaaatcactaagtgatttatttatttttaagtttgggtcgaaaggagacttgcgtctcgattcgacttaagagatgcttttcaataactcaaatggtaatgtaccgacctcccgggtcaacaactcaaatggtaatgtaccgacctcccgggtcagatcattacttctcggctcccagagccatttcacttgattaagcggctcccagagcctttttcattttctcgaactcccagagtccagctgcccagcagcacaacaatccgcttccactcgggaagcctagtctatgatgcccgtagacatcccgaatcacacaaattcgtttctgaccactcaggtcatccatctgcctcataggctgattctggttacgattcccacaccacaataacttttcacaaagcacaggcaaacaaatctacacaacgggaaccacctcacatccgcccatgaccgtgggcacggctgttcgaacagttagttaacctctgtagaggggtacactttacccacaagatacgaacttattccgaacacccgtcggtatcggaggttcgcaacaaagccattcccaagccgacccagggatacctcatgccacatagaaggatcaaatcctcacataaatataggccattttagttttcacaaatcaaactccaaccacctcgatcggtaatctggcaagcttctcttccttgccttaccagaaacccggtttggctccaaccgaccccgccccggcgttcccaactattggcatgcgaggtttccctgaactgactagttacttagccagggtgtcccattccaccttatggttgcactttgattatgttcgatgagtttcccacaggaatcggtccttatatgcgaatacgggacagtgccaggcacaacccccgcatcgagagttttcgcagttcattttattttcaaacccaccgacgccacatgtcgggttttcaaggcttctcaaacccatttcccaaattttcgacaatcaacggtgtatgtgggatatttggtatacgcgctcagagagcacggataccgaggtaccacaagggtggagtgacaaggaatcagggtagtacaacctacaggaattagtgcgactactgggtaggtccgtcggtttgacatgcaaaccgaggccaagcatgttataggagtgattctaataatgcaagttgcaaacaaaatatattgatttttcaattataggagcaattgatcaaagggtgacttgccttgctcaaggtcttcacgaagcttaacgaatcttcgagaaatccttgattgatgaaaatccgcaaccgcaactatacgcaaacaatcaaaaacctaaacaaaagatcaaaagaatgaccctatttagactaactaatagtgccattagatagatcttaattttacggaattactggaagttgaacggagtcaaacgaagctatggatcgagagatatgaattttggaagtttaaatggattttctggacgagaaatgatttattggaatttatagaaataatattctcaagaatattattggcattcgctgatgtgcgggaccaaaggaaatgatttatggaatcttggaatagagaattgatttatggaaaagggaaaaaggatttatcaattcctttggaaaaggaaaggaaggagggatgcgaattggacttcctcgggcggcttaggcgcggcccaaggaaaggcgcgcggctcggccgagctactgggccggtgcgggcccattagggttcgggaggaggggggagaccggccgggtggacgcggtccacctcgcgggttccgggtggggcccatgtgtcggtcgacacagcgcatggtgcggagcgtgcacgtggcgcggggggctagggttagggtcggagtggcgcatggtttggtgcaccgggtggaccaaagggcggcgagccaacgcgcagccgctaggctctccgtggactgagcgcaccgagagggaggagagagcggacccgccttgactcggtctttgctgaggtggcgctgacgtggcacctccatggcatgccacgcaggccggcgagaggaggaagaaggaggccggccgagatggacggcgggcggcgggggtctcaccggagcacggatcgacggtcttcggtcatgggggagcacaccgggacaaagaggcggacgagaggggacgatcccatggctcggatgcgacggaggaggtccgacggcggcggattgcggcggtgaccgttggcggcggcaaaagaggggaatcgccggtggtcaacgagggttcgattcgaggcggcgggagcatatccggggctcggtgaactcatttccggcgccggatggggcaatggacctccaagggaggccggcgacggcgagctacctctgggagcgggcggcaatggcggcgaggccgcgccgggcggcggcgggcattggggcggcgtctatgcgcgttcgggacggctaccgagctactgcgcaagctagaggggacgaggatgagcgaggaagaggaacggagggctaccgcgtcgggacagggcgccgtgaccagcggcggcggcgtgggagagctctccagcctcgggccggggaaggggaagaagggatggcgcccagagtcctcttccgctccgcgcgcacgccggcttcccggcacgcgcaacagcgaggatggtgacggcgacgagtggcagagatggctcggcgtcaatggcgcggtggcgatggaagcgaaaacgagaggaagggagattggagagggggctcgattataaagggggcaatgtcggtttgggggggggaaccgaccttgcacggtcaaggaggaggagctggcggtcacgctaatggccaaggcggcggcaggcgatgacgcgggtggtgtcgggcaaaagtggaaaatggagggggaaaggggggctcaaacgggaaaaggaggagggagaggggagcgaggccgagggctctgcctccatccctgggacgcatgcgcacaggcggcagcgggccgggaggcagcgcgggcacaggcggtgctagggcttgacgcggcgagggcgcggcgaaattcaaaaggcggcggcgagagatcaacgccgggagggcgagaatgagaggggagaggaagagaagaacgaaagagagagagagagagagactctcggcttggcgtcggcgcacgcgcgtgcgccacacgtgcggagcgagggaggaggacggttgaggggaggtgggccgaggggaggggatccggcccatccaaaatatgaggaggcaaaatagactttcacagagaaattgaattgggagggatttggattttggatttcgaatttgatgcttggtcttagggacacaaggtggagtcaaggaaggaactaaaatgggaattgggaacaggtatttggcaaggattcaaagagagggattgaattttcggaatttgatttggagacttgaattggaagagccattttgaggtggaggattttgattaaagatgagagaaaacaacaggatttgaattgagatccacggcacgacttagactcgcacacaaagaacgaaattttcgcaattaggatttttcttaaactagtttttaacgtctcacgaaaagcggagcgttacacttagggatttagttgatggggcctaggactccaattaatttttacatgtaagatgtataccttatatgtatgacgtatgggcccccacaccatctaggaagaaggccccactcatctgttttcattctctaccaagaattgaatcatttactcccatcccctcaatccaattggcaatcaacgtcaaatcaagatggagaagcgaaaaattgatgtgtcctaagctcacaaaaattttttgcgtttccacgaagcctacaatcaccttcaggaggaggagcagcgcgtgcaacaagtggccgcctagacggcggatgagtccccactcacaaacactagtgaaccgtggtacttccttcgactactccctgtttggcaatagcagtgtatcaccctgctcaccaagtcgcattgcacatcatgacagatctgtgccgccacgccctagtcggctaattgttactcggtgtgcctaaattctaaagccctttccattagctatcaagttgtggttcaacgtaatcccttcctcactcgccatcacatcacccgatgtaggtccaagcatagaatgcttacactaggtgccccggtcaatttttatcatgtgccccggccccctagctacctgatttttaatttaacaaaatgtgaaagaacaatacatataattatgtcgatggattatattctaatcacaggatccatacctatacggtttgtctggaggacgtagaggttggatgctataaagagagcaagggagacaatgatttgtatataggttcagaccttttgatgatgggtaatagtcctactcttattgatcggagttgatgttaccattatatatcaatatctcacaggtacaaataggatggaaatctaatccaatttgctagtatatcaacttaaaacttggacatggtggttgatggttagctgttgtctagtttcttgagaatcgactcggtgaatttggaggtggctctagatctctcttcgctcgtattaggcttgccttgtaggtcttgtcttctggtatttatattcccggatgcccttttattcaaatagaactgaaaggtaaaatattgatacaatccgagtagttctgattgggcaacaaatgttttcttgaaaaccgtaaagctagcaaaaccttatcaactatcgaaacattgcaaaatatcggaatagaacctcggatacgttgcacacttgtgaaaagcgaacttcatgttaaggaaattttgcctcatatgcaactattagtgaggattgaaagtaaaaagaaaataatttagatacttaatgaccatgacattgcttaaaaactaatactaacacataaggattacatctaagttttattacatttggatgggctgtctccattgacggttatttatttaaaaaattcggataaaatcagtacatcgatagatgaaaacccatctaacattttcatttcgattatcgatatttcaaaatataggaataatacaatcaatataaaaaatcagtacgtacggttgagaaattatgcactactaccattttcatcgttgtgcattgtccaactcggtcatgagtcgggcgaacgcgacacgcgacgagccgccatctttccaggccatggctgcgccatctctgtgcgcctcgacacgctctctaagcttccttccatgctcggactccacgaccagcctcaccttcgcctccacctcctcggcggtcacccacccttccagccatccctccatctccacgccgacgcccatgtcgtccaccatgagcaccttgttgatcctctgctccgcgtacattggccagcagagcatcggcacgcccgcggtgatcccctccagcaccgagttccacccgcagtgcgtcacgaacgcggcggtggcgcggtggcggaggacgctcggctggggcacccaggtgttgacgacgaggccgcggccgctggttcttgccaagaacccctccggtaggagcgcgtcgaggtgttcggtgctgggtgcccgacgaaccacccacaggaagcggtggccggacttgtccaggcccgcggcgatctcccgcagctgttgctccg

SEQ ID NO: 4502 - DNA, 9846 bp, Oryza sativa
ctcaacgagcgcccgaacaagtccgtcacgtgagaagccgacatgggtggcacgcccaacaactcgaggggagcgctgccttcttctcctcctcccagtttcttgaacccagcaagaagcgaagggatctggatgttcacggcgagggcgccggcgtcgcaggggtagagctcgtaggccggaaccccgagcttcctcacggcttgaatggcgaaaccgcacgacgcgtcgacgaccacggcgtggaggccctgcacggagcagaggaagtcgtggaggtgctcgtcgtagcggcgcacgaggtcgaagtagttggtgaagaacttgtcgtcgtcgaaggcgagcgagggagggtccgggatgcgcgggagcatgtggaaggagacggtggccgagctcttggaggagacggcgcgggcgacggcggcggtgaaggcggcgtcgtcgtccttgaccgacgggttgatgagcgcgacggcgacggcgtagccgtggtccaggaagacgtcggcgagcaccatcatggggttgaagtggccgacggcgaggccggggtagagaaccaccgtcttcttcatcgcaaacgcaccggagtggaatagctagcttcggcactgaatgaaacctctcgagttctctctgttcttcgtacgagtagcactcggaggaacttcttcctgcttaccctcttgttatttactcccttcgtcgaataaaacaaatcagaactgtatgcgacatatgttagtacaacgaatttagataaatatatgttcacattcatagtattaggtgtatcacatccaatacagttgagtttttatagaacggagggagtaggtttcaagtttccacaaattctctcgaaacaatcatcaaatgtaaattacaatgtaatttcaatttacacgtaagtaggatataacttgtacgtagcttttatataattttgaacaattaaatttacttcgagatttatgtaagcagagaaaggaaaatatctactacaacgtgcacgtacgtgggaggattcgatcccacgatcttcattttgtggaagcaacgtgttaccaagagatttttttaagttatatcattattagttatttaaattacaatataattggatatttgtcgacagaaaatatacggctcaaacaacaatactaactagccatgtggagctagaataaatcttatttatatactcgtaatttggacacacccacctcacgtacgtcgatacttgaaaacaacgtatcaggaagattgatctggactcaaatgaacatcgttttctagaaatggagtagttaacactgaatcattgatgacgctcacactcctttaatttaatactacagttgtgctgacactactacattatcgattttttctatcgataaaattgatttttgcaaatgggtgggtggccctctcgccatggccttagcgcttcctttgaatggcctaggtgtttatttgatacggcttatagaaacaacttttttcaagaatcagtcattagactcgtaaatcagagagaaaatgtgtactctctagcatattcaacatactaatcctcttaaaagacatatttgagaatattctacgcatgctagtaagattaataatataatgtctcattatctgttcgttgacttatgagatgtaactaaaatttaaaattttaaactcaattttaggtatttcatcgtaggctatttgatatgatgcatttcttttaaactactaagaataaaaatataataataatccacaaaccattataattttttggtttatgttttatggttgatcgataagccataacttaacctatcaaagccgtatatattagagtggcagtcccattttctaagacattatatttaattatccgcacaaaagaaatcaatatataataaaaaatagtaattaccgttagtaaatttcatactcctaccattttttattctcgtgcgttgtctaactcgaatatgagttgcgcaaacgtggcacaataacgaaccgccatccttcgaggccgtgggttctacatgatcatctctgtgcgcctcaacgtgctctctaagcttgctttcaatgctcggactctatgatcagtctgaccttcaccttcacctcctcaggaatcaccagccctaccagccatccctccatctccacgtcgatgcccatgtagtcaaccttgagcaccttgttaatcgtcagctccacatacagcggccagtagagcatgggcatacctgtaatgatccccttttgcaccaagttccacccgtagtgcgtcacaaacgtgtcggttgtaaggtggcaaaggacatccagctggggcacctgtgtattgatgaaatagccgtatatattttctcctttagatatagaggtgagatttttattcactattaaaaaaaggtattgacaacgatgccctccccaccgacctcgaactccttcggtaggagcgcgtcgaggtattcggtgttggcatcgcgaacaacccatagaagcggttaccaaacttgtccaggcttgtggcaatttatcacatagtaaggtccctttgaattaaagaatttatggagaaatttcataggatagaaatcctataggaattttcctatttggccttttgattcaaaggattagagttttccaaatcgtataaaattcctatagaatagatcattacatgtagattttggaggaaacttagcaaaatgttaaacctcttggaaaaattcctttgaatctatctctctcatccgatttctgtgtttttcatacggtccaatcaaacaactattaccgtgtttggaatcctccgttttacacttatatctctgtcagaattttatgcttttcatattactctttttttttattcctactgttcataggagagatttcaaatgttttgctcgacaggtaaacccttagatcttgtctttttcacttgacatgaggttgcgacaggacgcactgtgccagcatagtcaagattctttaccaataagaaaataccaaagtgacaaacatgaccagggcactaaaaagtaaacagtaaacaatcagtgctcatttgaaaaacaggattttcaacacacaaaatagaagaagaaaaaacagattcaagtgtcgtatctcaaatcctgttggatggaaaagcttagaaaaactataggaaaaactgtttggatggagtcgtatgaaaaatacaggaattacacaaaataacgtatgaaaaatgcaagaattagaagagatttatagatacagagtaacgtatgaaaagtataagaattagatgatacaatgtaaatttttcaagaggttggatcttatgttgaaaaactttcaaaatccttatgatttgagaaaatcctaggattttgaaatgactattcctttactccgaacaaacatgtttataaacattccacgaattaaaccctgcaaaattcctccaaaattcttttgtttcaaaagaccctctaagtaagggcatgtacaatggttgttaatagtggtctcttagcgttgctaattaggaatacttattgatatggaagaaagagaaataggagagacaaaacatcgttgttatgcatgacaacagcttaacaacgactcttaatcactataatatggaaatatggttgcatgagggtaaaaaaatggaaagaatattaacaaatgaaatattttttgagttaatgattaaagcctttatcgactcaactattataaagatatggtctctaaataatcttatattgtttaagagaccatacttgtctctaccattgaacataccctaagtaaaccggggaaactattttaattacccgggtgattagaatccatataagagcagaccgctctcatcgaactttgccgacattgggtgcgccggcgcggccttgtccgttggggtatcatctccacatacaagccactaagcccacagtttcgggccgacgaaatcattcatgcgcgtctggctgcccactccgcatattctgcgcgatatcctcgtcccgtacgtgttgcccattttgccgccacaaccgtcgcaaattcgcaaaccgccggcccggagccaaccaaccaacggaagcatcggttggctccctccactacactgtactgacttcgcccatagcaccggcaaagtcaccgatccgcttggtactgaataaattggtcacgcacgccatagtagtggactagtatggtggtagctcaccatcgccgacttgcaaaaccagctgctacgtccgcgtactttttcgctgaagatcgagcacctataaattccattcaccagcttcactatgattcatcaaccaaagccaaccaaaaacttcctctgctgcttagctaaagaatcatcgccatcatgagtgtggagatcctcgacggcaagacggtccggagcttcgtggaggacgagggcgccttcaactcctcggtcgacggccgcttcgccgcgctcgacgccaaccgcgacggcctcctctcctacaccgagatggccggggagctgatgagcctccgcgtgctggagaagcacttcggcgtcgacgacgaggccgccatgggcgccgacgagctcgtggagctgtaccgtggcctgttcgcgaggttcgaccgcgacggcaatggcgcggtggacctggaggagttccgggccgagatgaaggagatgctgctcgccgtcgccaatggcctcgggttcctgccggtgcagatggtcgtcgaggaaggcagctttctcaaggtggccgtcgacagggagctggccaaagctgcttaaattaatatacctgaaccggcgagcatttaaattttcacacagctacgattttaattgatatatcttgtgttcacaatattgatcattgttatttgatagcctctgttgagctatatttcattgttacttgtgtaactgtgctctttgagatagacaaagataatatgatataaaaaaccagttttgatcaagagaatcggtttgaaagcttgtgtgtgtctactagataccagggtttcatctttcggtttggtcatttggaccagggtgcccgaaatatcgaaatttcagaaatttcggttcgaaattatatgaatttttgaacaaaatttgattaaattaaacaaaatattatcaaatttacaaaaaaaatgaaaaaaaaatcggtcgaaataatgtcgtatctgggttcgatccgaaattttgaacccatgctagctgccaggctttggattctgagcgccacgtcaggaacaataaaatatttgggcctctaactcttcgtgggctgatctgggccgtaggcagacgagagagcccatgacacgatctcatcaattccgtagtggccacgaactcacgtagcgcaaatgccgctcccgtttccgaatcgtgcgatttatctcctttctgtttccgaattttattagtagttgcgatattattaatacaggtttcgtagcggccgcgtctcctcctcccttatataaaggcagcgtttctgcaagttattacccaaatctacacgagagagagatcgttcgacgcatatagagagagagagaggcaagatgcagatcttcgtgaagacgctgacggggaagtcgatcacgctggaggtggagagcagcgacaccatcgacaacgtcaaggccaagatccaggacaaggaaggtaatataacacgatatcaagatgatatccctagcttcttcgtttgcatgttcatcttgtttaatcgttgatgtcttgatgtcgtctcgcgatgatcgactgcacgtacgtacgccgtacatttgctggcattgctcgtcccgttaatttagtgactcatcctttgtttcgtacgtcgtgctcttgtgcgtctagacagtagaaatcatgtgttttgcactagatgcgtggtgggttgatactgccgaaattgttcaatattgtagttgtagattagatcgatttgataaccaaaaaggaagccttgtacttttccattacattacataggtctaagcatgcgtgtgtttagtcgcagtaagcacggagcaacaaatccaatctagccatctgcttatagttcgtcttcgctgtgtacatgtttctattctgtcttagtagtttaaaaagatatgctagtatcttttatctcttgatagggagtgccttcatcgatgacattgctgcataactgtaattaaagactcttttttcttgttttcatggattaatattaacttccgagcccattcgactagctaaaattcattcatatctctttcactgttgtatatataggtatccctccggaccagcagcgcctcatcttcgcggggaagcagctggaggatggccgcaccctggccgactacaacatccagaaggagtcgacgctgcacctggtgctccgcctccgcggcggcagcaggggcggctacaccatccaggagcccagcctcctgctcctggcgctcaagtacaacgagaagaagatggtctgccgcaagtacgaactcatcttgatcctgtttgactaatgctatataattttttttttaaaaaaagaaactttacggaatgcttactaacaaagatctcagctttgaattttaacgcttaattcgtacgtgtattcctgttccacgatgcatcctaattaagttcctaaccgcaggtgctacgcacgccttcccgccaggtctaccaactgccgcaagaagaagtgtggccacaccaaccaggtgaagtggtccttttacttagttttgtcgtcaaagaaatgttttaacgtttttagatagtttgttttcaaaattggtcgtttggttgcatcagtcatgtacacggattcgtgttactccctccgttttatattataagtcttttttagcattgtctatattcatatgtatgttaacgaatctagacatataacatctatatgaatatggacaatgctataaagttttataatatgaaacgaattttttttatataatagatataaaatccatccactatttgtacatgttatttttttcgatttgtatacattgccgtacgttggttgtacggctgacctaatgttgttttcttccatctgaattttcagataaggccaaagaagaggtttatatccaagactgccaactgaataaaagagttgtcatgcatcagttgagtcgaagagtcttcctattcagttattagctcatatgttagcatcagttgagtcaaagagtcttcataaatgttagcctggctgcttatgctatttctgtttgtgagatttggttagaagtttttactgttcaaatctctatatacgcccctacttttctgtttttgagatttggtttgaagtttttacttgttcaaatctctatatacgcccctactgcgagacacctaatttcgtttacggttgcttaatttcctttcttttgcatgaatgttacgagaaactagttagagaagtttgatttagaacctcttatatataatataataggaaacggaaggagtgggcatgttccaaactcacatatataatcccagcgaagactagcagatgcgaagatcaggaataaacctttcgtggtttagctgatttgatcagacctcaccaaaatttctgaaatttttgaaattttgaataaaatttagttgtatttgaacaaatattaccaaaatttacgaaaaaaataaaaagttagaaaatttcagccaaaataataatgtattggagaggtctgaaatgaccgaaatttccaactttggccaagataacttgcccgatctcacaaaagtcaacacattcaaattaaccaaggtcatcaatggcaaatgactaatctcactaaatataattcaacacattcgaattaactgaggtcatcaatgatagattattaatctcagtaagttcctagtgataaaaaaaataatctatgactccagtacacaaataatgcttccgccgtttgttttgctggcaaccccacgagtgcttcccgtttctattgatggcggcgtggcgctagggcactaaacaccatgaacgtttgccataaatgcttcccctgttattttttttgcctcaccatgaacgtttgacatagtgtttcccctgttattcttttctgtaaggctagttcacaacatatgttcgtttgagaatttcggcaggcaaaacaagattattatagtactattagctattactgtaaacataaaacattgatgtggtgtggttgttttttttttcccaaggatgtaaacttgaatttatatatcaaagcgtaatgtcgctctattttgtgcgtgtgtttttttttcaaaaataatgtatcaattccttgtttaatgtatcaattccttttaagaaacatacataaaaccgatccaagtagctattagaactcgattccgctagttgcaacagccacgccacgcctactccgtacttactaagggaatcatgttcaaaattcggctaatcaatccacagaaatcctggcaaagatcaccagaatttctactaagtcatccagatcccaaccgtgaccgactcctgattcccggtatctacacagatcagtgcacgtcaataccgacgcagtcgttcgcctataacattggttgctttccaggcaagtcatgtgtctcatgcccatagcatacgactctctccaaaagaccaaaacccattggcccgtcccacgcatccactagaccaccacgcgccaagctgaagccggtcggcaattggcagctagcgtaccactcgatcaattccattagtaaactctcccctatataaacagcactcgcaagcatcgatctccactcaaattagccactccactccaagcaaaccgagtctcacttactctgagcttctctacacatccagtgctactccagtttaattagcatccgccaccatgagcgtggagatcctcgacggcaagacggtgcggagcttcgtggaggacgagggcgccttcaactcctcggtcgacggccgcttcgccgcgctcgacgccaaccgcgacggcgtgctctcctacgccgagatggccggggagctgatgagcctccgcgtgctggagaagcacttcggcgccgacgaagacgaggccgccatgggcgccgacgagctcgcggcgctgtaccgcgggctgttcgcgcggttcgaccgcgacggcagcggcggcgtcgacctggaggagttccgggcggagatgaaggaggtgttgctcgccgtcgccaacgggctagggttcttgccggtgcagatggtcgtcgaggaaggcagctttctcaaggtggccgtcgacagggagctcgccggagcagctgcctaaactgaactaattacagagcaaaaaaggagtttcatattttacacttccacgattttgttgtgattcattattctttttagataactagaaggccactctattgagtaatttcattgatacttaattacttatatatacacggaaggatacacggtgtaataatgcattagttttttcatgttattctcaaatcactagtcttttattattattattttgcctagcataaaagaagatagttgatcttgtacggatgtctacgtgaggaaatgaaataccagttttgggattttggattacatcagtaatataaacggtgaattcacaagttgaactccgtgactaaatcaattttccaaattttcttttagaattttactgcacaatttaagaattttttttatttatacttttttttgg

SEQ ID NO: 4503 - DNA, 11082 bp, Oryza sativa
ttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgatcacaaataaaaattttgtatttaggtcccttgccgccctttgagagggcgatttttaaaaatcgcccttcttaagggcggcaggcaattaaatttgtaaattttcgaaacaaaaaattatttttgtaaatattttaataaaaaaatgtataaataaaaaaaattccacaatttaagccgtgtctgcttgggccatatacacggaccagcccaatagccagaagcctgtagctctccatgggcccgtactcgtgccacgtgtcaatcctgtggttcggtttcgtggcggttgcgtttcctcctctctcttttctttttcatcttttttttttcttacgacatttataggtttcgtagcggctgcgtttcctattttccttttctttttctatttatttttatgggatatttcgctttcgtggcggctgcgtttcctcgcccatatataagagcgggtgaccacgactgcggcgcggcgcaccactccaccaccaccaccaccactccaccgatcggcgagagcgcggggagatcgttcgacggcggcaagatgcagatcttcgtgaagacgctgacggggaagacgatcacgctggaggtggagagcagcgacaccatcgacaacgtcaaggccaagatccaggacaaggaaggtatgctcgcaccggccatggtcgccgactcgccgtctctccattcctagccctccccattctcgctgacctgcattgattgctgctttgtttggtgtgctcgatatgctgatatgttactgtgtttgtgtgcaaatctgtgggtttagtggagtttatgcgctgtggatatagggaattgttaaacgtccgactggtatgtacgacttagcatccgaccagtacttacctgctccttgctctggcccacatggagagcagctggctcgttggagtaaattgattagcagatacggcagggtcggacagggtcgaacaatagggtcggattgctgctttgtttggtgtgctcgatatgctgatatgttactgtgtttgtgtgcaaatctgtgggtttagtggagtttatgcgctgtggatatagggaattgttaaacgtccgactggtatgtacgacttagcatccgaccagtacttacctgctccttgctctggcccacatggagagcagctggctcgttggagtaaattgattagcagatacggcagggtcggacagggtcgaacaatagggtcggatgtatagcagttgcaagtttttgtgggtttagtggaatactgagcaaaatgcgtgaactctagtagtatcgcccatccaatgttgctgcttttctaccatttttttagatctgtaacagagtagatccatcttgaaaagcgtataaaaacccaaaaccttccgattgaatagttcctttccaatttctctggaggcgattttttttataactgtcacgctatactgcacggttaactagatctaaaaggtcccctgttttcttgttacaataagcaaaaaagtatgttgttttataatctgattcgaactacttgaatcgattcctaaaacgttctgtatccttttacatgctgtattgatttgatcctccggtagtgttaatttcatatcacgctctgctaagctggaaattgttgaatccgtgtgtgcgcatggtcgaatctctctgctgtttaagctgatgaactgtatccatctctgcacaacccgtacaggtatcccgccggaccagcagcgcctcatcttcgccgggaagcagctggatgacggccgcaccctggccgactacaacatccagaaggagtcgacgctgcacctggtgctccgcctccgcggcggcagcaggggcggctacaccatccaggagcccaccctccgggctcttgcgctcaagtacagagagaagaagaaggtctgccgcaagtacgaactcacgcacgcccccgcccgcccgcaccttgattccagatgatactagctttgcatccgcggctaacatgaactgatttgatttcaaccctgttccatctcctgatgcaggtgctatgcacgccttcccatcaggtctcaccactgccgcaagaagaagtgtggccacagcaaggaggtgagcatttctaaagttcctcttcgtatgtgaacacaccattgttcatgttcttggctttgctttggtctgaatgctggagatgaatttgtcttagatagttgtcatactcctgtactttgtattggaaatttgaaatcgtcattggttgcctccgtgtgcgcttgtcacggatttggaaatttggatagagtcgcatcagtctgaacaccaattcagttcagtggtttgcctttgaattgtgtttattctagtgattactgtgttctgcatcggttgcaatacacgctgtacagtttttttcccctcacaaatgcagagcaagccgtacaattacagtgtttgttcaactttggtcggaaactcggaatgtctgatttgttcccatttctattattctttttcagctgaggttgaagaagaagttcatcaactcgctttcgatagcgtgaggcactggaaagtgttcaccagctgaatcaatctcttggatctccgtgtgcgcagctaccatgttatgtccagtttagaagtactccgtagttgttaatctcttggaacttcgtatgcccagctaccatgttatgtccgtagtctagaagtagttgtggtacttagtacgcttgagagctctgggttgttgcttaaagaagttgtaaccctgcgaagctgcgactgggatgttgaaccctctatcatcactctgaatgaagaagttatcgttactagtagtaaatttttaatctcctcccttttattcatgctgttctggttgatctggttatttaactcgttgccacatctgccaatgtgatgaactgtttgcaatgacgaaattgcggccaactacgtatgaagcattgagcaacctgttaatcggactagtaaatctagataaactattttaaaaaagggttaatctataattatcagccgacatggtagaatctagacattccaattgaaaactggcaagcaaacactatcagaatccagcagagtccaaccgggattgactcttgtggtcacgagtccaacagaaaacgcgggcgtcaataccagtgggctaggctttaccggtgcatctaaccaccgacttcttaaggcatcgtcgtccatcatttttgccgcttttaatgaaaccaggtgctaacacatccattggtttagaggcaaatcatggcgtagcacacaagtacacagccgaatcttccatttgaaagtgtaaaatcatcaacaacgccgaaggcagtaggggttgggaacattgcactggaaatgccccataccatgttgccggtcatagtggctccaaaaccagctgctacgcctctctatataagtagaagttacaagctcaacatttgctcaaaccaaagtactagaacaaagacacaaacatctctgatacaaccacattttgtagcactcatctgctacacaccaaaaacatctctgagaccgccacattttgtagagccggcaacatgagtgtagaaatccttgacggcaagaccatcaggagcttcgtcgaggacgagggcgccttcaactcctccgtcgatggccggttcgccgccctcgacaccaaccgtgacggcctcctctcctactcggagatggcaaaggagctcatgagcctcagggtccttgagaagcatttcggtgttgatgaggccgccatgagctccgatgaactcgtggagatgtaccgtggcttgtatgcgcggttcgaccacgacggcaatggcacggtggacttggaggagttccgggccgagatgaaggaggtgatgctcgccgtcgccaatgggctcgggttcctgcctgttcagatggtggtggaggaaggcagcttcctcaaggtggctgtggacagggagctggccaaggcagcctgaagcacaacagttttgcagcaatatttttttttacatgtctactatttataattttgtcattgcattcttattctggattgagctatttcatttgctagttattattggcacacggcagaaaccaggaggttgtaatactgtactttacatatcacacaagctagctgaacaaatggaaatgttgtgcggaatgctcgtgaaatcctacatttgggaataaaactaacagttctggaaattgcacagtgaattatctgattgttgagtaatagaaagcattgcatgttcacttgttcagtaataaggatgacaatatgttatcacaacaacaggtaaacaaaagaccatgtctaggaattgaaattaaactagttctcataaataggagtaaagatgaatatagtatgtatttgcaatctagagttggcatcaagtttatgataccggacacaacactcacagattcagaagatgtaattgcttgatattcattctgtcaacatctgatccatctggcactaaaacatgcataattcacataagatggccatttctcagacctgcataatgtaagcatgactagtggagagtaaatcttagacaaaattcaccttcctatatctgaataaaaaattttaaagttgacatcaatatgttgactctgaaactaaatcaaacctgataagccatttggccctgaaaattggtacaacataaacacaggttatcaagatctatgccctgacctctgcctccaaaacattaaactgacaatgctcacaagtcacaacaattgaatcaagttatattctgcatagatccagaattaccgcaaaaatttcaattcaatcattcgtctcctcgagatcgtcttccaaagcatccgtctttttcgacgaactaccatcgatctccaatgacctcaagaagttgaagtaggcatacttaatgtcaaactgcatgtcataccagtagttcactgcaatggtgagcccgttcggcccggggctctggctcacatggtgaaaccacatgctcggcaagtagagcatctcgccggcgcgcaccgtgcagcggatcggcctcggcccctcgaagtagagcgggaaggatgacgcctgcgcggccgcctcctccggcgacggcgggtaggggtcaacgctgctccatggcacgatcctctcgggctcctccagctccagcttaagcctcagctccgcttcatcttccgcggcgtagtgggcggcggggtagtcgcggacgtagaggcggtggtgctcggtggggggcaagaggaggaagtgcttctcgccggagacgacgacgtagatgttgtcgtagtggtccttgtggaaggaggtctgggagcaggcgctgccgatccagaggttgacggcctcggggaggcagccgagcgcgtcgctggcccagggcacgtgcgcgtccacgtcgccggcgacggcggcgtactccccgcgcaggcagtcgtcctgctgctgcgcgtaggccaccaggccggaggccggatcggagctccggatgaggcgcacggcggtggggaagtcgacctggcggacgtgcgcggaggcgaagcacttggcgccggggtggctcgggcgcgggtgcggggcgagggcgtcggcgcggccgtcgggggtgaggtggagcgagacggcggtggagcggagcgcgtcggtgaggtaggagtcggtcggccacagcgaggcggccggccagtggctggtggcgccggaggacacgaggagagggcgccccggcgagacgtggtcgcggagaaacgcgagcggcgtcgggggcatctcggcgcggggcatcgcggcgtcggcggcggcggcgtcgtccggggagtggaggcccagcaggtcccgcgactccgcccacagctcccgcactgcgcgctccattggtccccgcggcggcgagcggcgaagattctagtccgtatgctccgttggttttgtgaatcccggcggcggcggcggcgccacgcggttcaagaggcaggcaggcagggccgcagcggaagctggccgagtgggccaaaagtcctcctatatccatggcccatgggctttaatttgatgacatcgaagattagcctttagcaatggcttagaccttaggcattcccctaaggaaaaagtacaccggaggtccctcaacttgtcaccgagttacaaaatcgtcccgatacaacacgtaccccaatttataaaaccagtgtaaactttgactctagttttgtctgacgtggcagcccaatcagcgtgggacccacgtgggtcccacatgtcagcctcttcctccctcccctcaccatctctcttcctctctctcctcccctctccacggaccacaggcggctggcagagagcagatgggcgcggccgagcggcgggcgcgggcagcggccggcgagggaggaactgccactggcggcgggtagttcaggtccagcatggcctccggcggctgcggcacggtggcgccgcccgagtcgtcgacgtcggcggccgtgagcacgacggtcgtcgtgcccgtctcgcccctgtgccggcgcatgtggccgccgagcgcctgccccatggagaactcgaccccgcgcacgcggcgcactcgtggatgcgtgccctgtccctctcggccgctgcggcggcggggtcgctcagcagcttcgcctgcagccgcgtgtggcttgtccggtgcccgcccagcccctggagcgacgggaacgacttgttgcacgtcttgcactcgaacaccccctccgccgccagcgccctgctgcccgccggcgtcgacgacgacgtcggtgccatcgacgtggccacgcgggtgacgacagtgagagcagcgcgctggcgtgcacccgtaggctctcaatcttcttttgtcatgaatcgtgattgtcaacaaaccaaagaattccaagtaactttcttaagctcttaatgacgagctaaaaattcctttcacgtcggtgaacgtactcattttatatagagagtacgcgtttcttactttattccttaatggcgagctaaaaaatcctttcacatgtcgcgcccacgaccaccgcccgcagcagcgcgggcctccgcccctcgtacgcctcctccgctggcgttggctctcatccccagcccgcggcgacaagccggcgctcctcggctggccctgcgtcttgcagagcctctcggcgatggtgtgccccatgtgcgctgatagggtgatgagcagcctcgtcgcggcgacgccgagcgcctccgggtgatgagcagcctcgtcgcctgggagctcgctgcggaggatgaagacgacgccgacgccgcacgcgagagcgaggtcgctgcccgccttgctcgcctgctccgccgttctcctcgtcgcccaacgccgtggcgcccgccggcgcggggccgcttcgccgctggctgcgacacagcgccgtagacgccgccgccgccccctctcccgcctcgccccagcgggctcctccctagcagcgccggccggcttgcccagacaagccggccgacgacgacgacgacgctcccgacgctgagaaagggaggatgcggcgcgagagcaggccggggctccgagtccagctccacggtgctcgaccccgcctccacggctccacctccgcggccaccgccgcggcgcccttccccgcctccacctccgtggccaacgccgcggcgcccgcccgtgcggggccgcttcgtcgccggcggccacacatcgctgtcgacaccattcgcgaccggccgccgccctcgccttcagccgcgttgcagcagccaccgcctcctctcccgcctcgccggccggctttcccggttgcccagagaagaggagtgagagagagggtgatgacgtgggcatcttgacatatgggtcctacgtgggttccacgctgactcagctgacacgtaggataaaaccagggtcaaaaccactaaaggagctagattgaacggtttttgtaagttgagagatgtcatatatccggttttgtgaatggatgacgtcatatatccggttttgtgaatggatgacgattttgtaactcaatgacaagttgagggatcttcagtgtacttattccttccctaaaaaaggtaggaaagactttttatggcttgattagtgggctgggtccaataagcgaccgactacgccacatcggcccatctagatgaagcttagggatacggtctgttaatctgttatagggaaggactcatctgtgatggagactcagcacaaaacatatttgacgagctcacatatagacccgttacagatgatctcttgtatgttacaggtgttgagtttacacccgtcacggatgaggtactcatctgtgatgagagtattttttaacacgttagtaatgacctaaaaaatcaaataaaacaactcccctcccttaatgagtctctctctccctccccgtctcgtccttatcccttcttcctccatcccctcctctctctctctttcttcttcctctgcccctaaaggcttgaatcctctttcccatccaccatgatgcaagtgtcgcctcctttgtcccccgaccatcggatccatcctctacgaggtcagggtcgggggacatagatttaaccgctagacaccgcctcctccatccccatgtgtcgcctaccggtgtcgactcctttatccccaagagcctcgccagtgtcatctccaccaccgttgttgagcaccaatggcgttgcattctggctctactcctaagcatggtccgctgccctaagaatcgcagatccagccttcccgaggtcagagggacacctgatcttatggccttcgacctcatggtggctcgaaccgatgccaggctcctgtcgccatctctcaacgtcccagcaccatcccctcctctacccctagcatctcttgaggcgcccagattgtcgattcgtaatcattttccagagtgcaaataaatttatggtgtgatgtatttcttgccatccttcctgtgtgaatttgtgatcgtgacaaatgcaatggcaacgagcccggattgtgatgttctcttttttttggggataagtccattttacaccctccaactctttgtcttggctaaaatacacccataactctaaaacttagatatttcacccactacaactttcaatacctgtaactttacaccctcaagtaggtattcagctggttacagtctacttgacaacgatgcggaagtctagacatgacatacgactgaaaatagaaataagagccacacgtcagtagccacttcttcttcccccatctcctcttccctttctctctccatccttcttcctcccagacagagagcagtggtggagctgagcaggagatcggtggccgtggagcagggaactcgttgcggcgacggagctcaagcacatccccagccttccctttcgcgccgaccaccgacgagcacaagctcaaaggtccacctctcctgccgcctccaggagctccatgactccatcttctccatgaatcgagctcgccggtggaactcgagcttgacgaggcggcggcggatgcagagcttgagctcgacctcgtcctcgaccaagcggtggcggcactgcatagggatgactcctccccgcgcgtatggctcaggcgaggttggcctcttccgcgaggggcatcaagctcatgattcgcagcgccgccggcctcacaccagctccccgccgccaccaccctcgcggctccacgccgacgccgcagccgccgccctcgcagctctacgcagctgccgtagccgtcgatttcgcagctccgcgctgccacctctgccgccaacggttgtgagagaggagagcgaacagggtagggagggagagagagatagagagggagagagagagagggggggagagaatatgggcttggcccattttatgttttgcgctgacgtggctagggctgacgtggtatccgacgtggcaaaaaccacggtaaaaacagtctggggggttaagtgtccggtattgacagttcgagggtgtattatatccggttttgtagttcgggggtgtattttagataagcacaagagttcgagggtgtaaaatggacttttccctcttttttttttctccatcggtaatctgcaccagtgacggatactagcgtgtgagctgaattttgtttatcccatcatatgcatatatgatactaggttgtaattataacccaccttagacaagtgtcctcgatggcaagctaaaataccatcccatcacaggtgaacagcctcattgtcgggtgtttgttactactcatcacaaatatttacctccactgacgggccttcatccattaaagatgaggtagagtcattactaatcagtcatctctgacgagagccttacctgtcacaattgacggtttgggccatcagtgctgatttggcgcagtgacctataaatgtgtgtgagggaaaacaaatctcataaaaaatatcatgatttcaatatcctaaatacagac

SEQ ID NO: 4504 - DNA, 1105 bp, Oryza sativa
  unsure (1)..(1105): unsure at all n locations
gtccggtattgacagttcgagggtgtattatatcgggttttgtagttcgggggtgtattttagataagcacaagagttcgagggtgtaaaatggactttcccctcttttttttttctccatcggtaatctgcaccagtgacggatactagcgtgtgagctgaattttgtttatcccatcatatgcatatatgatactaggttgtaattataacccaccttagacaagtgtcctcgatggcaagctaaaataccatcccatcacaggtgaacagcctcattgtcgggtgtttgttactactcatcacaaatatttacctccactgacgggccttcatccattaaagatgaggtagagtcattactaatcagtcatctctgacgagagccttacctgtcacaattgacggtttgggccatcagtgctgatttggcgcagtgacctataaatgtgtgtgagggaaaacaaatctcataaaaaatatcatgatttcaatatcctaaatacagacaaatttcttttttaaaaattttagaaaacaataccacaaatctctatttaagttgaaagaactgactctagttgctatttcattttcgagcagtttttatagcagttgacttaggccaagtgtgccaaagttgtcacggccctcttacatcttggaccactaactgctactcctatgatctatagctgtttgactacttaaaaatgacggattaaacggctgcatggatggaaaaagaaaaagaaagagaagaacaaaaggattcatcaatcatcattcgttagacaactccattattttgccctggcataaataagaatgttatcctaattatgccttgtcggtcagtactcaatagaacatgcaagctccctcttatcacctatggaaatacttattttgattcatctatttgtttgtgaaagcctatagaaaataaggtagttgtaggtatgacctacttacagtgagctcactcattgtccaatggcaacaggaggcagttgctacactgacatataatggtggctacgttggaaacgtgtcagtgtgccatnnnnnnnnnnnnnnnnnnnnnnnnnnnnnnnnnnnnnnn

SEQ ID NO: 4505 - DNA, 664 bp, Oryza sativa
tttaaaaattggattttatagtttttagagtttattgccacattgggtttcatttttataatttcgaaatgtcccgtcaaacgttgccattatactcctctacggcccgtccactgtctcttctctttattggcattgagattttaaaaatcgaacataattattgtttgggttcatttttactttctaaaagtcccgccaaaccgtctgcggctttaccattgtactcctctacggctcgcccgctgcctcccttttttattgtcattgagattttaaaatcgaatatgattatcattggttcttttttacttttaggaagttccaaacctttaaaaattggacttgtagtttcattttttataacttttagaagtcccatcaaacgatgccactatgcccctctacagcccgtccgccgccaattcattttttattttctaaaagtcccgtcaaccatcggcggctctgcaactatactcttatataccccgcccgctgcttcttctttttattgtcattgagattttacaaattgaatatgattatcaatggggttttttttactttttagaagtcccagcaaccgtcttacttgtttgcttcaccgcatgcctgacgtccctccttttaatagcaattaggattctatttggtgttttat

SEQ ID NO: 4506 - DNA, 436 bp, Oryza sativa
atgcccacgtcatcaccctctctctcactcctcttctctgggcaaccgggaaagccggccggcgaggcgggagaggaggcggtggctgctgcaacgcggctgaaggcgagggcggcggccggtcgcgaatggtgtcgacagcgatgtgtggccgccggcgacgaagcggccccgcacgggcgggcgccgcggcgttggccacggaggtggaggcggggaagggcgccgcggcggtggccgcggaggtggagccgtggaagcggggtcgagcaccgtggagctggactcggagccccggcctgctctcgcgccgcatcctccctttctcagcgtcgggagcgtcgtcgtcgtcgtcgggcggcttgtctgggcaagccggccggcgctgctagggaggaggccgctggggcgaggcgggagagggggcggcggcggc

SEQ ID NO: 4507 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnncgttccgcctcagggagcggcggaaccggctcttcgtcgtggggtgcaacctgcaggccgtcctcctggacggcgacgacatcgccgccgcgtgcaccaccatctgcggggcgccggcgccacctggccagcagcggccgacggcgagctcgcggattactcgtgcgcgggcgttggctgctgccaggcttccatctacctaggcctcacgtcgtacggcgttcggctgtcgccgttcggcacaagcaccgggccgncgtcgccgtcggcgaccttctncggcttgtcgtctaaccaatcggattcggctctcgtgttcgtcgcggacaacgagtggttcggcgggaacgcgagtaagctcggatcagcagcagcgacgatgcgaccgggcggcggcggcatgccggtggcgctggccgtgctcgactgggcgatcgggaagtcggggtgtccgccgcatgggcccgacgacacgggctgtagcaacagcaacagctactgccgcaactctaccaacaccttgcttggcgctactcgtgcagtgcgacaacgggtaccaaggcaatccgtacgttgcaaatggatgtcaagggaatttggtactccctacttccctaaatgttggatgccggtgactttttaaaacatgtttaaccggtcatct

SEQ ID NO: 4508 - DNA, 523 bp, Oryza sativa
tgttgaggggaaggtcttcagaatcaacaatgcccttgacaaagctgagccactctgggatcaactcctcacagttgtccatgataaacacccggcgtacgtacagcttgatgttgttttgcttcttcctggtgtcaaagaggtcaaatggcgctctctttggtacaaacaggatggccttgaattcaagctgaccctccacagagaagtgcttgacagccagatgttcctcccagtcgtttgtcaagctcttgtagaaagcagcgtactcttccttggtgatctcctctggcttcctcaaccaaatgggtttctgcttgttcatcacgttccactcgtgagagacttccttgatcttcttctttttcttctctttctcttccttctcctcatcaacatcctcaacctttccctcctcagcatccttctttttttcctcggcttcatcatcagaaatctccttctcagttgtcttctcagtccatagggagatagggtagctgatgaactcagaatgcttctt

SEQ ID NO: 4509 - DNA, 632 bp, Oryza sativa
accactaccacttcagcagttcagctcgctgcgccacaccacatggatgggcgtcttggctttggctgtgtgcgtgtgggcgaggctgcctagcgtagagacggacggcgagcatttccagcgcgtggtggtgcgcgcgcgggcgcggtgctctcacgtgcgggtcgcgcgggcgcggagcggccggggttggtcgtacgctggcgggaccgaatcccacaacatcggcccggctcttgctccgatgcctcgtcgtcgtcttgtccgcggcttccattccgtttcagggggcattcaccgctgcgcccatctcgatgcctgctgctgctgctagattgtatgtcaataaattgaaaaaatagagttttaatacacgacgcactcagctaaaccggcctatgccaaggaaggaagaaaacaaagataaaaaacaaagaaaggaactcgaatttgctgctgctgcagcgctgctactagcgagtgcaacagtagtacaacctagactaaccataggagaaaccatttcagctacagtaagggtggagctagaacgaaatgggaagaaataacactcacttgctttactctattttaggctgagcttagtctgatatgagcgtctgagtttagat

SEQ ID NO: 4510 - DNA, 463 bp, Oryza sativa
  unsure (1)..(463): unsure at all n locations
ggcgaattcgagctcggtacccatgcgcgcaccggcaaaaatcatggcctcgaaatccttgttcacctcgctaatcggcccaaaaaggccagccaagtgagaagccgacatgggtcgaacacccaagaactcgacaggactagtactatctcctcccagatgcttcttgaacccgtcaacaagcagaggagcctgcaagttaacggcgaggtggccggcgttggacgggtagaacatcaagacagggactcccagcttcctcgcggcttcatgggcatgggcgcacgatgcgtcgatgaccacggcatggaggccccgcacggagcggaggaagtcgtggaggtgctcgttgtggcgtcgcacgaggtcgaagtagttcttgaagaactgatcgttgaaggcgagcgannnnnnnnnnnnnnnnnnnnnnnnnnnnnnnnnnnnnnnnnnnnnnnnnnnnnnn

SEQ ID NO: 4511 - DNA, 5035 bp, Oryza sativa
  unsure (1)..(5035): unsure at all n locations
nnnnnnnnnnnnnnnnnnnnnnnnnnnnnnnnnnnnnnnnnnnnnnnnnnnnnnnnnnnnnnnnnnnnctatcaccaccaattactccaatattaaaagtagagaaagagtggcaaactgcagcaatttaccaaatgagcccttaggctgtgttcgcatgtggtggatgggaacttattccctccgcacagaaaacggagcggtccattagcgcgtgattaattaagtattacctaattgtttttcaaaaatggattaatttgatttttttaagcaactttcttatagaaactttttgcaaaaagcacaccgtttagcagtttgaaaagcgtgcaagcggaaaatgaggaagaggggttgggaacaaggggttgcaaacacagccttaaccctttcttttacaagtgctcttcacatgattttcatcgacatctaaagttcgcggacaccagtagcaagtcaaagacttgaaatctagtagctggctgccgatcctcccttcccctctacaaggtagacatataaccaaaatacttgaaaatgccctaatgtaggagatcaggtaatattgatcctaattgaacacaaacaggtaaagccacagaaaaaaattattcctggcctgtttaaatccaatttacgtattcgtccagaacgcttgtcagtcagaaacatcacacataagaatgaataagtgattttgttatattttgagggccataaagcatttcattataggttttcagctaatggagatgtaaaagaccagcaattnnnnnnnnnnnnnnnnnnnnnnnnnnnnnnnnnnnnnnntgggcggaagacgttgatggtagtgggaaagcagcgaagagggttgaagctgtgcttaacttgcacgttgggggacgatctcaaccatcatgcatttgagggttaggattcaccaaaagactcggtttttcaattcacgcgagcattttcttgtttgaggctaccctttcaggcttcaactcgggaggaataggaaaggagaacgtgcgccgagggcacaacgacgtggtgcggcgccgggcgcaaggaaatgcccggtgcggtgccggacgcgattgcgcgaggagcagtgttgggcggttgcgcaacaggtatgcggcggcaggagatggatggggattagggttgaggtggattgcattgcatctatacctgctcgtgtgggcttctttgggctgattttttaatgggctatcggattgctgctggacagattatacaagtttgtcttaggctggattttctatggtctactggatgtccgggtccccatgggggcccgcgggtgaactacctgccccgcccccgtccctgcttgtttgcggagccccgccccccacggggtcatctttcgccctgtccctgccctgtaggggcgggtccccacagggaaattgccatccctaaatatatttaaaccatggccctgcgtttgggtttgcacgggccgaaagaagggagaccccaacagcaaaactcctgaaccacaaacgaaaggggaaagagaagagtgatcgcgtcatccacgtagcagcgaccaatcgcctattaggacatgtacaaccaaagccactctatggatgctctcactaactgaagccacttaataggacacacatctcccaaagtcatatacttacagctggggcttcaaaatctcaagcaactgatgaagataccctagcccacaatggggtgccccaacccacgtagccacatatatgatttccttccctacccctagcccaccgagcatccaccgtcttctcccttctcttctcttttccttcggcatttttttcaccgattttcttggccttatcccctcgccgcttctcctcttccttctcgcccagatgcgccgccgactcccgctctctcttcccttcgtcgctctcctctctctccctctctgactcgtcgctgctctatccctctctatcccggtggccgtcgccgtttctcctactctttcctgttgccggtcgctgtccacctcaccggcagctggatccactctcccacatcctttctctcccgccgcctctctctctctcttgccgccactcgtcgtcgccgcctctctctctcccgtcaccgctgacggagaacgacgcgcagggctcggtggccgacagtaggggtgaaaacggtacggaaacggatggaaacgacctttaacattttcgttttcatattttttccgaaatcggaatcggaaacaccggaaacgaaaatggaaacgaatagtatcgaaaccgaaaacggagcgaaaacgaaccggcgcggatacgataacgaaaatttatcggaatacaaaaacccctcaaacttttgtcaagtccaattctcaagtctcaacagtcaacaattcatcataaaacacaattatatcaagactaattgtttagtatcaacagcaaaatatattcttctataacttcatataatttgcataacaaatattctaaaagaatacagcaaaacacaatggtataaggtatacacaattcaggtgctatactgctatcagcctatctctccaggaaatgggtttgagaacaacaacagaacatcagtccatcaatacttagttcatcaatcatcacagaacagcaacttctactcttgccactgcacccacatttgtggtaggatctcctacatttgcaagggttggttgtgatgctggcaaagctacaatgcccgcattgcatacacttgcactgctgctacttgcatttgatgattccatcacaaatctgcagcataaaagaaatcaaatcaatggtttaggctcaagaccacagtctgtccttagctggacatagtagcatatattatttttcagctgcatttgtattattccccacaaacaaagcagtatttctataattggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagttgctgccgctgggctgctggctactgcgaggcgaggagtcgtcggcgttggtggcggtgaggaaaagtcgccagtggggcttgaggtgtcatcggtggtggtggctgtcgcgtcgtcgtcggtggtggtggcggcggtgaaacggcgagacgtggcgggacggcgtcgtgagataacggggaccgagcaggccggcggaggtgcgagatggtgacggcggccagcggcgaaacggcgaagagcgaggcggcgcgagatggtgggggcgaggataggacggcggaccaggtggcgaacggtggcgcgggcggtgggcgcgggggcgcgcgatgccgcgatctggatgcaccacagccgccgctccgccgccggctcgcgtttgcgtctgtctgtctctctcctctctagggttagccggttagagacttgagttagggtagatgccgcgatttgggttgcgctggaaagttggggatgaattatggactattgaatctatgggcctttttaacttcggaaattccgacaatttttccggaatgtttccgaccgtttccgagttccaacggaaactgctattatcatattcgattccgtttctgggaaaatatttctgttttcgattccatgcctgcaaaaatctgccagacgatcccccatttctgaaaacatgaccggaatctggaaaaattccgtaccattttcactcctagcagatggcgagcggaagccaagcccgtcgccgactggtggccggcggcggccgcggcgcgaggaagccgtctccgcccgtcaccggctggtgaccgacggctaccgcggcgcgctgtggccggatctagtcgtcgtggatccttgtggccatcgcagatctgtcgacgtcgcctctctctctcatcgccatgccgctggtgaggggcaagaaggggaaacaccaggggaggaggtaggggacagggcactgggtcgccccaacgcgtagtctcgaggaagtgtctctggaaaagagaaaaagagagctgaggagccaaaggcgtgcgttcccctcgtgggggtcgcgcctccctacagggacacgccgcgcggacgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagtttttttttttaaaaaaaaagcaaaggaaatgtgtaaggaaaaaaaaattaaaaatggaaataaaatgtttaaaaaaaagtaatgatttactaatgttaaaaaatgaaaaaatggtatttaaaaaatggaaataaaagttttttaaaaaagtaatgatatgctaatgttaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaannnnnnnnnnnnnnnnnnnnnnnnnnnnnnnnnnnnn

SEQ ID NO: 4512 - DNA, 4995 bp, Oryza sativa
  unsure (1)..(4995): unsure at all n locations
nnnnnnnnnnnnnnnnnnnnnnnnnnnnnnnnnnnnnnnnnnnnnnnnnnnnnnnnnnntacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactctccaaagttaaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacacaggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagccttccaacggttattttcaaatttcaacggtcaaatagccgttagtgccacgtgtcgccgtcccattggaccgccgcccgcctgccgcgcctgacgggccgccgccgtgccgtgccgggccgtgccgtgccggcccgctacagtagccgtgccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgcggacggtgtgagctggggaacgatccaggggcacgcattgaacagcccttaggaatgcttcctgtcacaagtttcagctgtaccggataattctgatggcacttagcatcaatacaggagctttggaagagtttccgctcagtaccgtacgtcatcattcttagtgttagtctacagataattagaatcaacagaaggaaatttactagtcacaactcacaagtcataaccatttgtcttagaggccaaaagactgggcaatggcagccaaactaagagtttacaatcactcatccaggagcatcagtgcatcactaccgagttcaggccagatctgaacactacatatcacagtctacagcaccaaaaattgcttattctatgagcagaaagggggtgaaacaaacaaagaaaaaaaaaacagggatgtaaatagtgtacacactacagactacattagccatcattgcattggcctcttcaaacggagctgctttcttctgggagtggcaagtatatgaagacagcgactaacaagatcaggaatgccacggtgatgtacttccagttcagcactgacggctgtatggtccggactgcctcagcagtgccctccccgccagagtcatcatcctctgaagacctcgtcttctcttcctcattgctagggtctacaggtttctcagcctgtacacaatttcagtaacgcaacaagagtttgaaaacctcagaagtcggatcaagatattatccatgttctaaaaggcatttagaaataatcaatcaactatgataatgtcttgcgctgacagctacgtctgagatctcaaacagatatgctgcttacaaacttgtgcgtctttattagaaagaagaaagcggaattacattgcaacagaaccaagagaaaactgtttcatacatctgtgtgttaatccaagaaatttcaatacagttgtacaattaattcatgtaaacataattatataactatagctcaattgttaaaagaagttttactacacaatattttaaaagtaatgagatagactgacttgagtacatacaaatgcgtacttactacgaatgagagattgactgacttgagtacatactacgaaagtgtagttactaccaatgggtacttgggcttttagttgctaacacaacccaagtcgtacctgagaggttgagcccaatctggccatctttacacaaagctcaacctaaccacaaacttaaattggcaggttcagcccaaacccaagctagacctaattacttcaccacagcaaatgttaacttactaatggcatgagtatcaaatagttgtggatgatgtcgaccaagcagcagcaatttataccttttttgtacagtatgaaaaagagaatcaactaaagataattttcaccttagtctgtgatgaagaaaaatcaggaactatttcctccgctaatttagtagaatgaagctcaacatctttgccagtaacatttttgctcaattgagtgtcatccttaacacttcctttgcacttctgagccaatatcttgtttttctttgtcaacaacgaaatctggagccatcagaaaagaaatcatcaaataaatatggaacagcaacagttcaacttactgcttaacatagattaattcagatttggtagaatatgagttcacactgtatttagtgtagcacgagtcatacgaaagttttccttcctaaaataatccaaaacacttaccattgcttgaattggaaaacaaaacacaccatgaaaatagtatcatgtcagcttttttccaccacaaagttttagattttctgtttacattcaaaaggtacatgcagatctttgaactttgatgcactaaagctaggtcacaatcccccactgtctaagtctcactcacatcatgtatgcttgagtattctatagtgtcac

SEQ ID NO: 4513 - DNA, 14176 bp, Oryza sativa
  unsure (1)..(14176): unsure at all n locations
acctttgaaaacaagaataaccaaactttgcaaataatgaaaatggttcatcggtctaaacacaagcatggacttcgaacatagtcataaacagatatttggatttacttagaatactaaaaggtaaggttaacatctagtcttttttgtatcaactcatgtcttgctaaatttggaagcaagaccaatccacagtgtcattcaacacagtaaaattaaaaggtctaattgaagatttgtatctttttcttgaatcatgtgtttccaaactatgcacgagtagcatgtatatataaaaaagctaaagtattgacaacggcaacaaaagtgtattcggtcgcgtatagacctgttgatgaagtcgttctctttccaatgcaagttttgtgaccaaatcagtaattatttttgttctgattccaatatccttgacggtagacatcttaacatggttggcttcatgtaatgagttctctagactttctgctcgacccctcagaaacgatagctcctcactaagttctaagttagtgtctgttaacaatgtacacttagattcagcattctctgctctggtttcagcttttaaaacctttcccttcagatcatcaatcatatgttccatgtccgacattgtagatctcagcatactctgctgttcaacagtggcatcaagagatgcctttgcatgctctaattgggtatgtgactccttaagtttcctctccaaaaggctagtcttttctgaaccatgacttttaagagagtttagctccccattaagttctatgttagcttcagttagctgcatgcaccttaactcagcattttgtgctctactttctgctcttgagacatcttctttgagactcttaataatgttttctaatgtgcttatctcggcatgcagcacattctgctcctcctgaaaagtttctgctgatgcctttgccaactgcaactgtgaatcagattccctcaactgtttttctagctccttaaccttatcctgcaaggatggcaattcaggacttggatgagtttctgtgcctccactatgttgactcccttcttgaatattctctgcgttgacttgcagtgaagataatcccatcaagctttctcctaacttcgactccagatcacccttcctacatcttgatgcacttagatggcactctacggtactaactttgtccacaagttcctttgaagttcccaagagtacctcagaagcgttttctgctgcaaatgttttcccacataatgattcgatagattcctccaggaaatatttttcctgatcatgatgatggagctttagtttgagttcttctataatacatcttgattcagagagcttcttttcaagatccagctcacttgctatcgattgttctaacatctgcaaaacatttcttcgttgatcctctgtcctcatgctagtgtgggatgacacaataccattttcatacccagcgtctccagtaatgcctgtataattgtagttagaaaagagtgctaattgatgcatataaaacccagggtaactgagcattaccttctttgtcatggggaaactctatggctttctcaaacttggctgactcttttctgatatcagaaactaattccttcatctgctttaaagacaccatagcagcatctagcctagctttaatcttgcctccagattcatcttgacaaaccatatgctcaacattttgaatatcagtctcaagagtactgatcatgtcatctaactcccctacttctgcatctagaaaaccatataggatgtccaattcaaaagcactctcggcagtttcagaagaaacagattcgtcttccaatgtaggaggctcaaaatcagtagccttgcgagctatctccatcaccaacatctctagatttagtaatttctcagaggcaaatgcaagctcaagttccactctagtaataatttccatacttcctccttctacattcattccatctccattacccatgttttgttggaaatggtcatcatccatactgttctcaacatccataactccttttctgcctgctacacatttggttatacacaaaaagggagacatgtgagatacaagaaatgcacaaataggaatattaaagaccaaaataaataaaatgaaaaagaaacaataaaaaaaattatctatcataagtgacgtttgtagcttctggttcatctgatggaccaaaggttttaagagctaatagcattccaaaaacacctaagagtgtttatattaaaaaaaaatcagaaaatgtacacatcagaaaaccaatcatgttggagcctgattggacaagaacattatgggaaaatcaagcttatcaggcatcggtccaaaatgacataggtaggtagaaaaggcccagcttacatgttcccccgatatcgtcaaccaatttaacaagcattaacctcggtaaggactgggacgcaatactactatttgagagaaaaaatggagggacagaaagaaacacctccccgaatgaactaacaagaacagatcagaaggaaattcaacctcatgatccaacaccaaatagaatgacaattcgtcctatgtgctccattcagcacaggaaatgctgaaattgggcttctcctaactcgggtcagtaatcctgatggattccccctctcctccaagtcggatttgctgttcatggtcactatgaccgtacaaaagtgctctgctttcgtgcgcactacatcatacaaaaccaaaccaaagcgccgtatcagccgttatcccaattcccaccagcaccagctagtccccccacccacggggtgatccagattcggcggccctccgcgcgcgagcggttgacccgaatctctcgctgctcgcagctaaaagcaacaacctacctaccagtgaaccacacggactagactacagagcaggaggcatcctcacgccgcgcgcgagcaggaggcggcgagatgggagaggttgcctgcggcttgccgttacctgggctcgtcggaggcagcttgccgccgccgccgccgtcgccctcgcgatctccgccgggaagcgaggcgagatgatgaggtggccggattcggatgctgctccactcctctgcctcgcctcctctttgcctttctctctcctccctttccttttcagaaaattaaaaggaaatggaaaaaacgaaagaagtgggggagacgtgcgtgccaactaggcgcacgtgcggcccagaaacggacgacgtggaaacagcccacgggccggagagcccctttgccttcgtcctcctcagcccagaacagccgatagagagacgtccattgccgccgagaaaattgggtattcctaatgggcgggtgatcgccgagaatgctaatgctaataggcgggtgatcgctcctccgtacgcccagcgatcacccgcccgcccccttccctataccgtacacttatccctcctctccctccttcctcctccccttcttctcttcctattacagtacaccacataaaatttttttaaaaaaataaaaaattagaaaaatttatgtatagaaatacttatatataaaaattttgaattcaaattcaaatttaaatcgggtatataaacttttgacttataaactttgggtctataaactttaggtgtataaactttagatgtatagaaatactatatatatagaaaatatttgaattcaaatttgaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcgggtatgtaaacttttgacttataaactttaggtctataaactttaggtgtataaactttagatgtatagaaatactatatataaaaaaatatttgaattcaaattcaaatttgaatcggatatataaacttttgacttataaacttttggtctctgaactttagatgtgtaaacttaaggtgtataaactttatgtgtataaatttactaaaataggaaagtaatgcggtgccaaaaaagaaaaccaggtggaggggtagagggagggaggggggaggggatcgatcgctaccccagtatccgggcaatcgatcgcccattaggatcccccgctttgtatgccatattgtattttgatctctctaaattactattttcaaatgatgtttagtttggtctatccatagaaaaacagacctataacctatacagttgggtggcacacgtctgataggatgtcaatggcatgctagttagacgatgtacttctccatatccctctcttgcagcacataacgacgatgggccaaacaaataaagtgaggccaccggagttttagggcctcatcttttcgtgtatgctgcttatcagctaaaatttgaattttcaatcttaaatttgaaactgattttgagatttttttttatcaaagtttacttttcagcctttgattttagatcgctaagaatacgtatataaaatttatattcagcatttgcaaataagccatttcgtttattccgcaaagagatgccaaagtgcattatcttttaaagtgataatttaatgaagccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttggtttgcgttttttttccatgtgcttcatcagggtgtaaatgaactaaggggaaggaagggttctagactggagattgcattctggtcatataccaaggtactagatttttgctttgattgtgataaatctacaggaacgaattagattgtagataagaatcacagttttcaatagcctctgtttgcctgcaaattatcatttaaatatcaaatctcgttgtagcaaacttggaataatcccataccttcaattgtttttgaaaaaccaacctctttgcatgtatttcatcagaaaatgtttaaactcaggtctgagttattatttcagaaattttagtgaattagatatgaaaagtgaaatagggacgagatggctaatattgaagtagatatggactatccatataaacgaatagatatttcaaaattgaaattcgaatataatcttgccattaaaactagactaccaaatgtgctggggatggggatctgaaggtttacagcagtgtggccaacttccaaaaacaaaagctttaaaatttaaaaagcatgacaacctgaaacatttcctgaaaggcatgtcttttctgtgatagttgtgatttagtgagaactttcaacaaatttgctctgtacatattattgaatcaaaataatctactcatagatggtattgtctgttaccctccttgctttgttggattttgctactttgcatcaactatagctttccatatacttcacaagataactatttatctgatctgtttcatgcgactttctttgtcttgcattatgcaaataattctaacttttttgccacaatattctgttattctgttgtttactctcagtaaccactttattttctatcacaaatcaaagctgttcacaagtacagtttatttgggggttttgcatactgcattttaaatcaatctaccattggaccatacactggattcgtttgtagtttgtttcaggttttttgtacattacaaaaaatgtttatttctgtatttaacacccttttgttggttcattaggaaaagagaaaatgtcatctagttatgatgaagggaaaagttttgctcggagggaccttttgcttaagatccaatctgaagtgcaaaaatgttgggaagagaacaaggttttcgaagcaaaggctggtgatacacctccaagccctggtgaaaaattctttgggaatttcacatacccatacatgaatggcatgctacatttaggccatgccttcacactatcgaagcttgagtttgctgcagcataccacagactccatggctcaaatgtccttttaccctttgctttccactgtactggaatgccaatcaagccatcagctgataagcttggtaaagagatacaacagtatggaaatcctccagtgctcccacctgccaacaaaaactcaaaatttgagttgacaaatgatagaatttatggccagaccactgctagtgcccaagataagtacaggagcaagagatctaagtcagtagcaaaatctggctcatacaaatcccagtgggagatcatgaggagctttggcattgctgatggagagattgtggaatttcaaaatcttcatcattggttaagctactttcctccgctggccatggaagatctcgaggattttgggctaagttgtgattggaggcgttcatttataaccactgatatgaatccattttatgatgcttttgtccaatggcagatgagaaagttgaagaaaatgcacaggattgtcaaaggcaagcagtacatgatctactccccattagatcgccaaccttgtcttggccatgatcgggcatcaggtgaagaggtcgagccacaggaatatgtactgattaagatgaaggttattccgccatttccacccaagttgatggtcctggaaggcagaaatgtgtatttggccgcagcaacactcagacctgagacaatatatggtcaaaccgggggcgaagctacaggtaatcatcggggtcagtagaccccaacgatgttttgctaatgtccagtacccctcttattttaccagctatgcccccaatgaagagctaaactagaccccagtgacatccttgattgttccatcaaagagcaattctatactagtggtacctcatggtacctcctcaagaaccgtaaaattgctctccatcaaagctcaactggttactataggaacgagatactagcaagcagcaaatagaaaatgaactagcagttatgattatacaatggcccaatatgcatatacgattgatatttgagcccataaataagatcggaagacactactccacaaattccctggttgcatcatcatattcctcgttgtattgcatcggcatcgcacgtcctgacatcatatttatcatattttattttatttccagcataatggaaggcaaataattagtggttttgataatctttgatgcatttggtgtcttttacagcttgtaaaataatccaataatgtacatgttttaataattttatcgacagaagctgtaataggcaagatgtaacactactacaacaggagttggctttattttaataattttgtctcgtagtatgtagtctctaattacaagctgtaataattatgtagttttatttccgatttactgttggattccaaccagccgtatggcatttttcgcaaaaatttgattaatcttgatcaaattttggtctacttttttttattcaaaaaataattctcgaagaccattcaaaatttcactcggaatctacttttgccctgcgtggaaacatcaaaattgcatggttttcgatcggttttggttgaaaacgtaaatcctgattagtacgaatactgaccgcggtaactatttatcctggcttcgcccctgggtcaaacaaactgttgggtcctccttgatggaaagtatgggccttttgagataaatgaaaccgatgtttttatattgacagcaagagctgcacgtaatcttgcttaccagatgctatccagagttccagaaaagccaacttgcttagttgagctgcttggcacagatctgattggtttgccattgaagtcacctcttgcctccaacgaagtcatatatgttcttccaatgcagaacatattagtagataaaggcactggaattgtgactagtgttccaagtgatacaccggatgatttcatcgcattacaagagttggtaaaaaatcaagattttagagtggcatgtggagtgaaagatgagtgggttttcccctttgaagttataccaataattgatgttccaagttttggaaataaatcagcagagaaggtttgttttgatctgaaaatggatagtccagatgagaaagaaaaacttgctaaagcaaaagagatcacatatttgaaaggcttcgatgatggcataatgattgttggtgagtttagcaaccgaaaggttcaagaagtgaagccattgataaaggaaaagctattgaaggcagatatggctgttttgtactatgagcctcaggagaaggtcatttccaggtcaggtgatgactgtgttgttgctctcacagatcaatggctcataacatatggtgaggctgaatggaaacaaaaggctatagaatgcttggacaagatgaatacattctcagttgaagcccgtaatagttttgagcacacattgaactggctgacttcacgggcccgttcatgttcttttggactaggtactcggattccatgggatgagaagtttcttgtagattctctttctgattcaactttgtacatggcctactacaccattgcacatatactgcaaaatggtaacatttatggatctgacaactcttatataaggccagaacaaatgactgatgaagtatgggattatgtgttctgtaatggtccggcaccaaaaactagcatcccctctactgttttgacaaaaatgaagcaagagtttgagtactggtatcccttcgatcttcgaatttcaggtaaggaccttatgcagaaccatctggccttctgtatcttcaatcacacaacacttcttccaaaacatcattggccccgcggattccgttgcaacagacaccttctgcttaattctgagaagatgtctaagtccacaggaaatttcaggacccttcgacaggccatagaggaattttcgtctgatgccactaggtttgcacttgctgatgttggtgacggtatggatgatgaaaactttgtctctgagactgcaaattctgctgcactaagactgacaaaagaaatttcatggatgaaagaagtttttgatgataaatcttcctttcgacttgggccaccatctacttatgctgatcgcgtctttgctaacgagataaactttgccatcaaagacacggaaataattatgatgcttccatgttttgagatgctctaaaagccggattttatgatctacaggcagcacgagatgagtacagattttcatgtggagcaggaggtataaaccgtgaattattgtggcgttttatggatgtccagaccaggcttatcactcctatttgtccacactatgctgagcatgtgtggcaaaagatactgaagaatgaaagatttgtagtgagagctggctggccgattgctgatgatccagattctactttacgaattacaaacaagtacttgcagtcctgcatagttttgatgaggaaatcgcttcataagcaggaatcttgtcacaaagtggccaagaagggagctgcagcctctacaacatttgcggaaaataaattatcagttggtctaatatatgtgaatgaacactatgatggctggaaagagcaatgtttgagagtactccaggacaaatttgacactgaagcaagatccttcactcctgatgaagacattattgatgctctggtgaattgctcttttggacaggagctaaacttgaaacaaataaaaaagttaagtgtatgcctttcattaagttcaagaaagatgaagcacagaatgttggttttcaggccctgtaaccaaatcttccttttggtgaaatggagattcttgaagcgaacaaggaacagatcaaaagacagttgggtcttaatcacatagagatattgtcatcctcagatcctctgatgaggctggtgcaaacagagctggttcatatgcttccgtgctcaggaaaaatccaccttctcctggaaaccctattgcaatattcttaagtaaactggagttccagagtcaaacttgaaaatcactcacttggtttcggtaataacagaacactcaggttgctcctaacttgtcttatgcagataccactcatgctgcctttcaaacaaatagtttgttgtgtataaaatttgtcttacagtttagaaagcacaaactgtatatgaacctcgtatagaaataaatcattgtctgaacattgtacagaaatgaaccttgtaaataagtgtcattctatctgaaatttgtaaaggaatgaacctttgttatgtagactttgtttttagttgtatgtagtatgtactgctaatcattgcttcttcagtgccttgtgttcatcgtcccactgttgtttagttattagcagtagaagttccttaatttgagagaatccattatatgccactgattttgtcacacgtctacaatttaccatcgactttatcatgttctataatataccatcgacttttgcttaaattctacgatttaccatcaccatccggttagcctccgttgtactgtacaattttgtccaaataaccgaaatacccctaggacaaaaactttcaaaatttggataacaaattcaaaatatcatattataaatataagattgtaaacatccaaaatttggccaaaaacataaaatcttatattttagaatttttatccaaattttgaaagcttttgccccaagggtattttggtcattttgacaaatttgtacactaacggagactaaccggacagcgatggtaaattgtagaagttaagcaaaagtcaatggcatattatagaacgtgataaagtcagtgacaaatcgtggacgtgtcacaaagtcagtggcatgtaatggattctctcttaattttaacagatactacatgctgtctatctcgttgtggacttgtggtagagttcgctaaagaagtacggagtactaaattgaacaaattattggtctgcattagtattctatatttttgtatcgtactattgtagtagctcaaagtgatagccggacacagtggaatgctgccggtgatctcaaataaaacattagagatttttatagactacaaccgcttaggaatgtttttttttctttttctttttcttttttttaaaaaagagcatgcatgttaaaatatgtctcacagacaaaagaatgaaaaaaaaatggtcatatgtatctctactattataaaaattgaagatgttttgccggtattttggtacgtcattcgtgtatgaatcggtttttaaattcgttcgcttttggaaatacatattcgtatttgagtcgggttttaagttcatttgcttttagaaatacagaaggagtaggataagaaatctctttttttttaaaaaaaaatatcgcatgctaactttagatgatcggtctcctaattgcagctcatgattttgtagaaaaatatatccaaatgaattctcatagtaaatttcaccttaactaaactttataacaataataagattaaaatagcttcctttgcaatgcacaggtattttttctagtattaaaaggagagaaaaattaacgtgcttttttataacctatgtctttatcttaaacttcagttaacactacacctagtttgaacttatttgcaacacatggattttgcagcacttttatataaattaaattgattcatgaatgaatgctttatatatagttcttgcattctaaagaatgcctttggtatgatctgaaaccattcaagcgaattgcgccctcaaatttccttgaatttatttctgaaacaagtagttgtaaattgttttgataaaaatatatatattgagaagtaataggcaatagcacttgatttcccaagaggtgagttcaccatcaaatggtagaggcaaccaaactcaaccatatgcaagtacccaaacacattctcagcgcatctggcatcccgtccatctcttatacaaccaaccaaacactatcttacactatccagcctcatatgatacagacaaccaaacactttattttgcactcactcatccaggctcatgtcagcctggatggttcatacgggtcagggccaggttggagtggtgcaaacaaccaagcacacccttatttactggatgacatatactgcatagaaatattattctttgttggctaattactctcacacgtgggccggttgttgaaggacaaacttaggacaagtatgcgtataaaaaagagtaaattacacgaaaccactaaaattatagtgcaagttacataaaaatatacaaactagatgaaaccccgcgcattgctgcgagaatttaatatgataacaataaaaaaaatagcgtgtaagatagctagataacattaagattaagtaaattaatgtgatttataataatttaaatttaaatagtatgtagaatggtgattcaaacgtaaaaagtaaggtggtatgactttatggaagaagaaaaatagggggatagtttggaccgtagattaatcatctaaaggctaaaacaattgatgtgatatgacttaattagagaaaaaaagaagaaagataatttggaccatagattaatcatttaagcactaagtgaggatgaactatataagtatataggatatcataaaacataacaaagatatacattgaaacattatgtgaattatgttggatgataatttaacatatttgtatttgaaaagctcttaaattataaaaactataaagatatagcatgtttgcatgatgtttaaatgtgatgattgttagtggataatgatgtgacatcttgttaattagtggataatgatatgacatcttgttagtggatgatgatgtggcatctttgcaggttaagcttaacgagttagtgggggataactttatattaagataggatttggtaagtagcatataatccaatatattatggtaaaatttactttgagacacatttgattaccgatattttactttggattactgtttaaccaatgatttcactttggattaccatactctcttctgaagcatatgaacgatagtttgtcgactcttactaatcaatgaacttccacatctatatgtacgaccatttctgatttctgtgacatatgataaattgaacgtagatggataaaatacttgaggatggtccaaaatgccacaaaggtaaaagcgcctggttcaaaagtgaaaatattggttaaagggtaattcaaagcgaaacatcgataataaaaaggtgatccaaagtaaaatctactcttcacaaaatcatataaattgacaacttctacttaaacctgacatgtgggatgatagttttatatgatttgacatgtcgtagatgaaaactcttacatgctgcaataagtatgatagatgaaaaaactggtaaactccacatgtcaaatttgggttaaattgttttgtgaaacaatacacagaattatgtgttgcatgctaaaactcgtatggttttataaattttggacctaatatttttcactttcattgtataaaagtttcgtggcaagggtcttcactagtttttcatagccataattttataagaaatatatagtgtaaaccataaaagtttactcatcctaacgtgcataaatctcatacgtctattttggatttttcaagtttcaatatggaatatgatttgcactattcttttcgcaatttaatcattcacccaaatcgtttggttcgnnnnnnnnnnnnnnnnnnnnnnnnnnnnnnnnnnnnnnnnnnnnnnnnnnnnnnn

SEQ ID NO: 4514 - DNA, 1658 bp, Oryza sativa
aaaaggttgcatctataatggaaggagcacaacctctcctttcacaggtacagttttcttaccaattctttaataagttatcttgttggggaagttttttgatatatctcttatatttacctgatcaaatatctgtgcaaccaatgcatttttactcaatatgggtcaaattcatttttccaataagaagttccctcaatcatgtttggaagtgcaattttgttttagttaatacgctctagacattaataagaaatgctactctggtaaattttataattggggcctaattctacattacctgacagtttacagaagatatcaatttcatgcatgttaaattgtcaatgcatggatcatgtcatcttctcattattaattccaaactagcagctcacctatgcattgcaataggaaattattttcattatgctggagcaaaataacatacttacttgtccacggagaaatatttggcaacgggatttcatttgtacaaccgggaaaaaaaatatatcaaagatccatctactccatgtttcagaatatgcccttgcactagataagcctcatcaatacgtggacgagcggttaagataaaagcaatttggtcgctaacgacccctagcccttttgctatccgagtaatcatagaagtgcactcaacaggagcagagaactttatactctctaactattgccttatcatacattttacaggagcaattttgatttttctaaccatggcaaacgggatcccagccgatacagcaggatcatatcggctgtgatattgtccagtaggtttaaaacggattttagccgataccatgaaaatagccgataggacagtgtttagggacagaaaagataatgtgtcagttaatactttggaacaaacttatataaacagattgatctatatgaacgtatcaaacagtaaccaagcatgaaagcacaatgatttagctgatactagataaaacttgatacatttatatagaactatctatcaatataagtggtgaatatacatgagacaggtaaagaaacatgcatattaggtaaaatcggctgaaactccgatactatccttattatgattaagtgcaggctagtttctagggttcaggctagtttctagggttcaaaacaggactagagatgatgcatcgcaaagtgtgtaaagaaacctaaagtctaaacaatcaagcaattaaacacttttcaggatggtagatgccttagctaatctaatttagtaagacgatttagccgatacccgcattaaccctaaagcgagtagcagctaataaagctaaatcgtgatactaagactagattaactaagacaaatgataacggtgactatgataacgagattaatatgtctaaaacgacatagtagccccgatagcataagccatcgagacgagttacctcttgcgaagaactcgccaaaaaagaagaaaagtaaaagggtggcgatgcgccgaagttgtattggattgtctccctcattacagtgctatggggttcatatttataccccgagtataaaatcgagtccattatggacacgactcaaacctttctaaaaataaaatacaaacaagaccatatacggtggtctcttgccaaatctataacaaaccgac

SEQ ID NO: 4515 - DNA, 690 bp, Oryza sativa
  unsure (1)..(690): unsure at all n locations
tgtattatctcatgagacctacaaaagcaacatctaagctaccctttccacctcctttaagctaaattttccttggtaaaaatgacccctttttttaaataccacaagaagatctttattttcaacagaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacactttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagatttnnnnnnnnnnnnnnnnnnnnnnnnnnnnnnnnnnnnnn

SEQ ID NO: 4516 - DNA, 462 bp, Oryza sativa
  unsure (1)..(462): unsure at all n locations
cgaattcgagctcggtaccctctgctatacatcttggcttctagaaaatatttttcaggaacaattgagcactggagtaggttgtggtccagtacacccattatcgagaacgttctcgacaaatgcagagttgtagcacccaacctaccaacgaagactgacgacttatctcacatatagcaccgaccacgtccggactatgggagaatatgtcgttaacgggtaatccctcgcgaacgacgtcggcttgatcatccgacatgattgcgaacgggcatccggatatgctatgagttgggaatgtgggtcatgctggccacatgagatacacatgtaatcaccaactctagcgcaccttcaggtgatcgagatacacctatacctgatcctcgaccagtagatcgtagnnnnnnnnnnnnnnnnnnnnnnnnnnnnnnnnnnnnnnnnnnnnnnnnnnnnnnn

SEQ ID NO: 4517 - DNA, 938 bp, Oryza sativa
  unsure (1)..(938): unsure at all n locations
nnnnnnnnnnnnnnnnnnnnnnnnnnnnnnnnnnnnnnnnnnnnnnnnnnnnnnnnnnnnnnnnntgcatttgtattattccccacaaacaaagcagtatttctataattggagtgcttggcaaatggcaatagagcatattaataacttctacaaaattaacagaacaaaataaaatccagaagcaagaaggcataaacatataaagaaaataaaacctacacagtattcaagctccctacacagaatgtaatataaccaagctccttagtacaaagaaaataaaagacatcaatcattcaacattcactcaaatatatagagcctacacagtaacactaacacagagtgacagaggtggaggttaaggaatgaggaataacacctgctggttgctcagttgctgccgctgggctgctggctactgcgaggcgaggagtcgtcggcgttggtggcggtgaggaagagtcgccagtggggcttgaggtgtcatcggtggtggtggctgtcgcgtcgtcgtcggtggtggtggcggcggtgaaacggcgagacgtggcgggacggcgtcgtgagataacggggaccgagcaggccggcggaggtgcgagatggtggcggcggccagcggcgaaacggcgaagagcgagggcggcgcgagatggtgggggcgaggataggacggcggaccaggtggcgagcggtggcgcgggccggtgggcgcgggggcgcgcgatgccgcgatctggatgcaccacagccgccgctccgccgccggctcgcgtttgcgtctgtctgtctctctcctctctagggttagccggttagagacttgagttagggtagatgccgcgatttgggttgcgctggaaagttgnnnnnnnnnnnnnnnnnnnnnnnnnnnnnnnnnnnnnnnnnnnnnnnnnnnnnnnnnnnnnnnn

SEQ ID NO: 4518 - DNA, 701 bp, Oryza sativa
  unsure (1)..(701): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagaaaattccacttgatccctctaattcttctaaaattgcagtaattggtgctgagttagattgtaaataggaaagcgtgctcatcacctttcttcaagctaataaagatatctttgtgtggaaaccatctgatatgccgagtattcccagagaggtgattgagcattctttgaatgttagagaagacgtgttaacgaccaaatttggtaaatcacacattggatttgaagttagaaccgaagcggatttggaggagcttggcggttgcggaaacagagtgcaaatcggttgacaactgaatcgggtatagtgtacatcggctgaggcagaatcggatcaggatagtcgatgtagccgattccaataaggagaaggctggatcattgtcgnnnnnnnnnnnnnnnnnnnnnnnnnnnnnnnnnnn

SEQ ID NO: 4519 - DNA, 1172 bp, Oryza sativa
gatcactgcatagatgcgcattcagattgtgttgtgtgggtgaggattgctacaaatctacctgttaatgtttttttaaaggatccatgtatcttttatttctttgacatgtagcctgctggattcagtagacggtagaatcatataacctggaaatgagcagctcaatctgaatgtctttttgtgtcttacagttagggatgaaaacggagcggatatggacggataatgctcataccatattcgttttcatattttttaccggatacgaaaacgaatacggatagctcgaatacggaaacaaatacggattatctcgaatacgaataagaatcgaatatgatcggacacaaatatggatacaattttttctcggaacataaaaaccaactcaacttctaatggaaagaaatatcagcatatataattagctcattttatataaaatgaggtataatttataaatattttttaaaatttaaataatatattaatagtatggactagtgttaagagataaactactattaaaatctataaaggtatattgaaggtcatagagttagaaagaaatggggtatgtctcatgggtcctacggatatccgaatagcactgttcaccggatatccgaattattatccgtatccgacggaaaccctggtaccatattcgtattcgtatccgggagaaaatatccgtattcgtatccgtatccgaactattcgagaattatccgatccgaaaggtatccgtatccgtttttgtccggagcggacggaaactatccgctccgtttttatccctacttacagtatgtaactcaaacctggtgttcagtacaagagtccataatatgctccatggaaacgctgaaaattccatctaagatttggattcaacttatctcgaaaatgaagctgatgttcgtggaaatgaggctaaagcttccttcagtactacgctttcccacttctactcgctctaacttctactcgatcgtttttcacgcgctccttaagctaaatatatccgtactcacgcttttttaaactatttaacggtgtattgtttagaaaaaaagttataggaaagttaatactttattaatcatacgctcatctcttgctccgtttgggaaaaaaaagagaaaagtttcataggggcccaaaaa

SEQ ID NO: 4520 - DNA, 2672 bp, Oryza sativa
  unsure (1)..(2672): unsure at all n locations
cttccacatcttttgatcccaccgatgatggggaggatagcctcgcctctgatcccaccgaagccggggaggataacctggcctcgctctgggaggacgccggggacgccgatgacatcttcgccgccgatgctatggtcgacgaggtgctggtcgaacgcgtctgcgctgttgtggagtccacccccgaggatcagatccccttcgccctcgctttcaaggtcgtggacttacaacgagccactcctcgccgccattctcgtgtccaccgccaagagctgctccggtaaaaagctactcctccagttcaaatctattaacttattaaaggaatagaaaaagaaacctccacgttcactctcaaggcctagagattctcacattaatcgggataagaagaaaagtagagtccatacaaacatacaatttaaaagtaacaaaaaattcagaattaaaatagggaatatagaaagaggagactagagtccatacaggtatacaacttagaactaattgatattcggaattaaagaaagaaaactaaaactacaagtcagagtccctatagaaatacaatttaaaaataactaaaattggaattaaaaaaaataaatattggaagaagcccatattgaatataatttagaaaaactgaaattcgtaattagtagaaaacaaatattgaaagatgagtttagagtccatatagaaatacaattagaaacaacagaaattcggaattaaaaaaaacaggaatattgcaagaagagtctagagtccatatataggaatttagaataaattgaaagatgaaattaagaaaaaaagataaaagtagagtttagagtccatatagaaatacaatttagaaataactaaaattcaaaataaaaaaaaagcaatattgggagaagagtctagagtccatataagaatataatttattttggaattaaaaaataaggaatattgaaaaaacatagagttcacataggaatacaatttataataacggaaattcggaattaaaaagaagaatattggaagaagaatatatggttcatataggaatttagaactaactgaaagtcagaataaaaaaaattaaaaaaataaaagtagaattttgagtccatatagaaatacaatttataaataacaaaaattcaaattttaaaaaaataagcaagattgggagaagagtctagagtccatatagtaatacaatttagaaataagtaaatttcgaaattagaaaataattaataactatcaatacaatacaaaattcaaaattgtgttgctatttttaatatattataataataaaatatggaaatatttaagctattatatgaggaaaaatataatgacgttagccgcgtaatctgcgcgggccatcatgctagtttgtcaaaaagcaagtgaaaaattcatccaagttttgaaagtgagggagataaaaaacgaccccttaaagagagatttgataatttaactcttcttaaacgagcgtcacttcgattatttaatatcttgattcactttcattcactcggatagacccacgtatcatgcttataagtgttaattaaagtaaattgaccataaaaaaagttaaattattaaatttatcctcagagtcatcagaaacgaaactagaccaatttaacggaggcctaacttgggcccaaatcaagcccatagataatgagatgggcctgtggggcccactaagcactaggagcggaggcaagagactctccgcgcacatgacgccttcgtgtgctttggactcctttcccccgccgccgctgcctcttgccctctcgtctccggccaccagtccactgcgactgcttgacatggcctcggcgccgtcggccttcatcggcaaccacaaggtcagttacctacctccggtcaatggcattgaggtctccgtagagcaagcggtgccgtcctcttctcacatttcggctggcgctgaaacctaacataacctggatccatggcagcggcgtgggcgtggtgccctgtggaataggagcttgtgtgtttgtgctcccagcaaagtggggtgagggatgtgtggtgttttggatttcggggggggggggggggtggnagggggagccgtcgcccatcaggttctcctcgtgggcgtgagctttcattcacatgtggtgtaccggtgtggtgtagccacagtcggagtgggtgatctccgagatagggtctgtttggttgtctgcggattgagaatgtgcatactgcagctggttgaatccgtcagataccagagcgacatgcgtgtttcagtgtttgtcttgcctttagggtttagcggttgatactgatgaaatgagagtctgatcctagagatagcatggcctgcaggaggtcatttgtagcgggttggacaccacgggcagtggacgagctgttagctttttgcaaacgtgtagtacatccgttcacggtagagccagttaggccagttaggtttagtatatagagattcacagcagtccttgatgagggctaacttcatgagttgtgaaattctacagttataataactaataaacagtggtgtgtgatggattaagatggcgtattgactggcaaatacaattatacaacagtagattatatgcctttgctatgaa

SEQ ID NO: 4521 - DNA, 11892 bp, Oryza sativa
caacctactaaatttgaagtactggtactgatagtgctgttgtttgaactgagcaaaaagcacttgcagacttgagaagaatcaatttagatggtttgagatggtgtgtatttgacgcaaagggccaggttaccatttttctagtggttccagttgttaagcaaatattcatgggtaatggttttttaccaagcctttgtttgtgtgataggtccttggacggttggcgtcccaaatagctgttgtgcttcagggcaaggacaagccaacttatgcaccacatgtggaaaacagagacatgtgcgttgtgcttaatggataagataactgaaatgtaactgtaattattgttgtacacatctttactatggtgcttctatgtcttaattcagttaagttttcacactagaaggtatgtcttctcgttggtgaagtgataaagctactgttcattttattcattgtttaatgatatagactttttttttgcagggttagatatacacttatgttagcaaacacttggatcttttcgtgaactataaggatggttgtgacttgcgaagggtcttgcttcgtatgtaccctgtatgcttttagggtctggtttctgcagtgcctttgctgaactagtgatctgcttctatatcttacaattcctctatgtggtggggattttcatgagaactgtttatattgaatatcaagttcaacataccataaaatccaaccatttcttcttggtttcatattcaacatgaaaattgtatactgatatttatggtgtttctttgttatatgatttaattctgttttgtctgagaaatcaagttttttcctctctggtataatcaagtgtggtcaaaaatgtatattttcctacaattctcatcttcgaattgttaaagtagcttcatataacgctgttattgcttattaagcatgtactgttctgatcacaggacagggatcgtaaattgaggatattttctggaaatgagcacccattccatgatcgccctcttgaaccttttgtgatgccaccacgccaagtgcaggagatgcgtccccgggcaagacgtgcattgttaagggcgcagaagaaagagcaggacagagcagcggcatcaaccaaagatgatgaaaatgctaagaatgccaaatccgagatcactgcatagatgcacactcagatgtgtgttgtgtgggtggagattgttactactcctatattgcaagtctacctgttgctgttttttaaaggatccatgtatcttttatttctttgacatgtagcctgctggattcaatagacagtagaatcatataacctggaaatgagcagctcaatcttagtgtctttttgtgtctcacagtatgtaactcaaacctggtgtcgctaggaatgaaatccatctgctttgatttcctctgctgttggtcagtacaactgtacaagattcccatcataatatgttccttggaaatgctggaaattcctacgaagttttggattcaacttatctcgaaaacgaaggttgattcatggaaatgaggctaaaatatgttgaaaacaattgttagtaatatactatagtttaggggaaaaagagaaaagtttcatagtggcccaaaacttgtcaggccagtccaatgcgccatcaaggccttaaaccctagaaagcaagtaagaaacctttcgcctcccatctcgactcgaccagtgatgactctgcctccacacgttacagctaccaagccgccgccgccgccgacgatgatgagaagaggtggcggcgttcgggagctcgtgctctcctcttccttcgcccctccatccacaggcctctcccgccgccgccgccaccaccgccatctccactttgacccttaaccagagcgctaccacctccgcgccccctctcccgcttcctctcgtccccggagtccctgccagatgccaccggtggcgctgcttcctcatcctctgatcccaccgtatacaattatacaacagttaatgtatatgcctttgctctgaattgtgatcctgctagtgtattcatcctgccaatgattcctcataataccccaaaaaattatagggcatacagaatctgcagtgacatgctgattgaatggtcaaaaattaagtttttctgattatttcagtattgcagcgagcagcttatctgtgttcatatttgcactgagcgaagtaagctctatacattgtttacccttgaaaagaatggagtctataattgaaatatctagatagctatccaatatgaatcctgttctacatctaccctattgtttcagtctcttagtttggaattacattaataatatttttgagcttcaacctactaaatttgaagtaatggtactaatagtgctgttgtttgaactgagcagaaagcacttgcaggcttgagaagaatcaatttagatggattgagatggcgtgtatttgacgcaaagggccaggttactatttttctgctggttcctgttgttaagcaaatattcatgggtaatggttttttaccaagcctttgtttgtgtgataggtccttggacagttggcgtcccaaatagctgttgtgcttcagggcaaggacaagccaacttatgcaccacatgtggaaaatagagacatgtgcgttgtgcttaatgcaaaagatatcagtgttgcaggaagaaaaatgaccgataagatctactagtatatttctagctaatactgttgaataccttttggttttattatttacaattgcctgtttgtgtgctttttcaaataggcatattggccatttgaaggaatgaagactcaaggaccacatggaaaaagacccaactgaagtaattcgcaaagctgtcatgcgcatgcttcctcgcaatagattgcgtgatgtaagtgaaacatcatttctctttgtttctgattggagacttgatgctagatttatttggtgctatctatacactcatgaggacatcccagctacacttgatgtaaaccaagttaatggattatgtctcagcatgaacgatcaaacatatcttggtctaattacgtgcaaccgtgctaggaaaatacatcaagaggtgaactcactatttactcatcttaacccaaattttagtgagaattttatactacctaaatgctttatccttgtattgctaaggtttacacctgaggatatcatcactacgtcaagaaggatgagttacgttgaggacgacaagggttatgccgaggaggaatcaacccatgcccaaccagcagctgtctatgctaacaagaagatggtttacgttgtaaagactcaacttccaaggcttgtgcgacctagccaatcaagtgacggattgcatggcatacattgttggaaagagggacaagtctagtttccaacgcatcaaatcctacctcaatatctttatccaataagaagttatagcatttttaatgaaggctgggcaggaaagagggacaagtctagtttccaacgcatcaaatcccacctcaatatctttatccaataaaaagttatagcatttttactcaaggctgcgcagaagctgaagggctatgcgcgaacccgagaaaaacactttgccttctcatttatgttagccttgaccaccagaacgtggcttcttatgttcacacctaagctaggagggatgttcctaataaaaatacccctctattccttccattagagaacttttattcaattgaaaacctcatgtatgcataagtgtcttacccctttgttcttgtgagttcttttagacttgttagaaggctcctctggtgccccctagttcgtgcttttggctctcaggcctcctgtgtggattaatcctggattgtggttctgtgattgctcggtttgatggtcggtttgacaggtcggagtacaggaggcctcggatcgttctcaccctcaccacttggtcgcattcaaccttggcaggtatcaagcagttattccggaagtggtcgcaagctagttattccggaagtggtcgcatccaaccttggctggtataaagctagttattccggaagtggtatccaatcttggcaggtaaaaagctagttattccagattatggttctgtgattgctcggtgtgacgggtcggagtccaggaggcttcggatcattttcgccctcaccacttggtcacatccgaccttgctaggtataaagctagttatccacttgctgctcgtagcttgttatcctcttgagtacggtttgcgctggtgctcttttgcttcaaacctactgccgtgaagattgggccacccctcgcgagtatgttcgcatcatatggtatcagagcttcgttgacacagtatgttcatcatccacgtatcattagatgttcatgtgttcttgttgattttgcttctttgcaatagtccagaaaaatccctacaaaaataccaagcctttggtagtactgatataccatgtctttcatttccatcatgttgttagttcctcttgttatcttgcaccatcatttttttcccgcccacccacccttttgtttcatgtttgctagctcgtgttgaaaaaaaaaagagcgagaaccgaaaaaaaagaaagttataaaaaaaaagagtcaagaagaagtgaaaaaatatatataaaaaagaaagcgaggaatattttgacacaagaaagttgtatgttttgggtggtgctgtggtaatcgcttttctatcctttggtgctttggacaacagcgttcacatcattctttgcatggtttacgtcactttgtatcagtactatagccttccttgttcgattcgcattctttcagtcacaaaatcacacttgagtactgccacattttgcacgctctcacagtccttgagattgcataacattggtgagtaagaggtgagattgtgtgattccataaatttacctattccactatattttttttagagctaacatggcagattctcaatcgagtgtccatggtgaaaatcatgacaagcccgatagtcctgtcacacaggctgaggtgcagcaaatagggaataatcttcttcaagggatggaacgtttgttgaatgcacgacttccggctgccggaagtggagtggttcagccaccgtttgttgatcccagggatgaaattgtggatgcacattcggcggatgatgttgctaattctgagctccatggcccgcctaatggtggaggtcatggttttgtagctgctagagcacgaggaggaggtgctcgcgggcgaggccttggcccccgtgcgcactttgacggtcgttttgagccccatggtcatcaccatgtggaggaatatggtgataatgatgtttttttttcgcaaagcatgatttggggcagcggcatgcccgtcctcaccgaggtgctgtccttggcaatgcaggacatcatcatggtcgccatgatcgtgatgacccagacaatgttgctcgggtaaagttgagtgttcccaagtttacttgaaaggaagacccggatgcttatcttgattgggaagaacagtgtgatcaaatttttagagtgcataatctttcatctcaaaggagagtaaagcttgcttcagtggagttctctggttatgctttcactttgtggaatcaaatgcaagaaagtcagcatgtgctgggtcgtgatcctattgaaacatgggatgaaatgaagcgtgttatgagaagatgttttgtgccttcacgttataggtgtgaccttcacaatcggctacaagtgttgagtcaagggactcgtacagtggatgagtattacaaagaaatggagttgctcttgatccgtgctcaaattagagaagatgatgagtcgaaaatgacaagatttttgcatggtctcaatgctgaaatttctgattttgtggagatgtttccatacaacactttgcaagatcttctcgatcaagctcggcgcacggaaaggtccattcggcaagaatggcgtaatcagtcctctagtggccgctccaatgcagctccatggcatcgcatgcagcaaaccactacttttgttggcgcttgttcttagggagcctccacacgagcctctccacctgctgttacagccaagccacaaccatcttcggcaacatctccagctgcatgcacaaattctcattggcctgctgcacctatagcatcatcttcgtcccgtagccgtgatattgtgtgtcacaaatgccaaggtcgtggccacattgctgccgagtgtcctagtaggaggaccatgcttgtgaatgagacgggtgaatgggaatctgcaagtgagacgaagggatgacagtttacgtgaagaagtgttgattaatgagcaagtggataatgataatggtgacaataattgtttcatttctcatcgcgtgcttagtgtgcaagttgcaaaggaagaacatggtcagcgacaatatttttcacactgatgatatcatcaatagtactgtttgccgtattatttttgttagtggcagctgcaacaacattgctagtttggagttggtaaaaagattagacttgaaacaacgacgtcacccaaccccatacaagatgtagcggttgaataattgtggtgcactccgggtgaaaactattgtgacggttcatttctccgttggcaagtatgaagaccatgttgagtgtgatgttgtgccaatgcaagcatgtcagttgctactcggaagaccttggttatatgatcgtgatgttcagattagtggtcgtgccaacaagctcgttttcatgtaccaaggtgttcctagaaaaacacggcaactcgggagatctgcttagctccagtgcaagtcaaggcctgcctagtgcgcttgtagggcgtgctagctagtttgatcctgcaaccaacaagaaacatgaaaatagagttagttgatcgacaaccgatcggctgataggccgatggcaattgcatctattaattaggatatcaggtcggtttgttatagatttggcaagagaccaccgtatatggtcttgtttgtattttatttttagaaaggtttgagtcgtgtccataatggactcgattttatactcggggtataaatatgaaccccatagcactgtaatgagggagacaatccaatacaacttcggcgcatcgccacccttttacttttcttcttttttggcgagttcttcgcaagaggtaactcgtctcgatggcttatgctatcggggctactatgtcgttttagacatattaatctcgttatcatagtcaccgttatcatttgtcttagttaatctagtcttagtatcacgatttagctttattagctgctactcgctttagggttaatgcgggtatcggctaaatcgtcttactaaattagattagctaaggcatctaccatcctgaaaagtgtttaattgcttgattgtttagactttaggtttctttacacactttgcgatgcatcatctctagtcctgttttgaaccctagaaactagcctgaaccctagaaactagcctgcacttaatcataataaggatagtatcggagtttcagccgattttacctaatatgcatgtttctttacctgtctcatgtatattcaccacttatattgatagatagttctatataaatgtatcaagttttatctagtatcagctaaatcattgtgctttcatgcttggttactgtttgatacgttcatatagatcaatctgtttatataagtttgttccaaagtattaactgacacattatcttttctgtccctaaacactgtcctatcggctattttcatggtatcggctaaaatccgttttaaacctactggacaatatcacagccgatatgatcctgctgtatcggctgggatcccgtttgccatggttagaaaaatcaaaattgctcctgtaaaatgtatgataaggcaatagttagagagtataaagttctctgctcctgttgagtgcacttctatgattactcggatagcaaaagggctaggggtcgttagcgaccaaattgcttttatcttagccgctcgtccacgtattgatgaggcttatctagtgcaagggcatattctgaaacatggagtagatggatctttgatatattttttttcccggttgtacaaatgaaatcccgttgccaaatatttctccgtggacaagtaagtatgttattttgctccagcataatgaaaataatttcctattgcaatgcataggtgagctgctagtttggaattaataatgagaagatgacatgatccatgcattgacaatttaacatgcatgaaattgatatcttctgtaaactgtcaggtaatgtagaattaggccccaattataaaatttaccagagtagcatttcttattaatgtctagagcgtattaactaaaacaaaattgcacttccaaacatgattgagggaacttcttattggaaaaatgaatttgaaccatattgagtaaaaatgcattggttgcacagatatttgatcaggtaaatataagagatatatcaaaaaacttccccaacaagataacttattaaagaattggtaagaaaactgtacctgtgaaaggagaggttgtgctccttccattatagatgcaaccttttcagccaaacttaaagcttttatcaacaccaatttgctccatgtctcttcctagacgggtaagaattccaaccattgcatctaagcttactccctgttgtcctttgatcctctctttgtcacagagaactaagccttctctagaacagtctgggtcaagtgggccaaccgaaggtgttgggagtggatcttttggtgtaatatcaatcattgtctccattacaagaccagactggttcacctcaaccaatgaattcagcccagaacaaattggtatcagacgtaatcttgtctacctacagcttcgatcaaagaatgcagcaaatgaattaatcaaagcagagcacactactaggaaaagcattatcgcaagcggtcgaaaagggtcttcgcaggcggggcggccatccgcctgcgaagataattttcgcaggtggacattggctagtccggtccgcctgcgaaaataggaatcgtccgcttgcaaaaaaaaaacttccgcctgcgaagataggtagaaaatattgaaatttaattataatttggccgtaaattacttttaaattatttattagaaattcttgcaggtacatatattggaagattatcaagcatttggtactgagaaatctacttatattgcataaatcaaaagtgttgccaaaatatatatattacaatattgttttacattgtcacttcaaataacgtcatttagttatattatggcatagcagtgttctactcccaaagatccttgaattcgtcacttgccgctagggcaccctctgggtcgaagaaatctcctttgacatgagagcactcatggtggatgaagtggcacagatcacgctgcacatttgtgatacctgtatcgtcaaagcttgttcgacattctaatcttggcaactgcatgcattgaaattaatcaatatattagtatcataaatatcaagagctgtctaatacatagtataaagacttacatcctccgcgttaataaggaattcgcacgcataatatccgcaaaggaccgttccttgcggttgcttgtgacactgcaggacatatcatagaaaaaagtagttataatttgcaattagtgaaactattggaatacataaagtgagtggagtattaccggccaataggtacgtaatagcagcttctcccgtgttcgggtctgttcttcactcttgaacttgtagtattggtatgcactgtatggatgtcataccatttcagagtaaggaggatatttatttgtaatacattcatatacaaatgcaagagtcataataacttactactgtaagattgttagaaattctttgtattgcttgtgattgtaatcgagaggatccaagactaccacggttccgtctttagggtggatgagtaaacagatataatgatcgctacatattaacaacattataattagttagtaacagctaaaataagacatatgtgtacaagataaatgtaccggacttacttaaaattataagcggccatgacgactctcttattttgaaagtgcaagaaggctcgtccaatgtactgtgcgacagtaatcaatttctccttgtgcaagcccttcttgtattctgctatctctttcagattcttgcccttcagctggtctgaccctggtgctagcgtaacgatatgctgtgtttggcagatccgagttggatccaagaagccgatgggttcttttttcttgttagcatccatgtattgcatcctacagaagaagtttgttagtaataatcacatggatttgtattgtacatatttttcatctaattaattaaaactcatactcacatgcaccaaacaccgacatagttgacgtccatcttatcccgacgatatatggcgtggagatctgagaaatctagccatacgtaacctttttcgccgaaacaatctgccggtgatcgagctgttatattacccaagcctttcttgctggcctccatatggaagttatgcaaccttctcatctcccatggtgcttctttcagtgcccattccggcaagagtgttttcccatgttcgtacttttccaggcaatcatcggttgcgaagtatgttggcccggctagctcagaagccttctgggggtcgtcatctctgagcttggcacgttccttaccccctctgaagacggttagcatgaacttctccttgttcgcatctttggacttggagtcgtggctcctaagcactcgtggcacctcgggttctttcgtaggagaagggtcttcaaatatctctggctctgtaccgtcccattccaatcctggtacttcttctttgtctgacccgactgatgccacaaattccacctctagttctgccactgtaatctctatgggcacatccggcactggaatctccatggctgtctccggcgatgcaatctccatggctgcctccggcaatgcgatctccggtggcacttccggcactggattttccttatccatctctagatcatccgccttatcagtcaccttcctcttaggaggcctcggaggttttcccaaccccggtttaggcaacacaggtttttcctcggcatcggtgcccaatccaaagaatatgtcattcttgtgccagagaattacaagatcgaccgcatccccaagtacggatatacaaaatcaaatcatcggcttattacaaaatactataactattttttgattgcaccgaataaatagatatttaaaattttttcctctctctatacatgacaagatctatatctagatctagaactaggtggtggatatgatagcaaaaaataaaaaaaatgagaatttatgttaccacattaaaccactacaacaagaggcatcaagtattacacatacatctaacataaacatatgaaaagaaataaaattaaaaaacatggagctcttccttcacaattttggatgcataaatccatcacaaattaaggtctaaaagcttaaaaaactgcatacctagtgtggaaatgagtagatctaagtaccatacaaaaatcccacgaagatttgaagttcaaaacctcctcccctatatttaagttactttaggagagaaaaatgtcggggagaatgaacagggctcggggaggaagaagactatataggggcatctttgcaggcgggccatataagcgtcgcctgcgaagattgatcttggggatcct

SEQ ID NO: 4522 - DNA, 7316 bp, Oryza sativa
caccttatgaaaatactacaaatctaaaaaaaatagaagaattacactaaattcttggacagaactatcattcaagatttcgttaacccgtcctctcctctgtcatgagtcatcgctcattttttccattttttttctcctctccccctaaatatttcggcagaggtagcggtgaggaatggactcatcggacgaagattttaagggtaggagcaatggaatcggtctaaggccattcactccgcagtgcatgttacctcttttgcatgactttaattgaggcgagctactcttcaggctacacatctcacaaatgcatgtgaccaagcctagcaaaggtatcccagcccaaggattaaattcctccaactaccctttctgcttatctggacacatcgcctcaagccctcgtctcctagtctaccatgccgcttcatctcccagtcagcgcgctgcttcgcctcccaatccactgtgccgcatttgccgaccactatgccccgccacagtcagttgttggcgatgaaactctagagtggactggtgcagctcctacccaggtataccccgtccaggaagacaagggcgaggggagaaagaaaaagggcaaggcggcgagaggagttgctagaacctcacgctacagtgctccgtcgacctcggctccggcggagagctcaaactcgttgattgagatgtggaccaaacctagcgtccaagttgtgattgacatcgacggtgtaccggtctgatcatccctgactgctggttggactagtctaatgccgcctgttggactagccccgtatatatgaaaggcacgggtcttttccaattaaatctggtcatgttttcctatttttgtttagatgctaaaatttggatgttaacaagagtatttctatatataatataaagttttatatgtataaactttggttgaaaagagaaagggaagtggggtgttcgtcttgagcgaacttgtctccttcgttggactcctacccccgagcccgtggggcccgcggaagctgagacgtagtgctagagctgtacacgctatcttttctctaactaaccgcgcgtcaagttcgcatctttgatctttccaaattccccgatgattaaatcacccaaccccgactaataaatataaacactagcaatcatcgtcatcatccacaaaaccctaaacccaccaaacccgcgaaggcggcgacggagcatctatcggcttctccgatcgtacctacgcgcgtgccctaaaaagctagcgccggccggcgcgccgtacgtacgtccgccatgttgccggcgatgccgtcgttggcgatgctgttcgccgtcctcctcctctgcgtcgccaacaccctcgccttctccttcttggcggtcaggatcttccgcgccgacggcggcccatccaagctgaccgcgtccagcgtccgcaggtcgaccaagtgcatcctcgtcctcgcctgcgtcgtcgaggtcgccgtcctcttcgcctccctccgactcgccgccgaccgtcacgccctctccggcgaggtcgaccacatgcgcgaccagatcgaaaccctgcgtgagtagattaattcgttaccaatttgatctatcgactttcttaattaattttagattgattaccaatttaatctatcgacttgctaattaatttagattgattatcaatttaatctatcgactttctaactaattttctcgtattaagtagttagatccaaattaatataccatattcttgaacactagcatatttaccacacgtattattatggttgcatgtaccttgggcattgcttgaaatagattactcaaatacttattgctatggatgattctgtagataaaataaatatttttaaaaataagcttaagaaataactttaaataatacaatgttgtagaattttttttaaaaaacatcaatttttagaggcatggagtaaataattcgcggatattatatttatatggtgaagtagccgaaaataattgattgggttttgtgttcttcttaattttgaatttgtagagcttaattacttgttctgaattatttaaatagaggatgagatgaatggtttgcatgtactaaatttattgggctttgtgtgctccttaattatggatttgttatacttaattaattgttttcacttttaacagaggatgatttgaaggttgttatacttaattaattgttttcacttttaacagaggatgatttgaagcagtatgagcaaccgttctctgcgttgagtgattatctcggcctcagcgtgctagagctgggtagcgccgttggacgcttacgtgagtatcatcgcatcgtttaaatagtttctccaatatgtatatggcatgccttatttaccttggcgcacttaatttgcttatataattaatcattttatgcttaatttgcattgatcatgattactacgacaagaacaagtacatctagaataaattggtttcactgagctattttatcttgaagagaaataaatacagtttcagaaatgacatgcagtccagtggttacagtgacctgagtaccacctaaagatctgagttcaaatctccataagagttcagattgggttatttgaagtctaaattccttgtttgataggctaagttcctaattttaaaaaataccattctctcttaaaaaagtacagtttcaggaatatatctgtaggttcagtggacatttagtcctgggttattatggtgattgaaaataaaactactatagcaaacactcgctatgattacatagttaaatttgtctgtgctctaaacgtttcctgtagctcctagcaaatacgcatgatcgagtattcgttgcagttattgatgctttattccaccatatgtaattattgtatatctagattagataattttagtctgcttgatatttattttacgttctttttttccttcttgtgttctttgattaattaggtgataaggaggaacatctagtcaaggaatatcgtgatctgaaactcgagattgaacaaattaaatctgatatacagtctctgcgacatgagaaggaagggagaggctaccataaggttttttctttttctgctttcatgtcgctttataaaactcttttttttccctcataccaatagctttttcattgtaattgttacacaggaaacattaggtggcacctcaaatcagcaaaaacaagagaataacgagaaaacaaagtatgttgatcagaccttttttgggggcaatttttataagttcctgttaatttattatttgagttacggatatgatatggatttataattggaataatgaatttgtctgaattttcatgttcaaccaggcaaccagcgatagatggtattatgaagtcattacgagcaaaagcaacaaagttgcagcaggtcaagataaggtagtctctgattgatgcgcattagcaatttaaccaaaataaatcaagtatataatacagaatgaagttaaaacattctttttacctttttttttcttcgcagctttccttgggagaagatgaagaaagccaagaatatattcagcatggatttcaagctacggccgtagattagtttaagaagttcccgaaaacgaatttaatctagtcatcaaacaagaaatgcagatgtgtaattgtgataattcacatttggatggtctcagtgtactttagtcagagttttgttatttatgaaccgtttttctagagtagatacctcgtggattcttcgtattttcatcctaattgtgttatcaagcttgttgtgcaaatggtatgcccttatgtcaagcataaatagctatactagaaaaaaattaaatttcatgagttgcaacggttgataacatttttagattgctatacattttactcttttattttggaccaaaagcttattcttccctttcttttcagtcctagtccactaaaatataagcaccaaaagctcattctttccttccttttcagtcccagcccactacttcagctcattctttccttccttttcagtcccagcccgctacttcttaaaatatattatttccttccttttcagtcccagcccactacttcttaaaatataagcatatgtcatatgtccagattcatagccaaaagttatgttttaggacggccaaaagttattctttcccttctttttcagtcctagcccatataagcaccagaagctcattcgtctcagcccactacttcttaaaatataagcattttctaggtatgaatctggacaactgtatgtccagtcctagcccactacttcttaaaatataagcattttctaggtatgaatctggacaactgtatgtccagtcccagcccactacttcttaaaatataagcattttctaggtatatgtccagattcatagccaaaagttatattttaggacggtcaaaagttatattttgggacggaggtagtaccttcctctgctctttcaccaaacccaaaacccacgaatggagccgtaggtccagcttgcatagctaactgtacatcaaatccctcgcatagctgactaaatctcgcatagctcactgaatctttcgtgtccatacgatgccattctcgatctatagggcttttgatacactcgatctcctctcaaatccatttatcgatcttctctttatgtttctattaaaatcggagcgattctccatctttagggcttttgatacactcgaagcttttgatacactccatctcctctttctgtttttatcaaaatcgatcttctctttctgtttttatcaaaatcgaagcaattctcgatctttagggcttttgatacactcgatctcctcttttgatttttatcaaaatcggagtgaatccgattctcgatctttagggcgatctttagggcttttgatatactcgatctcctctttctgtttttatcaaaatcggagcaaatcataggaaaaatgaggaggggtagtggggaatcgatgaacgcatggtttggtcgggcggcaaaaaaaaacatggcacataaaaaaacaaacaccgtgtacgcatatccttcggcgtgcgaaaaaatacagcgtaaaagaatagcgatgaaaaaaaaacaaaaccgaaaaaaagggtaaatcccggctgatggaaaaaaaaccaaaaaaggcgaagacaaaaggcggacgaaaaaaagccgaaaaaaagtggacggaaaaaacagcgaaaagaatggactaacggaaaaaaataaacagctgaaaaaaagcatacaaaatagacagaagaaaaggaaaaaaaggaaaaacgagagaaaaaaagggaaaaaataaaaggaaaaaccgcagcaaagaaaaaaggtggatgaaatatagaaaaaaaggacggaagaaaaggaaaaaaagggaaaaaagggagaaaaaagggaaaaaataaaaggaaagaccacgacaaagaaaaaagacggatgaaatattttacggaaaccttgtgtttttttaattaggtatatatatatatataggtatagatactaaaaatgtgacgagtggtctaacaaaacagttcatcttcccattacgataaaatatctcactgaatttatagtgaacttaattattattcttaggattacgaaaatgtacaaaacgatgatttgtaagaggaaaaaaggaaaaattaaacacatgacctgaatttgttgacaacaaattaagacttgaaaaattacatagcttatccccttcattgtgaaatataaacagttttagttttatactaagtcaaattattttaaaattaattaagtttagtttatagatgagagtatttttcctccggtttttttacaaagtatttgcaaacggtaaaaaggtgccttcctgaagtgtattagagcattaccaacagcttatcatcctatttccttcccaaaactaatttttagggtttttgtaaaaaaaacagatcaaacagatcctctaaagtcctgcactagttttatatttcgttttgtggattcgagggcgagagagcgactcccaatctcttgttcatgcgtctctcctccttccccatgcttctcctctctttctgtgtaagcggagaaaatttatgtagggagcgcgcggatgatcgcgatctctttctgcgagcgtggaaggaaaaaaaacaaaaattttcgttggtagtttaacagaagggtccagttttagtttttttttattgaatttaggctatgtcttggagggataagttttttcacttcctattttcagtttaggaaacccaaaaatcaatatgttggtgatgtcttacatcgtaaatggaagtataaaacttttgttccctttacactactggagaaatcatctttgctgggttggtaaaaaaatatattagccctggttccaatagtaaccgggactaaaaaaaacatttttagtcccggtttaaaactccaacgggactagatgacctttagtcttggtttaccctcttatagagtctctgccttgtcagagggttatcaggggctagggagccgagaatctttagtcctagttggtgttaccatccaagagtaataatgataaaagttaaagttgtcgtttatttaaaaatgagagattaacatgtaccacgtcaaataacaaaacaatgaaaacatataatcgatataatgattctcatttcatatcttaaccattatattttataaacccgtcgaaaacttacgatagttattttagaaaaaattcgcttttatattttaaggatagagggagcaccgttcttgtgagaatattggtaccggtagcctgggactctttattagtaccgatcagccaaccaaaaccttgtgttagattaggataattattcaagacggcgtgtcttgttagcctttcttcataaagctccgcccatggacatatcggccaggcttcttctgcgattgaaaacgacgcaggcgtctctcatgttaaacattcttttgtataggatatagcaggtgatttatcttgtacttaactggtagtcgaaattttggcaatataaaaagggtaacgaataagctataaagtggatgggttaggaggcaaagctctatagatactctataatcataactgactaggactacgggacatgatataaaagttaacataatacccgagtccttatctatatatattctatccatatgaactatcccctataccagtcggatagcataggcatatggatataccggatccataatct

SEQ ID NO: 4523 - DNA, 28972 bp, Oryza sativa
  unsure (1)..(28972): unsure at all n locations
cnnnnnnnnnnnnnnnnnnnnnnnnnnnnnnnnnnnnnnnnnnnnnnnnnnnnnnntaaagttgtcgtttatttaaaaatgagagattaacatgtaccacgtcaaataacaaaacaatgaaaacatataatcgatataatgattctcatttcatatcttaaccattatattttataaacccgtcgaaaacttacgatagttattttagaaaaaattcgcttttatattttaaggatagagggagcaccgttcttgtgagaatattggtaccggtagcctgggactctttattagtaccgatcagccaaccaaaaccttgtgttagattaggataattattcaagacggcgtgtcttgttagcctttcttcataaagctccgcccatggacatatcggccaggcttcttctgcgattgaaaacgacgcaggcgtctctcatgttaaacattcttttgtataggatatagcaggtgatttatcttgtacttaactggtagtcgaaattttggcaatataaaaagggtaacgaataagctataaagtggatgggttaggaggcaaagctctatagatactctataatcataactgactaggactacgggacatgatataaaagttaacataatacccgagtccttatctatatatattctatccatatgaactatcccctataccagtcggatagcatagccatatggatatacggtatccataatctctgatgtggataagggttctcggtcttccgaaaggttatcgtggagattatgactaccgtatatccacatggcaatgctatccgactattataggggatagtttacgtatatggaatacgtatagataaggattcgggtattatgtatacttgtgtatcaaggtaatgtctgtagtcccagtcggttacggctacagggagttctagaccgtaagggatagagttccatattgtgatccgagctcctctacctatataaaggggggtcgggacgtccccttagagtagatagaacatcatacacaatcatattttccatcaatacaaacacggtgaaacatctcgccggataggagtagggtattacttcttattgagaaggcctgaacctgtataaaccctttttgccatctaacccatccactttcttagcttgtacgcaaccccttttattattgccgaaatctagtttcgacagttggcacgccaggtaggggtagcgtcaattttttcgccgactagtgcgatgggatctacatcaggcattgacgaccttgccttacctcctggccaggcgtaccgcttcagcagcctcgacttcatcaccgacaacttcggcaagatatctcttctcgactcgaattcgaaccagtcaggaggagacgacgactcggctccgttcggtctcccgaactcggccaagatctactccaatacgttttctgccgagttgaccacaaaccacccaggcgaaagcatcaagacttcaactccttcaccaagcttcgtgggagacacgccagcatacccggagatcaccatgcgacttcccgatgatcttgcatgcatggtgttcgactctagaggatccccgcgctctcccccgtaggactcggtccgatctagcctcggctcagattagatctagcttcagggaagtcggcgtcatccttcagccactcaattcgtgttcatcgaccgagatcgccgagtacatcagcgagtctgactgtgacttggccacgaatatagaacacatcaactatggtgatttcgacgaccacttcgacttcgacaacttctcctgctacgacggctactatgacgacttcgacgacgactacacacccctttattttggagtgttcatggccgacaatgagacggaagcacagaaggtagcccgactagcggaagaagaatggcttaggctagaacgagaagaacaagagcactagctcaaggaagatgaagaccgccgacagtgagaggacgaggagcgtcgacgcagagacttggccaatcgtgggcgtaatgtccaacagcgtattgaccagaccatcgtcgataacaccaacgttttcctcacaccacagcagaatgcagttgctgctggacaccattatccctcaagccccggtgcatctcacgccaacactgaataggatgaaaactatgatcgctgcaacagtcccggatgacttaggaggcaacaggcaacctgtcgacgttagatgtcgcgattccgatatttgcacagtatgaggatcgttggtactaggatatacgcgagacttaggtaaaagagacggagacaaggatttttatacaggttagggcccctgaattgtcaggtaataaccgtactcctgttggccgaagccggtcgttgctcttattcatcataatcatgccagtacaatatttggggtagcctatctatatgttgtcgacttggcggccataaaaacatcccgcagtcgacaatagagtagtcttcctcctcgaatccatgtccggcgagatcagagacagcactagatccctcctaacagtagtcgtaggaaccgtatggggactactaggcttatctccaatgttgatatccggcggcttgtcttggcgtatgttggcttgtatgttgatcttgtgtcttgatccattgttccgtgtcccctctcctcctagggggccttgtatttatacccataggtgtccccttgtccaagtaaaactagggaaaccaatatggatacaatccgagtagtccttgtcatttccatgtagaattctattcatccttccttatgcggaactcctcctatatccgaaggttttttccgtataagacatggtatgtagtgggtcctaccgagatttagtcaactactattaggtatgtggtatccataaccctgacacaaccaacagcttcgacacacacacacaccttcaggaagccgactgccctccatacgctcgggagatcgccagcagcccgagtacagccggattgactcccgactgccccactcgggaagacaccattaggatcagtctgtacactcttcagctcgcgcgcgaaggaatcaacgagcgcactcggaatatcagagttcctcccgagtacctgatcttcgagacacactcaatgcacgatgccgagtacgacacgaagggtatcatcaccgagagcgacgccactcacccgacaacgacgatgaaggagtcaccgccttcacaagcgacctgcgtcgagtgaattggctagctggcttcaaaccaactggcattgagaagtatgatggcaagactgatcctgaatcatggctcaccgtctacacttgcaattcgcgcagcaggaggagacagcaaagcaatggccaattatttgcctgttgccctagccatctcggctaggaactggctcgttgggttaccgcgaggctcaatcagatcatggggcgagctccgcgaccacttcgttgcaaatttccaagggacctttgagcggccgggaactcattttgaactctacaatgtgatccagaaacctgacgaatctttgagtgattacattcgacgtttttccgagaagcgcaacaagatctccaacatcactgttgacaacattattgctgcattcaccaatgatcaactcatcggcaagttcgaacgcaaacctcctagaacggtcaagcagatgtatgaaggcaaaatttgccacaagacacgcaaagattatggtctttgctgtgggacacccgaagatcgtgtttttgctcgtggacaccgcaaaaatgtggtaattagctagaggacaccagccgcattattttattatttgtcgtcgaaacggagagagaaatagcgttgaaagtaccaaaatgcccctagacactgttcttcttccttctctttgcttctcttctcttcttcagcgagggagcataatccccaacttcaccggcacgttggcggtgagccgctcctggtgaactgtcgtcatcgtcatccaaccatcaccacaccaccacgtcctggtcgtctccaaccaaccaaattcttgcacacacacacgcttgcacgcagctccatcgagctatggctggagtgaacaacaacctcgtcagcctcaagcctgccgcggcggttccgcagtcggtcgcctcgtcggcgctgccaaagcgcgtgcacgtcgcgtttgtcacaccctaaaaatccccatgtataaattgttgtttaattggaattattagaaatgattttaaaagcctacaagaaaagatctaattttaaataataaattccaatataaaagtgggctagataaaattttattaaatacttctcttaattctatagttcctagatttttctgggatttatttgagccaagaaagtatttttaataaatggaattgcatttcatgaataatttaaattgaaaaaggttttaaaaatcttccttttggttttgggcccaaaaccccctccctctctctccccggcccaatcgcgcccgacctagtccgccgagccgagcagccgctcgccctcctctctcccgctgacagatggggcccacctgtcagggccgtcgttttcctcccgccacagccgcgccctaacgcgcgcaagccaccgctgccacccttccaaattcgaccgctccttttccgatccgatcgaatcaatagaggggaaatgatcctcgggatcccttctatcttttctcttttggaatcgtcgtctaaattcgtttggaaatcgtgggattcgagctcgattcggattcctttttccacccgaaccctaaaccttccatcgccgtcgctggtcaccgtgggcctccatcgccgccctctagccctttataaggacccctgggacctcctctgtccgccgtcaccctcgcctcagctcgtcgccgccagtagcgccgcctccgcgtttgcccttgcgccgtcgtcgccgccgcaagtccagccgtgcgccgccgccgctccatcgtcgtcgtcgctcgggaaggccaccgtcgggttcgccaggtcgtcgccgtcctcgtccacccctccgtttctgccaaggatcgccggagcaccgccgtcgtcgtcgacccgatcgtcaccgccgcttcaacctcgtcgtcgtcgccgtcgccgttcggttgccgtccgccgccgtccgtgcctcggtaaggttcgccgcgtcacccgctacgtgtagatgccctccgtttgtgccgccgggccgtcgatcgccggcgagcatgcctggccgagccgccgccggtggtgacgtcatcgccgacgtcattgtcgacgtcagccgtagaccgcggtagaccgattcgatctcggccgttcgtttccttataccgtcccgtgcacccggtccaccgtgaacccgagccgctgacacaataattcctttttccttttcaaaaataattctttattgcgtcataattcaattaaaatctatataaatgatttaatccgatttaatctttaaaaattcataactaattcatcttagctcggatttagttggttcaagtctctaaatttttctaatattgagatctacatgttaaaaatatccacatgtactgttcatgattgtttatgtgctgttttggtgatttttctcttttctgcttatattccgacattcccggagagtccgattttgcaggagaagactttgaagagttccaaggccaggaaggcaagtcacacagatcccaaacacccctttgagcatgttgatcccgtttaaagctattgtttctattcaactattgcatttatttctgaatgtcattgggtgggaataacctattgcttttgttatagcccttttgctattgattacctattctttgtcacttggttaataattggattagctagaacattatatggttttagctaaagtgattaggatgcttagccatgcttagagacactagctcatatatttgggataacttatgattcactattatttaatgatggcttaatgatagctcatgatggttgatcgtgatttgttaattaattaatttgtcaactaaaacctaataatggtgggttgtgagcacatggttttgatggtcgtgctcatgacaattaaggactggttcacggttttcggttgtgaaacattaaccgtgccaaccacaagccagcgtgggcaacggctttactttctgtatagtatggttcattatagagcaccagactgtgaagtggcggagataagcccacgggggtcgctggggagtccatgccttgtttacaagggggtgattatgatccgggaatggtgcactgctttgaattgtgttatgcagagggtattgtcacaatctctattcgggtacttgttaagtatcgcgacgcatggttgacatgatgttgaggttgtgtcttgtgggtacagtggtacacctctggctagagtaaaactattcgaatagtcgtgcccgcagttatgggtgggtctaacaatgtctttcgtgattagtttcacacctctcaccataataaatgatgctgtaattggtaataatttgtgtagctcctggtttggaatgttacattcctggtttggagatagaactgtgcagtcgggaatggttgttcagaatggttggacctatgcaacgggtatgttgtatagtgttggattaatattgtttaattaataccttactgttttattaaattctgaaatatttattaaatgccgtttatgcaaatgagactatattatgccatcctttgttatatcttgcatttgcatatttgctgcgtggcttgttgagtatatcctatactcaccttgcaatcattcatcagaggaggagtgctacagtgatgttgatggtgtagaggattaggcgtagccctggtcaagctgcttgtgggatggagtcgtctgcgccgtttatcttattttccgctgcttagaactttattatttgagaggaactatctacctctgtaatgacattatattcgcttattaattagagtaataattgtactctattatcaatctattatcaatttgttattgtgtgcctcggctaattcctggacaagggtttatacacatgtaagcgtttgaaattttggatagaaattccgggcgtgacaggtgccgcccaagctggagcagcagggcggcggcagccgcgccgcgctgctgggtctcgccgccatgttcgccgccaccgccgccgggcaggccgggcaagccagggccagcgtgttcgacgagtacgtcgagaagagcaagaccaacaagatgagaatgtgagattgatcgatgattcgttaagtctcgggttataattaattcatgatttcgctgcttcgatgagctgatccatcgatcgattgattgatcgtcaggaactgaacaacaagaagaggctggcaacgagcggcatggatctgcttgttgcccgtggccgcctatcgctcccgctccctgcctccacgggcggtcccgctcccgctccgtgcctcatgcgtgcctcatttagcagcaccgcccgtcttccagtcgcgcggtggcggggtacgcggcagtgttggccgatgcgtcgctctgcgtgcgggacgctgtcaagggctgcctgccacgcgctcgcgctgctcgtctcggacgccgccgccatcgacattgctgaggaagaagaggaagagagaaagagaggatttgtgagattgacaagtgggcccatgggtaaacttgtctttaaccattgtttctctctccgtttccaccgaaaataataaaataatgcggccggtgtcctctagctaattaccacatttttacggtgtccacgagcaaatacacgatcttcgggtgtcccacagcaaagaccataatctttgcgtgtcctgtggcaaattttgccatgtatgaaaaagccaatgaatatgacaaggtggatgatgtggtcaaggcctccaagcagtcggctggtagttggaaacccaagaaagacaataatcatggagctagtgggagcggaacaaaccacaaggattgcaagcgcaagccggaggacctcgtcggtaccacttcaaatttccaacaccagcggccccgagtcaatacttatgatgagataatgaacggtccatgcactcatcacaccaattccaagcatgatgccaaggactgcttcatctacaagcaatttgctgaacaatatgccgcccaatccaagaagccgactgatggagaagccgggacgtccactcggaagaaggatgacgcagaactcggacaaaggcgcttttcaggaccatagcatggagcttaatcatatttttggagggccactcgcctatgaatccaagagaaagcagaagttgactgagagggaaatcaatgccgtacagccgacaacaccatagtatttgatatggtctgaagtcacaattcggtttgactgctcggatcatcctgaccgagtggcccacccggggcggtaccccctggtactagacccagtggttcgtaatgtcaaactcaagcgagtccttattgatggtggaagcgcactcaacatcctcttcgccaagaccctggatgagatgtagatcccaagatctgagttacgaccgagtactgcgccctttcatggagtcatcccagggctgtcagccacgccactcagccagatcactctaccggtcacctttggcactcgggagaatttccacacgtagaatatttgttttgaagttgctgacttcgagacagcatatcatgccatactcggacggccggcgttagccaagtttatggctgttccgcactacacctacatgatgatgaagatgccgggtccgcgaggagttataccccttcaaagcaacgttaagtaagttgttacctgcgataaagaaagttgtgagttggcccaagtccgggagaaagaactcaaccgagaagaaatccgactggccacgtgctcaacacccgaaggagaaatgcctactaccaaatccctcaagacaggcgaaggcgatgcaaagacaaagaaaattccacttgatccctctaattcttctaaaattgcagtaattggtgctgagttagattgtaaataggaaagcgtgctcatcacctttcttcaagctaataaagatatctttgtgtggaaaccatctgatatgccgagtattcccagagaggtgattgagcattctttgaatgttagagaagacgtgttaacgaccaaatttggtaaatcacacattggatttgaagttagaaccgaagcggatttggaggagcttggcggttgcggaaacagagtgcaaatcggttgacaactgaatcgggtatagtgtacatcggctgaggcagaatcggatcaggatagtcgatgtagccgattccaataaggagaaggctggatcattgtcggattcggttggagtgcttcatgaggattgccatgtgcggattgagtccggagaaggcaattgtatctattaattaggatattttcttaatttccttatagatattgtcggttagagtttgtgttagggagttttccttaatttatgttgtaatagagataggagtcgtgtctgacaaggacatcttatgtaattttgggtataaaaaggacccaaggttgtgtaatcaaaataacaatcagttcaataacaatctcggcgcatcgccaccttttacttctttactttcgacaagttcttgctttcgagttgggctgcatcggcttcgatctccagcaggaggtaaaacttgttatggcgggttgtgttctcgggattagtgcttccatctttatgatactctaatcttgtttatgtaaatcgtcgagtttcatatatactatataatctagatgaatattgattatatgaccccatcggctagtatctactgtcagaagatagccgatagggttatatatcaatgttgttccagattatatagtgtatctaccatctcaaaaaggttctcattaacttgattgtctagatattgtgtttctttacatacttagtgctgcatcagttaggtttgatctactaagttgtgtttagaattataatctctagcgtgtttatggttgctaatagagatagcatcgaggtttcagccggtcttacctgatttagttatcttgttatcttgatatgctaaatctatccgttatattgagatcttaccataataaaatatattaagctttctgttaatctagttaggtcatcctaatatcagatcaatacttatttaatatattttgtttataataatatctcagtatagagtggtatcggagtactagccgatacatgttagatttgcctaatcggctatgttatgaataaatataatatctgccttaatgtatatttacacataagtgatttatactgtctcggcgccctgtccgatctatcccaatcacttagtttaagtatattttgagatttggattatattatattgatatctacagccgattgagtaaatttaatcttctttttctttattcatcatagccgatttgatacatgttatatcggcttaatgctcaatgatatgtcataagcaaaccagtcgatcggctatcattgaaggactcatttcgttttctttctatatttcttattggttgcaggatcaaaccaattggcatgcctagaacccgaaagcaatatttaggacctgcactagagttaagcaaatctctcaggccaatgtgtgtttttttgcatcaacacgcttttggcatgccaggtgggaccatttcttgaagaatttgctagatggtggacacaaagacatctgatgttagtccagacaatgtcattccaataacaatggacaaattaacaccagagcaaaaggcagaatatgaagatctgatgaataagctctaaaatcaatacttgcattcccttgttcagaccagatcaggaacagtaattcagaggtataaagtaaatcttctaagnnnnnnnnnnnnnnnnnnnnnnnnnnnnnnnnnnnnnnnngaagtcaagcaggaagaaactcctgaagaattcaagagtttacaagacaggattgattatgctgtacacaatgctttgatcaatcaatcaggagtgcttgtcaatactttgacttatatgaccaagtctgtaggtgatggtactattgtgaacatcatgccaaggggccaatattcttgccagagggagtttttccacaatacaggccattgataaccaatcagcaccaacccgtgccaggactagtgccagaacagccgatatcagcaacatcagctatgattaagcaggaggtgtcagcatcggcacagaatcaacctggattcaatcctcaagttctgatgagacaacaacctcaacacatagggcagaacattcctagagtttctcctaaacaagttgcagctatgtttggccctaatcagtcagttgttcagccgatcttgcagacaccaacaaggcagcaagtaccaatcccacagcagcaacctgtcaatgcccaatttacccctgatcaacaagcttttatggccaatcagttgcctcaaagtcacataaggggtaataccaactaccaatttcaacctcattcacctcaaaggtagtatcggctagaagcatcacctcagcctcagtatcaacctcaaatcggccagttcgagccgatgcagcaacaagtgcaaggaggacagaagccttgggccgatatgatagccgatgtaatgagggagcaatttggtctcaagccaaaggatggtgacaatctgtatcggcatccatatccagaatactttgaaagagtacctctgccaagccgatacaaagtcctcaacttctctaaattttcaggacaggacaatgtgtcaacctacgagcatgtcagccgatttttagctcaatgtggtgaggcatcggctactgatgctctaagagtcaaattattccctttgtctttatctggatcggctttcacatgattttcttctttaccatacaacttcattcatagctgggccaatttggaaaaacagtttcataaattcttctacagtgggattcatgagatgaaactatctgatctgacggcaatcaagcaaaaacatgaagaatctgtccaatattatattcaaaggttcagagatgtcagaaatagatgctatagtttggccttaacagactctcagctagctgatttggctttccagggcttattatcaccaatcaaggaaagattttcgcctcaagactttaagagtttggctcacttggctcagaaaatagcaacgcatgaacagaggttccaagaggccaagaaagcatttaaaaaggttaattatatcagcccttatgtctcttaatctgaagaagaagaggatcctgaagtagcaacagccgaatgggtgagaagaaagaaggtggtttcatgtcaatgggttaagaattctggaaatgaagaaagatatgactttgatatcaccaaagctgacagaatttttgatttattgctccgggagttatagattaagctccctgctggtcatgtgattccatcggctgatgaattaggaaagagaaaatattgcaagtggcataatacaggatctcacagtaccaatgaatgcaaagtttttagacagcagattcaattggccattgagctaaggtaaaatcaaatttgatgattcaaagaagccgatgaaaattgatggtaacccttttactgtcaacatggttaacacaagtaggaagatagccgacagaaagaaaaatcggcttgattctattagaatgattaacaaatatcagagaagatatgatcagtaggaggagcaatatttcagggatgatgacagtgttgatccacactggagttgtgaatttttcaggttttgctggaatgaagggatgagactgccatcagtacgagattgcccaggttgcagaaattctggggatcatagccgatttcattctagagaagatcggtttttacagagaaagttgcatgttcaccaaaggttgggccctattcatcaagattatctctaggaagaagttgctgaggaggttgcaaatccacaatggtgtccttctggtattttttccaagagtcagaagagaagggttcaaagaatgaggaacatggagcaatttcaagaaaatcaacaagatataggtcgacggctgaaaagagcaaaaacaaaacaagtttggcgtgttaaaagcaaagtggtgtcagccgatgagattaaagccgatgaagcagagagattggctaaaggaaaggctattgcttcttcatcggttaacatggtgtttgtgttacctgcagaatttggaattgatcaaaggcatgcagacatcatggaggaatcttgtgctcaaatgattttgtcaccagaacaagctatctttgagaagccagaagggacagagaatcggcactttaagccattgtgtgttaagggatttgttaatggcaagccgatgtctaaaatgttagttgatggtggagctgctgtaaatttgatgccatatgttacattcaagaaatcgggcaggagtgcagatgatctcatcaagactaagatggttcttaaggattttggtggcaatcatacagagactaaaggagttttgaacgtagagttgacagtcggtagcaagattgttcctaccacattttttgtcatcgatgggaagggttcatatagcctgctgcttggaagggactggattcatgctaattgttgtattccttcaaccatgcatcacagtttgattcaatggcaaggtgacaagattgaggtagtcccagccgataggtcagcaaatgttgccaatgccaatttaactgtttcggagatggatggtattgattgtttgtctggaaaaaatctggcaaggagattatttaaaagtgtctgattgtgatatccagctagttgaagatggagaaccccaattgttgctttgagggtgttgtggagggttcaaatttctacaccaagaacactgtagatgatctcgatggcaaattagggcaagctttcatgtcggctgataatttggaagaagtggatattggtccaggagatagacctaggccgacatttatcagtaaaaatttatcatctgaatttaaaaccaagttaattgaattattgaaggaacatagagattgctttgcttgggaatattttgagatatcaggactcagccgatcgattgttgaacatcagttacctatcaagccaggatattggccacacaaacaaccacctagaagatgtaaagccgatatgtatgatgcaattaaagctgaaattacacgattatataatgttggttttattcgtccatgccgatatgttgagtaggtttctaatatagttctagttatcaagaaaaatggcaaacttagggtttgtattgacttcagagatttgaataaagctacatctaaggatgaatacccaatgccgattgccgatcagttggtagatgctgcttcagggcacaagattataagttttatcgatggcaatgctggatataatcaaatttttatggtagaagaggatattcataagactgctttcagatgtcttggtgcaatcggcttatatgaataggttgtaatgacttttggattaaaaagtgctggagctacatatcaaagagttatgaattacatttttcatgatttgatcggcttgttggtagaaatttatatcgatgatgtagtggtgaagtccaaggaagtcaaaggtcatatagctgatttgagaaaagtttttgagagaacaagaaaatatggcttgaagatgaagcccacaaagtgttcttttggtgtatcggctggacaatttttaggttttcttgtgcatgagaggggtattgaaatgccacaaaggagtattaatgctattcagaagatcaaacctccagaagacaagaaacaattgcaatctttgatcggcaagatgaattttattagaaggtttatttctaatttgtctgggagattagagccatttacatccttgctcagacttaaagccgatcaggaatttgcattgggggcagagcagcaaaaggccttggatagtattaaagaatatctaagttcccctccagttttaatttctccacaaaaaaggggtgcctttcaggttgtatctatcggccgatgtgaagtcaatcggctcaattttgactcaagagtttgaaggtaaagagagggcaatcttttatttaagcagaaggcttttggatgcagagacaaggtattcttcagtggagaagttatgtttgtgcttatatttttcgtgtacaaagttaaggcattatttgttatcaaatgagtgcactgtggtttgcaaagccgatgtggtcagatatatgctatcggctccagtgttaaaagggagaattggcaagtggatttatgctttaaaagagtttgatcttagatatgagtcacccaaagctatcaagggacaggctatagccaattttattgtagagcatcgagatgattcaatcggctcagttgaaatagtgccttggacgttgttctttgatggttctgtttgcactcatggttgtggcatcggcttggttatcatgtcaccaaggggggcaagttttgagtttgcttatactataaaatcttatgttacaaataatcaagctgaatatgaagcagttcttaagggtttgtaacttttgaaggagattgaagccgatgctattgaaattatgggtgattctttattagtaattaatcaactagctggagaatatgagtgtaaaatgatttattgatgatttatcatgagaggtgcaaggaattgatgaatggatttcggttggtcacattgaaacatattcctcgagagcagaacatggaagctaatgatttggctcagggggcatcaggatataaaccgatgatgaaaggtgttgacatagagattgctgcaattacagccgatgattggagatatgatgtgttcaattatttgaagaatccttctcaatcggcttcaaggaaattaagatataaagctttgggatatgttttgttggatggtgaactatattataggacgattgatggagtattgctttaaatgtttaagtgccgatcaagctaaagttgtaatgggagaagtacatgaaggaatttgtgatactcatcaatcggctcataaaatgaagtggtttcttagaagagttggatatttttggccgacaatgctggaagattgctttagatattataaagggtgtcaagactgtcagaaatttggagctattcaatgggcaccagcatcggctatgaatcctataatcaagccttggccgtttagaggatggggtattgatatgatcggccagattaatccaccttcaagtaaaggatataagtttatattggtggcaaccgattatttcactaagtgggtagaagcagtcccattgaagaaagttgattctgaagatgccatccagtttgtcaaggagtatatcatttaccgatttagtgttccacaaacaatcacaactgatcagggatctatctttgtgtcagatgagtttgttcaatttgcagagggtatgagaactaaattgttaaattcttcaccatattatgaacaagccaatggacaagcagaagcatctaacaagagtttgatcagactgataaagaggaagattgtcgattttccaaaacaatggcataaccgattggctgaggcattgcggtcatatagaatggcttgtcatgggtcaattcaagttcctccttataagtcagtttatgggcatgaagcagttttgccatgggaacatgtcatcggctcaagaagaattgagttgcaagatgagctgacagccgataattatcataatcttatggtagatgaatcagaacatttagttcaatctagaatgcatgctctagaaaaagtgacaagagataaggagagaattgcacgtcattataacaaaaaggttgtgccgaaaacatttgaggagggtgaattagtttggaagttgattttactgattgggactcgtgataataaattcggcaagtggtcaccaaattaggaaggaccttttagaatttacaaatctgtgtccaaaggagcatacatgttgcaaggacttgatggtgaagtttttggaagggctcttaatggaaagtatttgaaaaaaatattatccaagtgtttgaattaattcatgattcggctgtgttatgccgatacatattagccgatgtgttgacatcgcctttagatggccggtatgtgtaatatcgtccttagttatttgttttattgcaatcggttgtgttctgctcatattagttagccgattgtatttttgtgatgtttctcccacatgacaaaattaagggggcatatatatacacatcattggaaaaaaaattatattgttgcattgcacaaaagggagttttatattacaaaacacttgttcagcttattacaagcttatgaatagtcgatattgccctttgcatgatttgttctacttcttcgattgcttgggcatcggctgcatctgtgcttgggatcggtttcacagtcttatttagttcggctaagtgcttgattgaagacttcagcttgggtttttgttcttcgatggctcttggcagatcggcaagcttatgttcttctaaagctagttcagcattacatgcttcaagttcagccagcaattcaatttttctgtttttcagccgatctatgttagattggataggattgggtccagagatcattgcatcaagcttagctttttcttcaataatggattgccgattggattgaatggtggcttcaagatcttttctttccctcctatcggctatcctttgtcttgctctctccagtttgtgccgatattgctcaaggaagactgctggagagatgatctcaaaccttgccctgattagaccacagtccgcaactagagcatccaaagaactttcaagctgatgagctatatccttaagtgtggttttcaagtcatcggctagaggagcttgtgttttgctggttgtttcttcctcttcatccataaactgcatgatgtcaaatgaaaacatatcagctaaggcctgaaagaaagaaaggatgatttattgatcaataaaatgttggagtagccaattttggattacaaaaattgtacaagtacttacaggaatggcaggaatcggctggtcttcaatttggtggctacctctagccgatggcgtatgtttacttgattcatgttggattggagttggagaccgaatccgctgaggaaaaggagttaagttagtatcaattaattgaaaattgaagagaatttgtaaggcaaaatttgccacaggacacgcaaagattgtggtctttactgtgggacactcgaagatcgtgtatttgctcgtggacaccgtaaaaatatgataattagctggaggacaccggccgtattattttattattttcggtggaaacggagagagaaacaatggttaaaggcaagtttacccatgggcccacttgtcaatctcacatatcctctctttctctcttcctcttcttcctcagcaatgtcgacggcggcggcgtccgagactagcagcgcgagcgcgtggtgggcggcccttgacagcgtcccgtgcgcggagcgacgcatcggccaacgccgccacgtaccccgccaccgcgcgactggaagacgggcggtgctgctgctaaacgacaggggcaacagccgccgccaagcacgcgagtgtcctgctgctgggccgaggcggcggcggtggcggagcaggcggggttgagatggtcgagcgcgcatgaggcagggagcgggagcgggagcgcccgtggaggcggggagcgggagcgacaagcggccacgggcaacaagcagatccacgacgagcgagtgagcgacaaggccgacacgcgattgacgacgaggatgacgagatggcgaagagcggcggtgtgaggaaccgcgacgagcagcagacctgcctctattggtgctgcttgttgatgcttctgttacttcaggggaactggcagctgccgaactcgacggtgtacgccctcgcgaagttggcgccgctcgtcgccagcctcttcttgtcgttcagctcctgcacgatcaatcaatcgatagatggatcagctcatcgaagcagtgaaatcatgaattaattataacccgaggcaatgaatgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgatgtacgcgtcgaatggtccgaaaaattggctcctcacccttgcgcagatgcagtcttcttttgcagttttgttttgctgcaaattcggattcgtttttgttttggaaacgttccgaaaaatccggtgcgtgcaaacggcgtggagttcggataaggtacgcgcgacttatccggttcggttacgcgcagtagagatcgtgcgggcgccctgatcaagcgacccttctctatataaaccgacccgccgtcttcacgcagtatatgttacgcgcgacttatccggttcggttacgcgcagtagagatcgtgcgggcgccctgatcaagcgacccttctctatataaaccgacccgccgtcttcacgcagtatatgcgaaaatcaatctagggtttgcctcctactctgtactgcgccgtcgctcgtagactactccatcccgctcgccggcgtgcaccagcgatcgggagagcaggtctccggaacctctgcctttaacgtcctgcaccgggagaaggcggcaataaggtttttgggaagcgcttcgcgcgactgctccctgttcgttcgcgacggctcgccttcctcttcgctcgcgtgtttcgtgccttcgtagacacctgtgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatagagcagtttcatgactacaagatggctgacaaccgttctgtaatcgaacaggctcatgagatacaaaccatggctaaggaactcgaactccgtaagtgtgtcttacccgacaaatttgtggctgggtgcattattgcgaaactaccttcatcttggagaagtttcggtactgcactcaaacacaagagacaggaatactccgttgaggggttgatagcgtctcttgatgttgaggagaaagctcgggaaaaagatgccgcgtctaagggcgatggtggacagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaatttgtgggttgatactggggccaatgtacatgtttgtgctgacatctcattgttttcttcttatcaggtcgcacggggttccaccgtcctaatggggaatgggtcacaagcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattgatagaaaaccatcactttcttatttgcgcacatgggggtgcttggcgaaggtcaatgtaccaataacgaagaagcgcaaacttggacctaagactgtggactgtgtttttctgggatatgcttatcatagcattgcctatagatttttaatagttaaatccgaggtaccggacatgcatgttggtacaattatggagtctcgtgatgctaccttctttgagagctttttcccaatgaaagatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgatggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattattgaagtctttgtatggtctgaaacaagctcctaagcaatggcatgagaaatttgacaaaacattgacatctgcaggctttgcggtcaatgaggcagataaatgtgtgtactatcgccatggtgggggtgagggagttattttgtgcttgtatgttgacgacatactgatatttggaacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaattagcgaagatgttgtcctgcagagcattcttgaaagaactcacctttgtgagcttgactgttggtcgtagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtccccatcgaaccgctggtatataaacagtacattggaaaaggcaaatctcagtgagattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcctggcagggcagggcaggcggcgcgcgtgcacgacgtacgcgtcgaatggtccgaaaaattggctcctcacccttgcgcagatgcagtctccttttgcagttttgttttgctgcaaattcggattcgtttttgttttggaaacgttccgaaaaatccggtgcgtgcaaacgacgtggagtccggataagttacgcgcgacttatccggttcggttacgcgcagtagagatcgtgcgggcgccctgatcaagcgacccttctctatataaaccgacccgccgtcttcacgcagtatatgcgaaaatcaatctagggtttgcctcctactctgtactgcgccgtcgctcgtacactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgtttgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcccataatctcaacaatgaatcatcgatcaatctcacattctcaccttgttggccttgctcttctcaaggtactcgtcgaacacgccggccctggcctgcccggccttgcgcagcggcggaggcggcgatcacggcggcgagacccagcagcgcggcgcgcctgccgccgccctgctcagcttgggcggtgccgcgacgtgcacgcgcttcggcagcgccggcgagccggccgactgcggcaccgccgcggcgggcttgaggccgacaaggctgttgttcactccggccatggctcgattgagctgcgtgcaagcgtgcgtttgtgcaagaagaaaaagagaagagaagcaaagagaaggaagaagaacagtgtgcaggggcattttggtaatttcaacgctctttctctctctgtttcgacaacaaataataaaataatacgaccgctgtcctccagctaattaccacatttttacggtgtccacgagcaaatacacaatcttcgagtgtcccacagaaaagaccacaatttttacgtgtcctgtggcaaattttactaatttgtaaaggtatgttaccgatggaggtggtgcaggtttctttctagcagctagcttctttttctgcaaaatgaaaggagtttaagttaaaatcggcaagaagagttttggaagaaattaagttgtagactcattgttggtatttcttacgaccacaggtaaatccgcaagcgcacggaataccgctatagcacttcaccttcgggtgaccccaaaagtatatcgaactcagggaacgtgtgtaatctacctaaggctaaaacaatccaaggacaacaactataggtaggctaggcaggctagagaggactttctatgtgttttaattatctaagctaagcaaaggtaatttcctatcggttgcttcaggcaccgacccctactggtctgccagtgtggttccggctatagctccatgatgtatccgaacgtggaggattactaggacgagattcagggctgtcaccacctgccgcctacctctgacaaatccgtgggatacacaacaaacaaaggtaatctctaacctagaaaccacgtctaaattattaattactactctaatacttgtacaggaacttccttctttatccagagtcatagtactagagcacttaatatgaatactaaacaatgaacccgcaaagatgaaaatatatcttactcagactaaataattaaataacataagaaaggaacagcttacctaatagaagaaggttctccgaacccggagcagagtgtaccgacagctccggtactcctccagaattcctcctaggaagctacactcgtcgagaaagaagtcggagagagcgccaaaccttccgggcacccctccagagctttccctcactttctaccttattctaatgtacaaaagatacaatagagcctcttgtaattcagctcaaagttgtgtgttgtgaagtgtgaaggagagctctatttatagcctccatatgacagttacagctatgggaattgtccaaaacaccctcaaccgtcattgggaaggcatcagcaacgtacacgtggagggccaggatgaggggtgcctgtggataatcagataagattatttatgatatgatgatcacttcaatatctgttcctaatttactactacatctacatgcaagctttgctcctaatttactacttctacaagtggtttagatttaacacctctgtatgttattatctttgttacccttacattacttccttaaaccattaacatctgaattctcttatgttcaatatatgttcctaatttactactgcgtctcttatgttcagtatctgttcctaaattactattacatctacatgtaatatttcttactaataatgtaattaaattatttttggtacacttccattgcttcctaaaaccatcatgacatctaggagtctcttcagtatgtggaatttctgtatttgtgtgtggaccgtgtactccataattaatatagatttatctgtattctagcttctgtcttgattcatttgctcataggcctatcttcttttggtatgtacagatgcagatctttgtgaagacactcactggcaataccataaggttgagtcctctgacacgattgacaatgtcaaggccaagattcaggacaaggagggtattccacctgaccagcagcgcctcatctttgcgggcaagcaacttgaggacggacgcaccctcgcagattacaacattcagaaagagtccaccctccaccttgtccttcgcctcaggggaggaatgcagatctttgtgaagaccttgacaagaaagacccatcactttggaggttgagtcctcagacacgattgacaacgtgaaggcaaagatccaggataaggagtgtatccccccctgaccagcagcgtctttatctttgctggcaagcagcttgaggatggtcggaccttggcggactacaacatttagaaagagtccactcttcaccttgtgcttaggttgaggggaggcatgcagatttttgtcaagaccctgaccggaaagaccattacgcttgaggtcgagtcttctgatacaatcaacaatgagaaggcgaagatttaggacaaggagggcatccccccggaccagcagcgcctcatcttcgccggcaagcagctcaaggacggacgcaccctggctgactacaatatccagaaggagtctacccttcacctagtgctcaggctcaggggtggaatgcaaatctttgtcaagacattgaccggcaaaaccattaccttggaggttgagtcgtcggacacaattgacaacgtgaaagcaaagattcaggacaaggagggcattcccccggatcagcagcgactgatctttgctggcaagcagctcgaggatggccgcaccttagcaggttacaacatccagaaggagtccaccttgcacctggcgctccgtctccgtggtggcctgtaagttctcggcagatttggttcacatgttcgctgcgcctggtggtctctactaatgaag

SEQ ID NO: 4524 - DNA, 1102 bp, Oryza sativa
  unsure (1)..(1102): unsure at all n locations
nnnnnnnnnnnnnnnnnnnnnnnnnnnnnnnnnnnnnnnnnnnnnnnnnnnnnnaatagttctaaggataatatgatatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaattagcgaagatgttgtcctgcagagcattcttgaaagaactcacctttgtgagcttgactgttggtcgtagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtccccatcgaaccgctggtatataaacagtacattggaaaaggcaaatctcagtgagattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcagggcagggnnnnnnnnnnnnnnnnnnnnnnnnnnnnnnnnnnnnnnnnnnnnnnnnnnnnnnn

SEQ ID NO: 4525 - DNA, 708 bp, Oryza sativa
  unsure (1)..(708): unsure at all n locations
gtttatggatcaaattctatccttggtggttggcaattgtagaacacatgcatgatattctttcgtagtttcttcaaattcatataatcaaaatttgccttttttgtaacatacgcaatatggtcagtgcacaaaatccaggccaggtcagaaaaactggtaactactagttactagttctctccatggattcgaactgtagactctggtcattacactcctttacttgttttcctacatagtgaatactgaataattttctactgtatttcaaatcctctccaataaatcaacgacaaaatatcatcagcacagtgataaacaccaagatggtgagaacttgataaatatgctatgcttaacatcggctatgttgcgatatgcctttttaggtatctatagacctatatgctaccaacagctgaagtgttaaatatgtaacaaacatgcataaagataaaattagacttacaataattgcaggagggatgcagacaaggagagcaattattgagatgtacgcatacaggttggtgctatccatgtcagtctgtgataaagaacagcaacaaagtaaaaaaatgaaacgggagtatcaaaaggaagagtgaatatgcatgcagatcattagaggtaacaagcaaannnnnnnnnnnnnnnnnnnnnnnnnnnnnnnnnnnnnnnnnnnnnnnnnnnnnnnnnnnnnnn

SEQ ID NO: 4526 - DNA, 705 bp, Oryza sativa
  unsure (1)..(705): unsure at all n locations
nnnnnnnnnnnnnnnnnnnnnnnnnnnnnnnnnnnnnnnnnnnnnnnnnnnnnnnatctctttaccaagcttatcagctgatggcttgattggcattccagtacagtggaaagcaaagggtaaaaggacatttgagccatggagtctgtggtatgctgcagcaaactcaagcttcgatagtgtgaaggcatggcctaaatgtagcatgccattcatgtatgggtatgtgaaattcccaaagaatttttcaccagggcttggaggtgtatcaccagcctttgcttcgaaaaccttgttctcttcccaacatttttgcacttcagattggatcttaagcaaaaggtccctccgagcaaaacttttcccttcatcataactagatgacattttctcttttcctaatgaaccaacaaaagggtgttaaatacagaaataaacattttttgtaatgtacaaaaaacctgaaacaaactacaaacgaatccagtgtatggtccaatggtagattgatttaaaatgcagtatgcaaaacccccaaataaactgtacttgtgaacagctttgatttgtgatagaaaataaagtggttactgagagtaacaacagaataacagaatattgtggcaaaaaaattagaattatttgcataatgcaagacaaagaaagtcgcatgaaacagatcagattaatagttatcttgtgaag

SEQ ID NO: 4527 - DNA, 699 bp, Oryza sativa
  unsure (1)..(699): unsure at all n locations
caaaccagtcgatcggctatcattgaaggactcatttcgttttctttctatatttcttattggtggcaggatcaaaccaatgggcatgcctagaacccgaaagcaatatttaggacctgcactagagttaagcaaatctctcaggccaatgtgtgtttttttgcatcaacacgcttttggcatgccaggtgggaccatttcttgaagaatttgctagatggtggacacaaagacatctgatgttagtccagacaatgtcattccaataacaatggacaaattaacaccagagcaaaaggcagaatatgaagatctgatgaataagctctaaaatcaatacttgcattcccttgttcagaccagatcaggaacagtaattcagaggtataaagtaaatcttctaagcaatgaagacctagagtcaagttctgggaaggacaaggaagtcaagcaggaagaaactcctgaagaattcaagagtttacaagacaggattgattatgctgtacacaatgctttgatcaatcaatcaggagtgcttgtcaatactttgactaatatgaccaagtctgtagttgatggtactattgctgaacatcatgccaaggggccaatattcttgccagagggagtttttccacaatnnnnnnnnnnnnnnnnnnnnnnnnnnnnnnnnnnnnnnnnnnnnnnnnnnnnnnn

SEQ ID NO: 4528 - DNA, 1380 bp, Oryza sativa
  unsure (1)..(1380): unsure at all n locations
cgagaagacataccttctagtgtgaaaacttaactgaattaagacatagaagcaccatagtaaagatgtgtacaccaataattacagttacatttcagttatcttatccattaagcacaacgcacatgtctctgttttccacatgtggtgcataagttggcttgtccttgccctgaagcacaacagctatttgggacgccaaccgtccaaggacctatcacacaaacaaaggcttggtaaaaaaccattacccatgaatatttgcttaacaactggaaccactagaaaaatggtaacctggccctttgcgtcaaatacacaccatctcaaaccatctaaattgattcttctcaagtctgcaagtgctttttgctcagttcaaacaacagcactatcagtaccagtacttcaaatttagtaggttgaaactcaaaaatcttattaatgtaattccaaactaagagaccgaaacaatagggtagatgtagaacaggattcatattggctagctatctagatatttcaattatagagttcattccttttcaagaaaaacaaatgtatacagcttacttcgctcagtacaatataaacacagataggctgcttgctgcaataatgaaataatcagaaaaacttaatttttgaccatgcaatcagcatgtcagtgcagattctgtatgccctctaattttttgggtatcatgaggaatcattggcaggatgaatacactagccgaatcacaattcatagcaaaggcatataatctactgttgtataattgtatttgccagtcaatacgccatcttaatccatcacacaccactgtttattagttattataactgtagaatttcacaactcatgaagttagccctcatcaaggactgctgtgaatctctatatactaaacctaactggcctaactggctctaccgtgaacggatgtactacacgtttgcaaaaagctaacagctcgtccactgcccgtggtgtccaacccgctacaaatgacctcctgcaggccatgctatctctaggatcagactctcatttcatcagtatcaaccgctaaaccctaaaggcaagacaaacactgaaacacgcatgtcgctctggtatctgacggattcaaccagctgcagtatgcacattctcaatccgcagacaaccaaacagaccctatctcggagatcacccactccgactgtggctacaccacaccggtacaccacatgtgaatgaaagctcacgcccacgaggagaacctgatgggcgacggcttccccttccaaccncccccccctcccaaaattcaaaacacaacacatcccttaacccactttgctgggagcacaaacacacaagcttctatttca

SEQ ID NO: 4529 - DNA, 709 bp, Oryza sativa
  unsure (1)..(709): unsure at all n locations
nnnnnnnnnnnnnnnnnnnnnnnnnnnnnnnnnnnnnnnnaatggcggcgaggagtggctcgttgtaagtccacgaccttgaaagcgagggcgaaggggatctgatcctcgggggtggactccacaacagcgcagacgcgttcgaccagcacctcgtcgaccatagcatcggcggcgaagatgtcatcggcgtccccggcgtcctcccagagcgaggccaggttatcctccccggcttcggtgggatcagaggcgaggctatcctccccatcatcggtgggatcagaagatgtggaagcagcgccgccggcagcatccggcaggggctccggggaggaggagaggaagcgggagagggggcgcggaggtggtagagtctagttaaggctcgaagtggagatggcggcggtggcgggagaggcctgtggatggaagactggaggaggaggagagcacaagctcccgaacgcccgccacatctcctcctcgtcggcgacagcggtggcggcggcagcgtggtagctgtaatgtgtggaggcggacgagtcactggtcgagtcgaggtggtgggcggaatgtttctttcttgctttctagggtttaaggccttgatggcctatttggagtgggcctgataatttttgggcccctatgaaacttttctcttttttttcccaaacggagcaagagatgagcgtatgattaataa

SEQ ID NO: 4530 - DNA, 890 bp, Oryza sativa
cttgaaaaggaatgaactctataattgaaatatctagatagctagccaatatgaatcctgttctacatctaccctattgtttcggtctcttagtttggaattacattaataagatttttgagtttcaacctactaaatttgaagtactggtactgatagtgctgttgtttgaactgagcaaaaagcacttgcagacttgagaagaatcaatttagatggtttgagatggtgtgtatttgacgcaaagggccaggttaccatttttctagtggttccagttgttaagcaaatattcatgggtaatggttttttaccaagcctttgtttgtgtgataggtccttggacggttggcgtcccaaatagctgttgtgcttcagggcaaggacaagccaacttatgcaccacatgtggaaaacagagacatgtgcgttgtgcttaatggataagataactgaaatgtaactgtaattattgttgtacacatctttactatggtgcttctatgtcttaattcagttaagttttcacactagaaggtatgtcttctcgttggtgaagtgataaagctactgttcattttattcattgtttaatgatatagactttttttttgcagggttagatatacacttatgttagcaaacacttggatcttttcgtgaactataaggatggttgtgacttgcgaagggtcttgcttcgtatgtaccctgtatgcttttagggtctggtttctgcagtgcctttgctgaactagtgatctgcttctatatcttacaattcctctatgtggtggggattttcatgagaactgtttatattgaatatcaagttcaacataccataaaatccaaccatttcttcttggtttcatattcaacatgaaaat

SEQ ID NO: 4531 - DNA, 714 bp, Oryza sativa
  unsure (1)..(714): unsure at all n locations
tatatctagattagataattttagtctgcttgatatttattttacgttctttttttccttcttgtgttctttgattaattaggtgataaggaggaacatctagtcaaggaatatcgtgatctgaaactcgagattgaacaaattaaatctgatatacagtctctgcgacatgagaaggaagggagaggctaccataaggttttttctttttctgctttcatgtcgctttataaaactcttttttttccctcataccaatagctttttcattgtaattgttacacaggaaacattaggtggcacctcaaatcagcaaaaacaagagaataacgagaaaacaaagtatgttgatcagaccttttttgggggcaatttttataagttcctgttaatttattatttgagttacggatatgatatggatttataattggaataatgaatttgtctgaattttcatgttcaaccaggcaaccagcgatagatggtattatgaagtcattacgagcaaaagcaacaaagttgcagcaggtcaagataaggtagtctctgattgatgcgcattagcaatttaaccaaaataaatcaagtatataatacagaatgaagttaaaacattctttttacctttttttttcttcgcagctttcctnnnnnnnnnnnnnnnnnnnnnnnnnnnnnnnnnnnnnnnnnnnnnnnnnnnnnnnnnnnnnn

SEQ ID NO: 4532 - DNA, 741 bp, Oryza sativa
  unsure (1)..(741): unsure at all n locations
tttgtagaacttcatatacatagttttagtgtgcaaatgatctgatgtttttgtgtaatacttggtgaacttaatgttgaacaggcacaaagatcaccacacaaacaggaattggcacttgcattgccatagctggtgttgcactctattcttatatcaaggctaagattgaagaagagaaaacggtatgtgtgtatactatatacattctaaatctcaatatttgcaatgcaccctaacgttacttcttttttttagaggaaccattgcaactgaaagtaacataaactacactagtacacacatttgaagcaacctgaaaatttttgggttttgtttggaaattttgtaaacttttttcaacatggcaagaatcagaagatactttggttgctaatacagccaagcatgaaagcacaaaatgtaaaaaaagaaagaccaagagtttccactatcatcttttggggtttacaaataaacatcacttgaagggtaaatgaaattaatatggatatatgtgcacgtcctgttttggggtttggaaaagaacatcattcaatagacaattcgaacgaccttagcttatatcttgatcttctaagtgaaactccattgcctgagtggttgagcatacatgacatgctagtccagtttgagtttgtgcgcctaattgatctnnnnnnnnnnnnnnnnnnnnnnnnnnnnnnnnnnnnnnnnnnnnnnnnnnnnnnnnnnnnnnnn

SEQ ID NO: 4533 - DNA, 1665 bp, Oryza sativa
  unsure (1)..(1665): unsure at all n locations
nnnnnnnnnnnnnnnnnnnnnnnnnnnnnnnnnnnnnnnnnnnnnnnnnnnnnttctttttctgctttcatgtcgctttataaaactcttttttttccctcataccaatagctttttcattgtaattgttacacaggaaacattaggtggcacctcaaatcagcaaaaacaagagaataacgagaaaacaaagtatgttgatcagaccttttttgggggcaatttttataagttcctgttaatttattatttgagttacggatatgatatggatttataattggaataatgaatttgtctgaattttcatgttcaaccaggcaaccagcgatagatggtattatgaagtcattacgagcaaaagcaacaaagttgcagcaggtcaagataaggtagtctctgattgatgcgcattagcaatttaaccaaaataaatcaagtatataatacagaatgaagttaaaacattctttttacctttttttttcttcgcagctttccttgggagaagatgaagaaagccaagaatatattcagcatggatttcaagctacggccgtagattagtttaagaagttcccgaaaacgaatttaatctagtcatcaaacaagaaatgcagatgtgtaattgtgataattcacatttggatggtctcagtgtactttagtcagagttttgttatttatgaaccggttttctagagtagatacctcgtggattcttcgtattttcatcctaattgtgttatcaagcttggtgtgcaaatggtatgcccttatgtcaagcataaatagctatactagaaaaaaattaaatttcatgagttgcaacggttgataacatttttagattgctatacattttactcttttattttggaccaaaagcttattcttccctttcttttcagtcctagtccactaaaatataagcaccaaaagctcattctttccttccttttcagtcccagcccactacttcagctcattctttccttccttttcagtcccagcccgctacttcttaaaatatattatttccttccttttcagtcccagcccactacttcttaaaatataagcatatgtcatatgtccagattcatagccaaaagttatgttttaggacggccaaaagttattctttcccttctttttcagtcctagcccatataagcaccagaagctcattcgtctcagcccactacttcttaaaatataagcattttctaggtatgaatctggacaactgtatgtccagtcctagcccactacttcttaaaatataagcattttctaggtatgaatctggacaactgtatgtccagtcccagcccactacttcttaaaatataagcattttctaggtatatgtccagattcatagccaaaagttatattttaggacggtcaaaagttatattttgggacggaggtagtaccttcctctgctctttcaccaaacccaaaacccacgaatggagccgtaggtccagcttgcatagctaactgtacatcaaatccctcgcatagctgactaaatctcgcatagctcactgaatctttcgtgtccatacgatgccattctcgatctatagggcttttgatacactcgatctcctctcaaatccatttatcgatcttctctttatgtttctattaaaa

SEQ ID NO: 4534 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnncaatactttgactaatatgaccaagtctgtagttgatggtactattgctgaacatcatgccaaggggccaatattcttgccagagggagtttttccacaatacaggccattgataaccaatcagcaacaacccgtgccaggactagtgccagaacagccgatatcagcaacatcagctatgattaagcaggaggtgtcagcatcggcacagaatcaacctggattcaatcctcaagttctgatgagacaacaacctcaacacatagggcagaacattcctagagtttctcctaaacaagttgcagctatgtttggccctaatcagtcagttgttcagccgatcttgcagacaccaacaaggcagcaagtaccaatcccacagcagcaacctgtcaatgcccaatttacccctgatcaacaagcttttatggccaatcagttgcctcaaagtcacataaggggtaataccaactaccaatttcaacctcattcacctcaaaggtagtatcggctagaagcatcacctcagcctcagtatcaacctcaaatcggccagttcgagccgatgcaacaacaagtgcaaggaggacagaagccttgggccgatatgatagccgatgtaatgagggagcaatttg

SEQ ID NO: 4535 - DNA, 3610 bp, Oryza sativa
  unsure (1)..(3610): unsure at all n locations
ggctccggccacggttgggtcgccgttggggaagtggggatggtgcggtggagattgggggaggggacggcgacacgtagaggagggggtcgatgacggcggcgggcgaggtcggaggccgcgcggtcgacgcgctccgcctccgtcttcaccgtcagtcgctcgagctcgccgcctccaccgcgaccacctgagctcgctccaccgcctgctctgccgctgccggtggcttcccaagctcgctccgcctccaccgccgctcgagctcgctccgccttgccgcccgcacgaacgaggtccacctccgtcgccggctgggccagctgagagagaacttccgtcgccagccagagcgcgcgcgcgtgcaaggggacttggagggatacgtatgacatgtgggcccagagaatattttttattttctttgctgactgtattgccatgttggcaccacgtgtacaaattcaagtaaaccgctaacagtacttaggggggttatttgtccggtatgaatacttgagggtgtaaaatatctggttttgttgtttagggggtaatttgatcgactgcgatagttcgtaggggtaaaacgtactttttcctccccaaatcgccaaccgtgtgtgcaaacatttgctgcgcagcagcttgatttcagttatatatgaagttagcaaatctctgtgagcttatttcgatgatatatctgttcctgtactcgtttttttttaccctgatatatatagctaccataacaaaagagcaccgaattggagttgcaaacaaaatattgataatatacctgctcaaggcatgtataaccaataaaggaaacaattcataaggcaaaactctaccaactactcttgcactcaccaagagcgatgcgttatgagcatcctcagtcctcgccatatgaattgcgaaactaatgcaaatattcggaatagggtttaatgcaggatttatgaacagccgtaccttctattttttcgcttgaacgccaaagcaattttttttttgtggaaccaagtataagtgatttgaataattatacaatctttttactttgaagtagctaactttatatttgttgtactttagatcatccccgactattttcactagccatgtccatcatatattttgttaaacgtatggtctgttcgtaggtgaaggattttgccagtgtaccagagctgacatcctcaaagttgttgatgtgctaaagaatggacatatattccggtaaaggtttgcttggtccataatcgggcagaaccaccacacatctagaccaatctaacgaggacagaggatagaaaacgggcgataccagcaggggaccacctatacatttgtcgacaaattttctcctaaaaatttaacatatgtaattatagttatgtaattatagtttaatcgtagtgtaattacactctaacttatatgtaattatactgtaatgtaagtttcacttaattttgaatcgttatatctgttacaatattaacatatgtgaaagaatttgttctcacgatcttcattttaccgaaataatatgttacggggagtttttgaaagttacatacaagttatattatagttacagtgtaattacatgtaagttacagtgtaatcacactataattgtactgtaattacatctgtcgataaatatatagcaaaattgatatctaatccacgagagatcacttgttgggtgggaacaccgtgaagtatgtctgtgtagcggctagagcgatgacgaatgtggcgacggcaacggagatggccgaccacgggctgggaaaataattgcgccggagcccagccatgtggctgtgccaccatgtcccacagtagcgcgtcacgtcgtcgtacagtccggagaaggcctgcgagtcgtagcccgccgggtggcagtcgtcgaggcggttgaagaaccgggccgcctcctcgtcgttgtccaacaggttcaccacgacgccgcgccggcggagcagctccacgtcgcgtgctgtcacgatgagctggctcatcagtgccacgtagctgctcaggagcccctcctcctcgccgcgctggctctgctcgaacgcgagcaggttcgcgagcagcggccgcctcgcgtcgtcgatcaggactgtgggtatctccattacgccccagcgggcgtcgaacgccacgtcgtacctcgtcccccctgcggcggccgctgggctctgcgcggcgacgaactgtacccccgcctctctcatctcggttgcgcatggtatcacccgtggcgtcctggtgatcgtccgtcggtcagaccgtgggcctcggcggcttcgcggcggtgttcggttgggaatgaagctctggtagtacagatggaggaggtggtggacctcccagtcgccggaaggccatctcattggctcttcgtcctcactgccgaggtacttgacgaaaaggtgaaggagggactccctgccgtgctgggcgccgccgccggtgactgcgccatagagcctctcgaggacgaagaacgggatctggttctccatgaggagcaggtcggcggccgcggggacaagcgtgaggccccttccagcgtcgcagagcgcgtcgggctccttggcgtgccactttaagaggaactcgaggatgaagcagccatcgagcaggagcatcacgatgaagtcgtcggaggcgaggccggcggggcgctcgctgtagcaggcgcgcgcctgggcctccagggttctcatctctgcgaccaaagtggacgcgctgaccgccgcgacactgccgtcgccggcgtggcgggacagcaggccctgtaggtagtgccacttgtggtcctccatggtgcgcagtgcggcgccgccgtggtaataggggccgatggacaccacgcgcggctcgtacgaggtgcgattgctctcgcggacgttggcgggaacgcggaagatggtaaatggctgccgcgccctccattgatctcctctgagggcatccaacgttgcctccaccgaagattccaacgacgccacatccatgagatcgatagcaaaacgagagaagtgatggtaggaagaagacacgcatgcaacttgcaaatgctcccgtaataaactgataatacactacagtactacaacatcatgaatggtcatcatcgaagcgcgtcgtcgttgacatttttgttttaatccaacgagcagaaatgaacgaccgccaacgcgttgattcgttgacatttaggtgagcgtcgctttcctgtaacttcctgttaggtacgcgcgcgaacatcttatttatgttttataaatttaactaaagatatcataattaggttttataattccaaccgatccatcacatattcacatgctcggggcactgagagcaagtttaatagtatagccaactactagctccaattcatccatagccaatctaatagctcatatatataatagttacatactatattattaatatctggtcccacctgtcatatacacgttacatcttggagaccgtgctacagctggctacaaatctgtagcccgctgnnnnnnnnnnnnnnnnnnnnnnnnnnnnnnnnnnnnnnnnnnnn

SEQ ID NO: 4536 - DNA, 7374 bp, Oryza sativa
aatgagatgtttacctcctctatagtaactgctactcgaccacagctcgcatttgaaatacccgggggcacattccagcttttcagcctaatgggaatagggttggtggacatgcagactttgtccaaaatcgtgcaggagtgaggatgttggaccaacagaggaacatttatctgggtcaggcaggagaagggaatcagtacgctgaggctgtcctcaaggggccaagattagaaatccctctgttcagtggagaagatccaatagattggcttaagcagtgtgagaagttttttgagattacgggtacccctctggatcaatgggtgaatttagcggtggctcatttgaatggcagggcattgaaatggttcggaggaattggtctgccatggcaagtgatagcttggccacaatggtgcagcatggtctgtactcgattttctgctgcgagtgaacatgaggcaattgagttgttccaaaatgtgaaacaatttggaacaacagtggagcaatatattgacaagtttgaggattatgtggatttagtaaagagagaccacccttatctccaggagcaatatctgaccagctgtttcattgggggattgagagcagatattaaatacgatgtgtgtggtcagaaacctcaaggcttgcttgaaacttactggtatgcaaaaaaattatgaaagggctgctaatgccagaaaaatggtgggaaatttcaaccgaaacaggaatcagaatccacttggaggtaatcaggggcggaatgctaaccataggggacaaaacagaggtgagggagataggagagaggaaaagaagtgctggttctgtaaagaaccttggtttccaaggcaccagtgtaagattaaacaagcaattcacgctttgttagaagaagatgatgggcaagaagataaagaaacaagtaatactgggggtgatgagaagagaagaaagaaactgaagaatctgcaacttcagaaaatgagtccccaaccgaagagttgatgtacatttctcaaactgcagtacagggtacatccaggccagatacattctcagtattaatcaaaatcaatggccggacagctgtagggttggttaatagtgggagtccccccacattcatggatcaggattatgcccttaggaattcttatcccttgaaaaatactgacacaaagaaagtagtagttgctggtggtggagaacttaagactgatgtcatggtgccagacatcagctatgagattcaaggagaatgctttactaaccaatttaagttgcttcctctcaagggatatgatattatctggggtgctgattggatctataattatagccccatttcgctggatttgaagcaaagaattttgggaattacaaagggaaacaaagtaatactcttacaagatttcactaaaccaaataagcactttcagatcagtggtaaaagattggagaaaatgttaaagaagggggctcttggtatggtgatacaagtcaatgtcatgtctgaaactgtggaggaagaagggcatgttatacctgaagacattagtgacattatacaacaatttccagctgtgcttaaagaaccaaaggggctaccacctaagcgagaatgtgaccatgtgattaatttacagagtggggctgtaccacctaacatcaggccatacagagtgccacattatcagaaggaagcgatggaaaatattatcaatgagctgattgaatctaaggagattcaaactagtgatagtccctattcatctcctgctgtgatggttcgcaagaaagatggatcttggaggatgtgtgtcgattaccgacaattgaatgcacagactgttaagaacaaattcccaatgccaatcattgaagacttgttagatgaattaaatggagcaaggatattctctaaactagaccttcggtcagggtatcaccaaattaggatggctgagaaggatgttcataaaacagcatttagaacacatcttgggcattatgaatatcaagtaatgccattcggtttgacaaatgaccctgccactttccagtcacttatgaatcatgtcctagcaccattcttaagaagatttgtgttggtgtttttcgatgacatattaatctatagcaaaacaagggcagagcatctggagcatgtgaagttagtaatgcaagctttgcaagacaaccatcttgtaatcaagcttaaaaagtgtgcttttggacttgcaagtgtgtcttacctaggacatgtaatctctcaggatggggtggctacagatcccaagaaggtggggaaaattaaaaattggcccacacccaaggatgtcactgatgtaaggaaattcctggggatgacaggatactaccgaaggttcattcaaggctatggtaccatttgtagacctattcatgacatgctgaaaaagaatgggtttcaatggggagcagatcagaccacagcttttgagactctaaagcataagctgagaaccagccctgtcttggctttgccagactttgatcaagcattcaccatagaagcagatgcttgtggagtcggcattggggcagtactaatgcagggagggcgacccattgcatttttcagtaaggctttgggacccaaggcagctgggcaatccatatatgagaaggaggctatggctattcttgaagctcttaaaaagtggaggcactatgtgttgggcagtaaattgatcattaagactgaccagcaaagtttgaaattcatgatgggtcagagattggtagaggggatacaacacaaattgttgctaaaattgatggagtatgattataccatagagtataaatctggaaaagaaaatttagtggctgatgctctgtccaggctaccacaaaaggaagctgttgcagacaggtgtcacccaatgactgtggtgatacctgagtggattgtggatattcagaggagctatgaaaatgatgtacaagcacacaaaattctcagtttgattggtactgcagcagatccagatagagaatataagcttgaagcaggattgctaaaatacaaagggaggatctatgtgggagaagccacggatatcagaaggcaattgatcacaacctatcattcatcttcttttgggggtcactcaggtatgagagcaacccaccaccgaatcaaaatgttgttttattggcatgggatgagaggggaagttgaaagattcataagagagtgtcctacttgccagatcactaagtctgaacatgttcacattcctgggttgctcaatccattagaaataccagatatggcatggactcatattactatggactttatagaggggctaccaaaatcacaagggaaagatgttattctggtagtggtggatcgtctgaccaaatatgctcatttcatagcattagcccatccatatgatgtggagcaggtggtagaggcgttcatgaacaatattcacaaactgcatggtatgccgatggtcatcatcactgacagggaccggatttttactagcagtctgtttcaggagattttcaaagcaatgaaggtcaagctgagatttagtactgcttatcacccacaaatggatggacaaactgaaagagtcaatcaatgcctggagtcctaccttagaaatatgacgttccaagaacctcacaaatggtattcatggctggcactagctgagtggtggtataacaccactttccacaccgcaattcagatgactccgttcaaagcaatgtatggttattctcccccacaaatcaatgaattttcagtgccatgtaacatatcagaagaagctagggtgactattgaagaaaaggaagcaatactgaacaaactcaagaatagtttggctgatgctcaacaccgaatgaagtattttgcagataaaaatagaactgaaagaaacttagaagttggggatatggtatatttaaaattgaaaccctatagacagtctgcatttgggatcagagggtctctcaagctaagatccaagttttatggaccattcaaggttcttcagaagattggccaattagcttataagcttcagttacctgatgatgctcagatccaccctgtgttccatgttagtcagctcaagaagcatctggggaagcatgctattcccatgtccaatttaccctcagtaggaccagatgggcagattaaaacagaaccactagcagttctacagaggagaatggtacccaggaaaggagttgctgtgactcaatggttgatattatggcagaatttgtctcctgctgaagccacatgggaagacgcatcagtcattcaagcaatgtttccatcgtttaatccttgaggacaaggattgtcttgaggggaaggtaatgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcggggaccactgtagtggtaaattgttgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacatcccccttcctccaccatccctgccccatcctaactcaactcccccttcctgctgttgggccagatttgcccgacgacgacgaagaggcggccatggcgatgagctcagcgcgcggtgacctcggggtgccatgtgcttatgtgtggatatcaatcactatgtttataacataattaattttgatgctgatagagtgataatgctatggtgtaaacaatgtggtctaatctaggttggcaggattaattggttagatcctgcgccacgaatttctgagttatatttctgacctgtaagcaatgggaagttttatttctgatctatacgcaatgaagttctatttctggcttgctatggtgtaagcaatgagggcaagttttatggtagatgtgactaccacatctaattttatacatgatatacatcattaaattaagaggtgccatatataataggttgtctctaccacacaatccccaatatatctaacactctcacatttttttttagataaaggatttatataaaacccggcttctacatccccaagaatgtacacagccaatcaagtccatacaagagcactaaggctcctcccattacatgggttacaaaaacatacttaaaagtaacataagaagtaccaagttcaactaacatgccagctaacaagacaaccaagcaaactcaacaaacaagcttaaacaacagtgtaagcttcaattctccctctgaaattccagccataattagagaagaattctaagaccctcatctctaacaccttgcaataatttttcaacatgttgccatcctcttccttaagcaacaaagaccaaagtcttgcccagtgtgtccctctgaaaattacctgcataaaagagtaagcacatgatccattaaaaaccacatcattcctacttaaccacaccgcctagcacaacgccgctatgcccacaaaaacttgattttttagcctaatgttaacaccacttagccaactaccaagtaaatgagacatattgtgcggtgggcagatgccaaaagtgaaatgtactacgctccacacatatcttaccatggggcaatcaaagaagaggtgttgtattatctcatgagacctacaaaagcaacatctaaggctacctttccacctcctcttagctaaattatccttggttaaaatgaccccctcttttaaataccacaagaagatctttattttcaacagaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacaccttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagatttttagcatcctctaggtcatgctccataaaatgtatcgtgtcatctgcgtattgaagaatggaaagaccatcgtctactaaatgtggaatcactccatgaatcttaccatgctcgcttgttctctgaattaacactgccagcatgtctgccaccaagttgaaaagtaaaggggagaggggatccccctgcctcagtcccttttttgtttgaaagaagtttcctatctcatcattaactttcaccgctacactgccacctcttaccacttgatcaatccacttacaccacctaggctcaaagcccttcattcttaaagtttgttgtagaaacttccaatcaaccttatcataggctttctcaaaatcaagcttaagaataacaccatccttctttcttttatgcatctcatgtaaggtctcatgtaaaattatagctccttccataatgttcctaccctttaaaaaagctgtctgagaaggctttatgattttttgggctaccaacacaatcctatttgccaagacttttgtgaatattttgaaacttacattcaacagacagattggtctatactattgaattttctttaacttccttttggtttggaagaagagtaattatcccaaagttcaaactatgaaggggaagcctacccagatggaattcgctaaagatggccattaagtcatccttgattacctcccaaaacacttgataaaactccgctggaaa

SEQ ID NO: 4537 - DNA, 1220 bp, Oryza sativa
acccctctgtcttccttttcaaaatgtttccactaaccataaaatcttcccttacaaccacccaagctcaaatttgaacagaggtggttaattaatatgtgttccttatcccgagtctaccagcaatggtgtatggtctgagagttctctactcagtgtttgactgtagctagtggattcttcaactcccattcagtactaactaacaccctgtccaacttctcataagttggaatttgtaggttgttagcccaagtaaacttgcgaaccgagagttcaatctctctcaaatttagactgtctatgacagcattaaacaagaagggccatttgtcgttatatctatcgttattcttttcttgtgggtttcttatgatattaaaatcccctcctattaccataggtaaagaatccctactacaagcattcacaagttctgtaagaaaagactccttatattcttcttgagctgccccatttaccgccactatgcaccattgcacatcatctgtcttatttctcacatggaatttaatataaaattccccctcatcaatactagctatatcgaaaaagtccaaattaattcccaacaaaatacctccagctcttcctcttggtcttgtccagtgccataggaagtccctacctcgacatatttttttaagccacgagtctgaaaagttgttcttacccgtttccaatagagcgataaaatctagcttttgctccttagaaatttctgagaggaatcttgatttagccaagtctttaagacctctgctattccaaaataatcctttcatggtgaacctcttttatttttagactttctccccaccttaactcgccttcatttatttttctttctccatttcttaacattatgtttcctcataagcatgtcggagtcacaacttaggtgacaatcatcctcattcatcaactcttccactaagccaccacataagtgatcaagaacctggttgtctaactcctcgttttcagaaaaaacactctcctcgacccccccccccttctaatacaacagacttctcaagatttgcactattgaatctaacaaactcagactttttaaaattatcaacagattctatcattaaatctctagtggcacctaggttcactcctatgtttcttaagtcatcaactacatgcgaatgagaaaaagaaaggaacgaatatttaaactcgttacc

SEQ ID NO: 4538 - DNA, 784 bp, Oryza sativa
gatgtgcaatggtgcatagtggcggtaaatggggcagctcaagaagaatataaggagtcttttcttacagaacttgtgaatgcttgtagtagggattctttacctatggtaataggaggggattttaatatcataagaaacccacaagaaaagaataacgatagatataacgacaaatggcccttcttgtttaatgctgtcatagacagtctaaatttgagagagattgaactctcggttcgcaagtttacttgggctaacaacctacaaattccaacttatgagaagttggacagggtgttagttagtactgaatgggagttgaagaatccactagctacagtcaaacactgagtagagaactctcagaccatacaccattgctgctagactcgggataaggaacacatataaataaacaacctctgttcaaatttgagcttgggtggttgttaagggaagatttttatgggttagtggagaacatttggaaaaaggaggacagaggggtaacaaagatggaaaaatggcaaaataagatccgtagtctttgtcaattcctaagaggatgggcgaagaacgtaagtgggtcatacaagaaagaaaaggtgaagttgttagccttgactggggatttagataaaattgcggaaactagacttttgattagtgaggagttggatcgtaaaaatgctatgaaggatagattggcaaaactgctaagagaagaggaattgaagtggtatcaaagggctaacactaatagagtattagaaggcgatcg

SEQ ID NO: 4539 - DNA, 1222 bp, Oryza sativa
  unsure (1)..(1222): unsure at all n locations
cctttgagcggccgggaactcattttgaactctacaatgtgatccagaaacctgacgaatctttgagtgattacattcgacgtttttccgagaagcgcaacaagatctccaacatcactgttgacaacattattgctgcattcaccaatgatcaactcatcggcaagttcgaacgcaaacctcctagaacggtcaagcagatgtatgaaggcaaaatttgccacaagacacgcaaagattatggtctttgctgtgggacacccgaagatcgtgtttttgctcgtggacaccgcaaaaatgtggtaattagctagaggacaccagccgcattattttattatttgtcgtcgaaacggagagagaaatagcgttgaaagtaccaaaatgcccctagacactgttcttcttccttctctttgcttctcttctcttcttcagcgagggagcataatccccaacttcaccggcacgttggcggtgagccgctcctggtgaactgtcgtcatcgtcatccaaccatcaccacaccaccacgtcctggtcgtctccaaccaaccaaattcttgcacacacacacgcttgcacgcagctccatcgagctatggctggagtgaacaacaacctcgtcagcctcaagcctgccgcggcggttccgcagtcggtcgcctcgtcggcgctgccaaagcgcgtgcacgtcgcgtttgtcacaccctaaaaatcccaaatgtataaattgttgtttaattggaattattagaaatgattttaaaagcctacaagaaaagatctaattttaaataataaattccaatataaaagtgggctagataaaattttattaaatacttctcttaattctatagttcctagatttttctgggatttatttgagccaagaaagtatttttaataaatggaattgcatttcatgaataatttaaattgaaaaaggttttaaaaatcttccttttggttttgggcccaaaaccccctccctctctctccccggcccaatcgcgcccgacctagtccgccgagccgagcagccgctcgccctcctctctcccgctgacagatggggcccacctgtcagggccgtcgttttcctcccgccacagccgcgccctaacgcgcgcaagccaccgctgccacccttccaaattcgaccgctccttttccgatnnnnnnnnnnnnnnnnnnnnnnnnnnnnnnnnnnnnnnnn

SEQ ID NO: 4540 - DNA, 1579 bp, Oryza sativa
  unsure (1)..(1579): unsure at all n locations
nnnnnnnnnnnnnnnnnnnnnnnnnnnnnnnnnnnnnnnnnnnnnnnnnnnnnnncaacttaggtgacaatcatcctcattcatcaactcttccactaagccaccacataagtgatcaagaacctggttgtctaactcctcgttttcagaaaaaacactctcctcgacccccccccccttctaatacaacagacttctcaagatttgcactattgaatctaacaaactcagactttttaaaattatcaacagattctatcattaaatctctagtggcacctaggttcactcctatgtttcttaagtcatcaactacatgcgaatgagaaaaagaaaggaacgaatatttaaactcgttacctgttggaagttcgagattcttccaagccttcctcctctccgccttctcaagtgagggaagctcaccactgttggcaagcctctaactagcacgctttggtgtcaacaacacttccttaacacttgctagctgcaccaccttctcctccttcccagctccctcttcctcccttctctttcttttctgcccgtcctctcttccatccccttccacttctatattatcaaaaatctcacctaacaccttctccattgccacatcaataacctcatcagctatccctcccaaaaatacctcctcatactccctctctcctctcccattcgacatcgcctcctcgctatctccatttcctccctctttcccttctactaccatatcgtcattccttgcccttttcgggctcctcccctcctcctcctcctcctcatccctcatatccttctcattgtcttttgatccatctccatccccccccccttcctgcataaactcaacctcttccccattctcgtcaaaacctttcttctccacctcgaactttagctcaaaatagtgatctcctatcaccacatctaacttccggggaataattgtaggatctaggacagccacaaaaattcttccaaagtcacttttccttgtggtcttcatgtctaccaattgcgtggctccaacaagggaaccaacaacccacaaagtaagatactccctaagtctctttctcaggccaaacactcttatccagactttgggcaacaaacaaccttcttctttctcaaaccattcctcaaattgcactctaatcccagtgaaaactctaccttctttaacatcagccccccaaagttaatagccctctgaagttcagacttagaagggaaaagaacgacatataccccttcctcatacactttcggttcccagttccatttgcccggacagattctttgcagctactcaatcaatttatctctagacaaagatcctccaatcacctttaccagcgccatctttgtccccttcttgcttctttgcagcggcgtgtgcggtatatggttgaaacctaagccctccacggcataaccaactgcttgcaccgaaggtttaggtatcttaagaattgggcatctatgattcacatgactatcacttgtgcaaatatcacaacaagacctcaatagtgcaatcaggcactacatgaccctttttgagcac

SEQ ID NO: 4541 - DNA, 5057 bp, Oryza sativa
  unsure (1)..(5057): unsure at all n locations
nnnnnnnnnnnnnnnnnnnnnnnnnnnnnnnnnnnnnnnnnnnnnnnnnnnnnnntatcaccacatctaacttccggggaataattgtaggatctaggacagccacaaaaattcttccaaagtcacttttccttgtggtcttcatgtctaccaattgcgtggctccaacaagggaaccaacaacccacaaagtaagatactccctaagtctctttctcaggccaaacactcttatccagactttgggcaacaaacaaccttcttctttctcaaaccattcctcaaattgcactctaatcccagtgaaaactctaccttctttaacatcagccccccaaagttaatagccctctgaagttcagacttagaagggaaaagaacgacatataccccttcctcatacactttcggttcccagttccatttgcccggacagattctttgcagctactcaatcaatttatctctagacaaagatcctccaatcacctttaccagcgccatctttgtccccttcttgcttctttgcagcggcgtgtgcggtatatggttgaaacctaagccctccacggcataaccaactgcttgcaccgaaggtttaggtatcttaagaattgggcatctatgattcacatgactatcactgttgcaaatatcacaacagacctcaatagtgcaatcagccactacatgacctttttgagcacactttgagcaacctataaccttcgccacagaccttacatcatctacaacacacttctgatcctcaaacagagtgggatcatatcccagccctataatgccagaatcctccaccatgactaccttcttcttgccttttgtatcctccgatccgatgtcgttgtgaatggcgccgctgccattgcttgatcttgctccccctaccaactccttccctgcaccttcacgagttaccttcgaattgtgcccttctttcccactcaatcctccaacctctcctctattgtttctgtttgttcctgctgggccgtcgcctccctggctgaagcaagcgccgcccccaaaaccgctacgacctggtctcccaccaaaccccccacgccgagcaccaaagcttcgggaccctctaggccgaatgccctgacgaaatctcccatactcctgttgcaggtttccaaaatcccgctgagcgcctatacccgagccaggttgaaaccctagcctcccaccttcacttctaccagcaccatgatagaagtcttcctcctcctgctccctgaaaccccctccgctgctcccccagttccggttcccatggtggttccaatttttcccctccctccacaccatggtttcctctctcttttgctcgtgagttttcggccgccgccctcgcagcttccttgttctggccctcgatgagaagacgcacaggaaccgaagcgactcccttactcttcgttcctttaacccaggcatgatgtccagcccgcgaaagcaaacgggccagccccacagggaaattaatctttgttaactttgacttcccaagccaaataggcctggccggcccaactctcctctccaaatttgaactgaaaaacaacctatcgccatgttctagacacgccgcttcggtatccgcaccaatttgtctgttgtccgctgaccgcgtcaataacccaaccgaaaaggagggttcgccggtgatcctcgaaaacactctcacatatttcttgaaatttgtgtaggagttgccccttgcatgagatgtgattatttatctctcatctttcttctctcctccacctcatcatttagtcctatgtggcatcttagggcttgtgcttgatgcccatagtagccttgagaagttttacttctgaccttcacttccttccagtggaaaagggaagccatgcgaggaagtatggtgcaactgaacttagaggatcaaaatcaaaggatgtttgcatgtggagagtaatagttcacttttgtttgtctatctcaggcctaggcttgtattttgataccatgtaacctctgaatgataatctcttaaccacataagctctggatgataatctcttatccacataagcttctacatatctcttgattctgaatttagcagctaaggatgcctgttacacgacaaagattatatatatatataatgtatttcaggtttttgctagtgatattcttacatcttcactggttgtgaagagtaatacacagcttaacaatgttctgaacttttcataagtactctaaacatttaaaatggcaaaacatcaaacttgctagagaaccggaaagctcatttttattcataaaagcaaaagcttcacaaacaaacagttcacatctctgaagcctgaacttacaaacacacagttgacatctctgaagcttgaacttacaaaatgtcctctatggtcgtattttcacaagctactagttacatgtcacgcccggaaattcctgaatacaattccaagcagaatgtgcattaaaacccctgtccagcactggctagggtacacaaatgataatgttgacatacagatccacgtcttacaaacattataaaagtcttacataaatgcagcggaaaataaaaggataactggagctaagccttgacttggatagcagtgggagacatcattccacaggcatcctcgatggcacgaacgaagcctactcctcagagaagccaccatctgacgcatactcaaactctgggttgggagatagccaccatctgagtactacccaccgtactcagcaagtcataccgaaacggagagtatgatgcagggtaaaaccaaagagaggtaaaggagtttatttgcataaagctagcatttataaacagaaattgaaagcagtaaaacagttgtaataattatccatcagttaacccacttgctgctcagcactacaccacgttgagacaagcccaaaccaccacatgaactaatcagttccattaagctaagctaagggtgagactaatcacggtgaatatagttgaccgcccataaccacgggcacggctattcaaataattttactctgatcagaggtgtacaactgtaacaccccgattttcgttcgggactaaaaatcaattaataatgcattttctagaaattaaataaaagttaaagcaatttcatcaagtgatcagaggtgatacaaagtaaaactatggcaacaaaaaaaaggcccaattcactaaaaaaaattgtgtattctactagcacaaagtcaccgttctcacataaaaaggattatgcgcgtgtgcgttttataggactcgaacatgagagacctctcttcgtacacagtatcccttaccatctcacgatcgtcggaaatttattcagcttggtttgctatcttatgtggtgttttgaatctgctaaaagatgaagttgaagattaagtgtttcacgcaaaatgaggtggtaataatgtgtgattaattgagttttagttattgcaaacttgaaaaatggattaatctgatattttagatcaaccacatacaaagttttcgcacgaaacgcaccgtttagcagtttaaaaaacgtgccacgaatatccaaaacttaatcatttttttaagccatctctagtggtgttgcagacctaaccagaaagagagaaaaatacatatgctaagctaaggctgtgtttagataaagggtgaaaatttttgccgtgtcacatcagatatacggacacacatttgaaatattaaacatagtctaataacaaaacaaattacagaatccgcctgtaaactgtgaaacgaatttattaagcctaattaatccatcattagcaaatatatattgtagcaccacattgtcaaatcatggcccaattagacttaaaagattctgtctacatttgatgtcgcgactacggtgtttggatggtatggggatcgttggtaccagggtatatgcgagattgaggtaaaagagatggagacatggatttttatacaggtttgggccctttatctgataggtaatagccctacatcctgttggccgaagccggtgttgctctttattcatctggatcacacaaatacaatatttgggataacatatctggctgtcgtcgacttggcagctagataaccaactcgtagccgacgacaggggtagtcttcctcttcgaatctgtactcggcaagatcagagatggcgctagatccctcttgccggcttccgtaggcaccggatgaggtatggctaggctactctctgatgtcgatatctggcggcgtgtgttggcttgtggctttgtggctttttggtggatgtgtcccctctgcttctaggggggtttctatttatacccatagatgcccccttgtccaagtaagactagggagataaatatggatacgatacaagtagtccttgtcgtttccatatagaactattcttgtcctttcttatccggaactcattctatatatgaggtttatttccgtataagaaatggtatgtggtaggccccgccgagtttagttgattactattgggtatgtgttatccataaccctgacagtagcccccgacttcaatgcaaatgaacgagttgaggttctcgatcgaagactttggaacaactatcatcgtgctcgcttgaccgttatcggtgagatcagagatagtgctagattccttttattggccttttagacaccatattaggtttgtctagtttaatctccgatgtcggcaaagaaggtacggaacatgcgactaagtctgtcgtcttgctgtaattgagagtttggattgaagtcaagaaatttcgtctcggcaggcacaccattgcttcattccatgttccttgtcgaactccaacggtcgttctcggataatcgagaaggtgcaaagtctgcgacaaagtcttgaaatctgacttgactgttctgatgtctgatttcccttatcaacatttgtcgtactcgcttnnnnnnnnnnnnnnnnnnnnnnnnnnnnnnnnnnnnnnnnnnnnnnnnnnnnnnn

SEQ ID NO: 4542 - DNA, 6586 bp, Oryza sativa
  unsure (1)..(6586): unsure at all n locations
cgtttccatatagaactattcttgtcctttcttatccggaactcattctatatatgaggtttatttccgtataagaaatggtatgtggtaggccccgccgagtttagttgattactattgggtatgtgttatccataaccctgacagtagcccccgacttcaatgcaaatgaacgagttgaggttctcgatcgaagactttggaacaactatcatcgtgctcgcttgaccgttatcggtgagatcagagatagtgctagattccttttattggccttttagacaccatattaggtttgtctagtttaatctccgatgtcggcaaagaaggtacggaacatgcgactaagtctgtcgtcttgctgtaattgagagtttggattgaagtcaagaaatttcgtctcggcaggcacaccattgcttcattccatgttccttgtcgaactccaacggtcgttctcggataatcgagaaggtgcaaagtctgcgacaaagtcttgaaatctgacttgactgttctgatgtctgatttcccttatcaacatttgtcgtactcgcttaatcaatcccagtgtaagaccgtagagacatggagtcctggacaacgttgaatggaattttcctgaaatcaatactcggaacaaaatattaaatcgaaatagccctcgagcgaacgctcaagggtaacctgttataatatgtatggaaaatttgaaaataaattgaatctacgtgtgacaataaaagagtactctcgctagagttgccctcagcaatcagagttctgtactcctcctagcccctagccttgtcctcggggaagtctgttctcggaggggaaggctcaatgacccgtaacttgcctagctgaaaatgcgatttacctagcccccagctatgaagttggaaaaaccaatttccgattacacggcttagttaatacaccttttgagcactcttacatgaccaggtcttacatggtcgttcggctctcagagtctgacaagaccttatctgctctgggcgtccctagccaaaattcccgtaggtctcttggaggcttgtcagaatggcgtaaagggtcaataggttcgatttcaagagtaggtgctatcgtggtaagggatctctggacaaatattgcacatacaagcacttacagaaaatgacgtagatgatgagacgaccaccacactaggtgaagaccaggtgtacagttgtgcccaacaaatcgcataggtagtgggagaaccgctacgctgctggtcggagaccagtcgtagtcataactcgaccacttaaagtggaggtatgagagattactacgacctactagttcgaggaccaggagtaggagtctctcagtcgtttgaaattaaggtgcgagagactagtcgtagtcgtacctcgaccatcagaaatcatggtacgaggaccgctgctttgctggtcaaagactagtcgtagtcgtacctcgaccatcagaagtcgtggtgcgaggaccgctacgttgctggtcaaagactagtcgtagtcatacctcgaccatcagaagtcgtggtgcgaggaccgctacgttgctggtcgaagatcagtcatagtcgtacctctaccacttgaagagaatccagagtaatagatggacgacattctcgtgacctgtgagaactgcctcctgatgatgacgaggacaatgaggaattatcgtagtcggaggttcagctcctgtacctactacctcatcctcgggccctctagaagtctggggatctcgagttttgtcgtcgtcgtcgtgtgacgtcgtgatgtcgttaaccttgtctgttgtcgtcctaatgtcattagtcctggatgttgtcgtcctagtgacaacggcgatctagtcagtcttggttgtcactatcacgagaatgttgattgtcgcgttaggtgtcgtgagattgatgtaaccgactagtcgaggaccaggagtaggcgtatctcgatcacctgaagatgaatttttaggtggtgagagatcgctacaatctactggtcgagaactaggtgtacgcgtatctcaatcacctgaagatgaacttttaggtggtgagagatcgctacaatcaactggtcgagaaccaggtgtagacgtatctcgatcacctgaagatgaattttcaggtggtcgagaaccaggtataggcgtatctcgatcaccgaaagatgaaattttaggtggtgagagatcgctacaatctactggtcgagaactaggtgtagacgtatctcgatcacccgaagacgaattttcaggtggtgagagatcgctacaatctactagtcgagaaccaagtgtagacgtatctcgatcacccgaagacgaatttttaggcggtaagagatcgctacaatctactggtcgagaaccgggtgtaggcatatctcgatcacccgaagatgaattttcaggtggtgagagatcgctacaatcttctggtcgagaactaggtgttggcgtatctcgatcacctgaagatgaattttcaggtggtgtgagatcgctacaatctactggtcgagaaccaaatgtaggcgtatctcgatcatttgaagatgaatttttaggtggtgagagatcgctacaatcaactggtcaagaaccaggtgtagacgtatctcgatcacccgaaaacgaattttcaggtggtgagagatcgctacaatctactggtcgagaaccaggtgtagacgtatctcgatcaaccgaagaatttttaggtggtgagagatcgctacaatctactggtcgagaaccaggtgtaggcgtatcttgatcacctgaagatgaagttttaggtagtgagaaatcgctacgatctactggtcgaggatcaggtataggtgtatctcgatcacctgaaggtgcgctagagttggtgattacatgtgtatctcatgtggccagcatgacccacattcccaactcatagcatatccggatgcccgttcgcaatcatgtcggatgatcaagccgacgtcgttcgcgagggattacccgttaacgacatattctcccatagtccggacgtggtcggtgctatatgtgagataagtcgtcagtcttcgttggtaggttgggtgcgacaactctgcatttgtcgagaacgttctcgataatgggtgtactcgaccacaacctactcgagtgctcaattgttcctgaaaaatattttctagaagacaagatgtatagcagataatatcgagcatgtactcaaaaaactgcatgaatcctctagtattatcaggatataatgagcagattaaatatcaggctttatgtaaaccataaataagcatgatttatacagagtaaaatagagcgagccccagcattaaaccgtagttggcctaatatagggaatgctcactaataaatattgtataaaaaacatgctctaggtaaacataataaattattgatctgacaatattgtatatatatgaaaaataagtacggtaaattgtatataaaatattgcgtaccttcgtagatacatgctggatgtatctacgaaattagtagatcaattaaattaattaacctactaattaccttaattagccatgctaatcacatggtgtgagcgtgtagcttatcttggtgcatgtccatctatgctgccatgcatgtctaggatttggttccacacgtgtggacgtggccggcttgagttgacgtcgtgatttgccattaatgttgacttgaattaatcctcctcctgaagactggagtctaaacccgactaggatacctcaatgatttctagtcggttggcaaaccgacgtcccctgcgacggcgatgacttgaatcttggttgatctcgaattgttgatgacgatggttccgatctcgtcgggacacgtactcttgccgggttggatctccttggtccaaagtagttgaagtatctctcatcaaaaaatccatagtgacgcggccatgacgaagcttgagatgacgagggtcccgatccgccagataatgcacttcggttgggttggatcccccctatagccgaagtcgtcgagtagctcgttattggagaatccatcttttgaacccatctcgtcgaaatcttgaagcaccaaaattcccctacctggcacgccattgtcgacgtttgatatcgcgactacagtgtttggatggtatggggatcgttggtaccagggtatatgcgagattgaggtaaaagagatggaaacagtgatttttatacaggttcggaccccttatctaataggtaatagccctacatcctgttgaccgaagccggtgttgctctttattcatctggatcacacaaatacaatatttgggataacatatctggtcgttgtcgacttggcagctagataaccaacttgtagtcgacgacaggggtagtcttcctccttgaatctgtactcagcgagatcagagatggcgctagatccctcttgcccgcttccgtaggcaccggatggcgtatggctaggctactctctgatgtcgatatctaacggcgtgtgttggcttgtggctttgtggctttttggtggatgtgtcccctctcctcctaggagggtttgtatttatacccatagatgcccccttgtccaagtaagactagggagataaatatgaatacgatttaagtagtccttgtcgtttccatgtagaactattcttgtcctttcttatccggaactctttctatatacgaggtttgtttccgtataagacatggtaggtggtgggccccgtcgagcttagtcgattactattgtgtatgtggtatccataaccctgacagattcgtctcgcaatttaaacacaacatgtgtaattagtttttcttttttctagtatttaatacttcatgtatgtgtccaagcattcgatgtgataggatgaaaaaacttgctagggatctaaacatgccctaagatggttggaactaagttttggacgcacatgctaagctaagatagtagcaaaaaaatttcagcccctccctccatgtgctggcgtatccacccaatactttctctattttcgaattgtgcgtgggttctactccatattaaacggtgtgcatcatttctcaagggtccaatatttcgtttggatttcaccagccaaatttcacctctcctccaaaccgctcgctttatgtcaaattcgaatttcaacccaaaccggcaaaccctaatattccaatttctgggataggaggatacgggccgataggaggcctatatgggcctattgggccgggctccaccggagcaaaccccctcacatcatagggggacttggccatcgccgccggcagccacgccgccgccgccgcatctcgctcccctaccccccaccgccgcaagcctccccggcggcgaaccttaccgcccccgcaatggccgcggactggatgtgggcgcgccggtcgtgggagaagtgggctgggaagcacgtcggcgcttcgggtctcccctcctcctcctcctccccctcctctgccgctcttcgctgctgctgctaacgagtcgccgttgttggtgatcttgcagggaagccggtcaaggcggcgctgctgctcaactacgacccgacggggccgtctcgcctcctccccgtcgtgtgagtctccgatcccccatccatccccaaatcacgggcggtgtttggctacttcttggtcgtagggtagcaaccgtgtttgtccgtctccttcgcctcgatgtcactaggttgtgggactgggggcaccgtgaaattgttgtttctgttgaggagtatttagggggaaattgtttggtttattttgttggagttctatatgacttcagcattgttcgtttcctgcctccggtagcaactgagtaatttacagggccttctagtttgattgaaggaggatagggattttgatggttaatcatgaacttagtgatactcatcggtttataacctacaactcgatgacacagttgaaatgccaatttgataaacaacaacggcagttccaagaatggttttcagcttgcttgttggtaactttggttcggtctcatgtacttttgaatgtttgatgattgacaaaacacatatgtccagattcgtagctagaaatgcttatatttttggatggaaagagtagtttatttgttcatgcatataatgacaggaaccaagtataagctgatatttttttcttatctttctaacattccactatgtttacgtcattcagtttgctctcaaaatttgtaatgaagagctggtagggccatatattttctatataaatgtacttacttagttattatatacataatttacgggaagcttgttcatacaaaattttatcagatctcgcagaactaaatcaaggaatactttactagatacggagttttgtaactgaacagcagatgtgaatatattagatagatttcagtgtcaaagaaatgaacttatttgttgtgatacatgaatgatgaagnnnnnnnnnnnnnnnnnnnnnnnnnnnnnnnnnnnnnnnnnnnnnnnnnnnnn

SEQ ID NO: 4543 - DNA, 3905 bp, Oryza sativa
  unsure (1)..(3905): unsure at all n locations
nnnnnnnnnnnnnnnnnnnnnnnnnnnnnnnnnnnnnnnnnnnnnnnnnnncgtagctagaaatgcttatatttttggatggaaagagtagtttatttgttcatgcatataatgacaggaaccaagtataagctgatatttttttcttatctttctaacattccactatgtttacgtcattcagtttgctctcaaaatttgtaatgaagagctggtagggccatatattttctatataaatgtacttacttagttattatatacataatttacgggaagcttgttcatacaaaattttatcagatctcgcagaactaaatcaaggaatactttactagatacggagttttgtaactgaacagcagatgtgaatatattagatagatttcagtgtcaaagaaatgaacttatttgttgtgatacatgaatgatgaagatcctaaggtcgaaaattttcaaatattcttttttaactgcccagagcagagcaagaaggaactgaactgaaagctgttgatctgctaccatttctagactttgttcgacggaacaatctgcagatggaattcttctctattggctcaaaccggtgtaagagactcacattatgaatctgaatcaaccgtaccactcatagaaacgtcaaacgctaattttatatttgttatctccagcaatattgtgattgccagttctgcatttacagatttggtcacctcaatccatgaacactggttctgtgctcgttgcgttaatgcagtacagccagaaggtgaaggtgttatagttatggagattggagcttacttgttagtttgtatgtacgtatctcattgttcaacttttgatttacagaactctaaataccaggtttcctttaattacttccattatacaaatgtgttcctgccaaaaatttattttactggcattgctatctgaatgcacaggtatgatggttctcttggttctgcttcacaagcaatggtggctgttgatcagtttgcatggcactttaatcgaagaactcactaactgctgatttttgttagtttcaggtgtgagatctgagatgagtctagacattgttgattgaaatcattcttctaaactttagtgtaactgcctaatattactgttctcttgggtttagttgtaatcgctattagctgttttctgtaagacagatgtgtttgaggcaatttaactaaacttattagggcatatctactcggtagtcgtaagtccacataagctttgtatattttgtgagaatgctttaggttttgaatatttgacctgatgtagtggcgagatattcaatggcatatcatttaatgttaaagctgaccatgtttgtaagaacgaaagggagaaaatatgtcagattttcctattcttgttattaatgtaggtgtgtctaggacataaaaactgaaccgaagtaactagtgaagtgaagagttttaatttaatatttgcctatcatacaagtgctaaatgtattgaatataattatttgtaaggtagtaccttgcacatatcttcatctatcggacctgttcgatgcactgattgtcgttaggtaatgaactgaactctgaagctagcgatatccttccaagcattgccaagtgcaaatgacagaaaacagcgtactccctccattttaaattattctaacttttaaaatttgtgtcaagatacttatcattctcacgttagaaagcacttgcgtctttctcttaatttgtaccctttatcaatgcaactatagtagtactttgaaaggaatttttaatgcttgctttaaaaagatgattaaattataattaataagggtatcttaggagatttactataacaagaagtaaattgaaaaggagggagtatattaagcggtgatgatcacaagaaaaagaggcaaaattggttcttgaacatttgcattaattggcactcattcaccaaaacataccacaatataattctcatattgcctgaaagacgctactctctctatgccaaaaatgcaatattataatatgttttatcctatcctaatttgttatattttaaaacggagtaaatacattttaaccaatctcatttataccaatacaaatacaaagcgattagaatgcccttcactttagcgaaattcaaatgtattgattgcttcaaagataaagtctttatggttaaaataaaatgtgctaaaaatataataaatcactaaggacaggaaatagtctaccaccacacttattttcttatggaagtctgaaaatcagccctaactatttctttcaaactagatactattcacccattgactctcccctctcccctcccctagaccttttagctttttacttatatagaagtctgaaaatctaccctaatattttttttaacctagatactctttccgtacttgtaaaggaagccgttttggacagtgacatggtcttcaaaacacaactttaacttcttgtttctataaaaatatttattaaaaagtgatatgtgtatgattttataaaagtatttttcaagacaaatctattcatataatttttacgttttcaaactcaacaacttgagagttatttatgatttatctcccaaggtttaacttaaacattgtcataactgacttcctttacgaatacggagagggtactattcaccgattgagtctccccggcccctctcctagacttttaacttgttacctatgtatgaaagtcaaccctatattttttttcaggctagactattaatcccttgacttttcaaaacattcactttacacccttcaacctaaacctggctgttatttagttataaataaattagtatatcaaatataaaatatcattcaaatacattctagcgaaaatataaccatacaactttcgttcaccatagttgaacaatttagaaaggattaagcttcacaattactccagttcaacgaattatgaagattaagctatcacggtccactgagtttatgggaattaatctgagtttatggggattatttagtgaagaaccaaccaccgagtagatcacttccgtgcaagttggttgacaagtataaaagcatgacccaaacaaacatacacttaaacatagattcagctaaccttaatggacaatgacgatgtaactgaactgcttcaagtgtaatcatgcatttgtctcccacaattaaatactaaaccaagatcaaatccaagcattaatgtctggattgagtgctgccttgtacatgtctccaacaacaagaagaaagtcaatattaacaaccccaactcttactcctcctcattggccaaatggtcatcactctgtcttctggacaaaacaaaaacaaacaaataaattatcctgtgaattaactatgctgctaattgcttcagctaccctataatgcatgtaattaattaacattgcaattaagcacataagttaatcacccacatgtacaggtgttactacattgcaaagatgaacatgcattaatttgggcatatgcacttgataatttttgagctagagcctagagggttagcatgttcttgtccgggatctcgccggcggtgcaccatgacctgcagccgggcggccgtagtccgtacgacggcgacgacggcgaccgcacgctggtggtgctgctcaccttcggcatcttcttctccttcgtcatcctctacctcgtcgccggcctcatctgggccgtcgtcatcaccgccggcgccgtcgtgctgtccttcctctacctcagggtccggcggcggcgcgccgccgtgggcggcacggcggcggcggcggcgcccaacgacgtggtcttcatcgtgggggctcatcaagctgctcggagcaccggcagcagc

SEQ ID NO: 4544 - DNA, 11356 bp, Oryza sativa
gccgccggcggccggttagagctgccggtttgatcgatcagctcagctcagctgctggctgatgctgccattggagattagctagctgttgcttgttgtgtcagattatcatgttaatttagttcgagatgaagcttgacaagttgacataatgtacagaatgtttacctattgatgataatctaatgtgtatatatattcatgtataattttacattacatgatagtattgctggttccattttaggctttctctttctccctacggaactgaactaattcatatgaaattcataacagaattcctgtagaattgagaatttgagattgtatagatgtgcacgctattggcttttgcaagagttttcttagcaaagactttggtcgaaaaacaagaaaaagtcacgacgaggagatcgactgctaaggcaggttacaaaatgagatcattaattcaaattgaagtttggctggagggcgccactgcaacggctccagtgctgaggatgaagagtgcacatgttgctgcttcaaaaagaacatattccacttcttttgctagccttcaggacagcagtgcaatgcactagttttatgttgcttaatttgtgtttctttggactccatgatttaaactttgtaggacaccatggacttttttgagatacgtttcaccgttcatctttattaaaaaaattatgtaattattatttattttattgtgacttgatttatcgatttattaccgaatgtttctttaaggatgatttaaatatttttatatttacataaaaaatttaaataagataaatgatcaagcatcatacattaaaaacgaagatagtagttgctaaaactttgaacagactttcctacgaatgtgtgagcgaaggatgggatggcattcccagcgcatcattcagcgtatttcatgtctgcttttgtaaaatcaggcaaaggcttccttagcccacagttttaatcctatagctaacttatcatttgctaagtccctttgtaataaaataaaacaaaattgacttttgcaaggttagtcaccgtgattctttccgtgaggtgtgaaaagtactctcacgggttagcttgttaattttccccttttgagtggagaattctgacacgctccatctaataatgggcatgttcggctgccggggctacggctacgccacttctagcacgaagctgcactcccaatatataatgactaatcgtcgacaggttcagaatttaatggtggtttcatatataatctctatgtatgaaatcgttagttattcatcatattcaaaatttaatataaatataaaaaaataagtcatttaaattacctttggcgtgataaaacacgtaacaacaaatatatatacttacataattttaaactaataagacaaatgatggaatggtttcatatattgaaaaataaagatacggagtattatatttcttttttttatcagtgctaaaggatttgacttttttgagccatcgaccgtccgtacgtgttctagctagttcgctagctagtgttcgcgagagcgacttgtgactgaatttgacaatatcaaaattcggatatgccgtacatgtgcttttacacgtacaacgctgcaagaggatgacagaatattgatatgacgtgtcgaacacctggaagccttgagcaacccaacttataaccatcgttctttttatataaactaaaaaaataccggtatgttgcgaagatgaaggctatcttaatcttattattattatatggtttagctaaaatgaaattcattgtaggaatttgcttggatattgcttttacaagatcatgagctacaattaggagtccaatcatcttaaattagcatatgagttttttaaagagatctcttatatgactcttatattttcaaaagcaaatgaatttaaaatctactcaaatacaaatctgaaattccaaaagcgaatgaacttgaaaactaacttaaacacggatgacgtatcaaagtaccggcaaaaatatctttaatttttataatagtagagatatatgttagtaaaattgtagttttgttatactccctccgtttcaggttaaaagacgttttgactttgatcaaagtcaaacaatttaaagtttgactaagtttatagacaaatatagtaatatttataataccaaattagtttcgttaaatcaataattggatatatttttataataaatttatcttgggttgaaaatattattattttcttttacaaacttagtcacacttgaagcagcttgacttcgatcaaagtcaaaacgtcttataacctgaaacggagggaacggagagagtactatagtagaattttttaagtgataatcttgagactagagaactgatcatatttactatttctaattcatcagtcagacggagcgggagcaatagttttaattttaagttggttcaggatattattgttttaagttggttcaggatattattgtgcttggatatgatttggatttgctataattttttaaaattggtaggagataaggtctgacacactgactggtttaatatattagtaatgtgaataattagatctattattacttgttggatccaaccctcgtttcctttttttttttttttcatgtttgggtgactacgacaaatatcttggttgatgatgtaacagaggtaaagaaaaaaattgcttggagacaacacatttgtctcaacaattggatacagagacgcgtgtctgagttcacccaaccaaatcttcagtcaccagaaaaaaaggaaaggaaaatgtcgaactagcccaagcatatataatttctgatttttgtagcttgttcaagtacaaaccatgattctattttgtatgaaattgtactatcgctcctgtcatgttgctgattatatagatgagaatccaaagtgttgcgagagatttacacaacgaaatactacacttgtaatgtcccagatacatttgttttgtatgaaggcggattcgttttatggttttgtgcaagctatcttagatcaaccatggaaatgctaaataaaaaattaaattgtaagctaataaatccaggcaaactatgttaatgattaggttgccttgtgtcctttgaactatgtcaaaatgatgtggcttaaccagaagaaaaagagagatttcataatgatataccccatccattcaaaaaaaaaatccaatctaattaaagttaagacattaagacacaacataatacaacgaaactgaattgtcatgtcacatccttagctaggttgggtttttctatacggaggaagtaataaatactccctccgcattttaatgtatgacgtcgttgactttttgatcaacgtttgaccattcgtcttattcaaaaaagttatgtaattattatttattttattgtcacttaatttatcatcaaatattctttaagtatggcataaatatttttgtatttgtataaaatttttgaataagacgaatggtcaaacgttgtttaaaaagtcaacggcgtcatacgttaaaatacggagggagtaataaaggattggaagaaaaaaaaggaaaaggttgtgtaggacaactactcacccttgtacctaacattttagaccaaatgcagggctgagagcaacagtgataggaaatttgaagcaaatgaaattgtctatttacgtcatgacaacatttgcgaaaaaaaaaacctgtcaatttctcttgaaaccctcaccagaaagagacaataacgaattacgtatagctgctcaaacttaagagcatcatcaaaagtccaaatagccaaggaaggggaaaatgggatgatggaggctttgtttctgcgggtttttagcagttataatttacaaaaaaaaaaaaaatgcatcggtagcttttgctgttcaaagcgaaatcgacaataacaaacaagatgagatacagcaggcacctagattgttataaatcttacagctcattttatttctcggaggcaatacagatcgatcaaagcagctacccaactatatccacagattcaactccttatgcgctcttcatttgctgcatcaatcacaagaacaagatggaaccagctcaaagatcaattaggcgcacaaactcaaactggactagcatgtcatgtatgctcaaccactcaggcaatggagtttcacttagaagatcaagatataagctaaggtcgttcgaattgtctattgaatgatgttcttttccaaaccccaaaacaggacgtgcacatatatccatattaatttcatttacccttcaagtgatgtttatttgtaaaccccaaaagatgatagtggaaactcttggtctttctttttttacattttgtgctttcatgcttggctgtattagcaaccaaagtatcttctgattcttgccatgttgaaaaaagtttacaaaatttccaaacaaaacccaaaaattttcaggttgcttcaaatgtgtgtactagtgtagtttatgttactttcagttgcaatggttcctctaaaaaaaagaagtaacgttagggtgcattgcaaatattgagatttagaatgtatatagtatacacacataccgttttctcttcttcaatcttagccttgatataagaatagagtgcaacaccagctatggcaatgcaagtgccaattcctgtttgtgtggtgatcttgttgcctgttcaacattaagttcaccaagtattacacaaaaacatcagatcatttgcacactaaaactatgtatatgaagttctacaaaaaaagagtacaacacttgccaatggcaagaacaagaatatgcatactgatcgacaatcattatgaaagattaaaattaaaagtaccgaatgcaatgattgagaagccaatgacgaagacacgttttaacacattgccaacagcatgtgttagaggggtcaccctttctaatgtgtttgtagcaacctggataaaagagagaataccaactatcatcacaaaatggcagaaaatttatccatatttgcctaatactatgatttatttctatatctgaacaactataaaaagttttagtttcaaaatattgatagttacgaacttacgatgtgggaaatgcttgtttttattcttgacatgtggactaagttatttgaggatgttgtttgtaatagtgattaaagttgtttttaaccttcatctataaaccatgttgtttcatgatattcttgatctatgggcaaattatgacattaagctatttacctggttataaaggtgatagaacaagcccaccacaaggagattagaaaccaactttgctaatccaactttagcaatagcatctttgaatccatgctgcactagttgaggtccttcaatctgcaaaatttgtgttataaagaatcaacatgaaagtcaatgataatgcgtaggtgactttaaaggtatcttgcggacttaagaaatcatgagaaagggcatgtagcctagtggttgcagtgacctgagtagtaccccaaggtcttgagttcaaatcttcataggagcgaatttcagattgtattgtttgaggggctaagttcctaatttaaatggttatatatatccgattggatatagaggccgggtaaaaaataccttctctaaaaaaaagaaatcatataaaagaattttattaaccacactactatgggctaaggccctgcgggtagctgagcatgccttcctacagtacggttagttcacatgagcagtacctacatctatggtttaaccttgccttgcctcaagagcctgtaccacatcatgcaagggacctgccaatagctagatgagtgggaatccctacccttgatcctcacaaccagtacattgtaccatcagtccagggactaataccaaagacaaatgcataagacatgtacaggcgaacatcaaaattggattaggccacttgcaggcctgtcaaccatacatacacctatacaaacagcatataagcatgagcacatttctaaacagacgttccaatttcctctggagggacagggagaggccggtacaggccaggttagttagcagggcaggaatacaaaacatattatttggtttgtccaatttcctcccaaatgtggccaccaaccacagctaattaacaggaagctgtgacatcagtttcaagttttctcaacctcacaagcagagtgattttcatttcttagtagtcaatcatgatgttcaaattactttagtagcaaggttacagtggatctccgattattttcagactatttctctaccgctctgcgctttggacccagtttgaactttgaaggcattgtgctctgctgcaacatggaatctggaatgagaaaacaacaggagctttgcaaaaagtaaactgctaaaatcactttttctaatatgtattcgcaaactgtaataaatggttattatcagggttatagaaaaacaacaacaattttgagtaaaatcctgctcctaggctggtattccacgcaggtaatatcttaaatttctaattttaaaagtaaatgcagttacttgcttactgcaaaagatcatgtgcaagcacatgaagcgatgtttcgtgatggaactaaattttcaaatgttgtgcagtttttcaaagggatagaggaacagtggtttgagcatgaaagggaaaattggattttaccatgtcagaacacatgattagggtaattagagaaatggaggtgttgcatacactaggtagttttgaccttaggaggaaaatcaggaattgttgtcaaatgaatacaatcattgtgaccatctttctttatgcccccacattagtctgaattgaaaaaatgccttatattatttaccaacaaacacaagagttgcatgcatgcataaatcacaactacttgcaagagtattgcaaaacatggttactcacaacaatgaactcctaaaaattgctaaattatgtagtggtttactggtttatggatcaaattctatccttggtggttggcaattgtagaacacatgcatgatattctttcgtagtttcttcaaattcatataatcaaaatttgccttttttgtaacatacgcaatatggtcagtgcacaaaatccaggccaggtcagaaaaactggtaactactagttactagttctctccatggattcgaactgtagactctggtcattacactcctttacttgttttcctacatagtgaatactgaataattttctactgtatttcaaatcctctccaataaatcaacgacaaaatatcatcagcacagtgataaacaacaagatggtgagaacttgataaatatgctatgcttaacatcggctatgttgcgatatgcctttttaggtatctatagacctatatgctaccaacagctgaagtgttaaatatgtaacaaacatgcataaagataaaattagacttacaataattgcaggagggatgcagacaaggagagcaattattgagatgtacgcatacaggttggtgctatccatgtcagtctgtgataaagaacagcaacaaagtaaaaaaatgaaacgggagtatcaaaaggaagagtgaatatgcatgcagatcattagaggtaacaagcaaaccatagccttcttggaataaacgctccgtaatgtgaaggagatattagaaatcatggcattaacgaaaccagtccaattgaatgaaagttcagtgagagatgccattgaaacacctgattatttcaaaacagaatatactccaaatgattaccaatgcacagaagtagagatgctatagagacaactagaaagtcctaaaacataatatgcttgaaatgattaaagatgcatggaggctgtgaggaatgttactgagacaactgatagtaaagagtatccctggttccctggtcatcttatataatatctagaatattaatattaatttcctatctaagcatgtcatggaggaatctgtggaattaagcaataaacagtgaaataatcaaactgtagtttctccaaggttcttcaatctcatctttagtctgttccctcctcccgaataaccaaggcagctcagcctaccccccccccccccccccacaaagcccacacacagagttgcgtttatcgcacgataaggtaggtttcattaagcatgccatcgtgtagcacaccacttattgatatgccattgtaatatcatgatgaccagaattcaggagaaagaaatggtcattacgctataggaattagagagaaataagaaagaaataaagaaggcccaaggcccaacctactaggaacatgtgtccactctgcacaacagaaaggactataagtatcaatttggctctttctcatttgccctcatcataaggcaaggcatctgatcatggaaatgttactggagtgcttggatgctgaggcatcacctgcacaggggccttgacaaccatgaaacctactttcatatgtccttatttgcattgatgttaagatacaagtgatgtactgctaggaacacaagcaaaaggcataatgagattacctatcacaaccggagcaagagataaccacagcgtcaatggaacttgctggccaaggataaactgtgaagcagccgcattgaaaaatggttcaagagctgcaatcattttatttgcaggaaaaatctcagcataaagaagaaacgcaaaaggccaaaaatacaaaaataaaatcaagatactgttgcagtacctttaatggtgtgggcaaatgagacagctacagcagcaaaggacacggtgcttgttacatgaccaatagcatggcagacagcaactgggaacagtagcttcagaaccgttgagttgatcggctacaaaagttcaaactttcccaagtttgactattgccttccagaaatgatatcattaacgtaaaaaattttggatatgaaacaactgatgatacatacaaatatacaactttttcagtatgtatactagcttgatgtatttagggagttttttgtggattctactttgataagtttggcaatttgttgccaaacttgggatgccacactttcttaaccccatgtccaatatgccattgatacaagttctcaaattttgcgcatcaattttcttgccacaaaaatcatggtatgccacattattgggacaactagaagtgcgcatatgtgtttagacggaaatttattttccttatactaaaagcataaaaaaaactaattttccaacaggaaataagattttatatatgtatcagtaagttgatgtgaagtcggagcaaggatgagaatgtagaacggctatcaccaccaattactccaatattaaaagtagagaaagagtggcaaactgcagcaatttaccaaatgagcccttaggctgtgttcgcatgtggtggatgggaacttattccctccgcacagaaaacggagcggtccattagcgcgtgattaattaagtattacctaattgtttttcaaaaatggattaatttgatttttttaagcaactttcttatagaaactttttgcaaaaagcacaccgtttagcagtttgaaaagcgtgcaagcggaaaatgaggaagaggggttgggaacaaggggttgcaaacacagccttaaccctttcttttacaagtgctcttcacatgattttcatcgacatctaaagttcgcggacaccagtagcaagtcaaagacttgaaatctagtagctggctgccgatcctcccttcccctctacaaggtagacatataaccaaaatacttgaaaatgccctaatgtaggagatcaggtaatattgatcctaattgaacacaaacaggtaaagccacagaaaaaaattattcctggcctgtttaaatccaatttacgtattcgtccagaacgcttgtcagtcagaaacatcacacataagaatgaataagtgattttgttatattttgagggccataaagcatttcattataggttttcagctaatggagatgtaaaagaccagcaattttgctctatcatggctgcacattatttgacaattgccattggcaatgatatatgttgaccaacaacccctaataattttgtgtattcatgctcattattgaaaggaatcatggttgaagaagggcatgggcatgagaataccgcgcgctttgggagaccaaaactccagccgacaaggcagtacaagactcctaccaaaagatggctcaccgacacaaaactatattaacaagaaagaggttttagatcatgaagatgcatgttgtcacatgaaaggaaaaagaaaaggaggcacacatataaagcaaacgtactatggataggggaagtagtcgaagatcttcttgttaaggatgttaaatatcacgttcagaaaatacctacaaaatcatattgtgaattggcaatagctaaaccacattaggcagcaacttctcagttcgctcacctgcaattgtaaattctaaagtgcgctcaggtgagtaagcataccacatgaagaaaaagaaaccggtgacaagagcagggtatctctctgcaaatcccacaggctttgcttccctgtaaagtgtaatagcaatttctcagttcccgaaattgaagttacatatacagggtggtgagaagaattggaattagttcaaatagagaatgatcacttaaaagtttggcacggttcttttgtttaggaggcgttgtccaactagtgaaaaagttaccggattcatagcttgtccctaattgctgcaaacctatcttcctagctcttaactttccattaatgaaagagcatgctagcctattgattcaaaaagaaaatgcatatctacaaatatccactgagaataaagtaactccatcgcctagactctactgtcttaaaaacttgccacaatcagaacctgtgttggaacatatgagaacataacaagaatataaatgcagaaaaaaaacaaaacagaagatgagaaagcatagaaacttggtgtttgagacacaggaattgttatccatcattccaatggaatatttcccttgtcttcagttcatttttattttcctttgtgaagtacatgaaagagcaaaacttcaaaggaatctggcctattcatccattccaattgctacaatcggtgaaagaacacttatccgagaggggaaagcactatatgtttgtgtctttgtgatatgggccatttgtccaacaataattataaatgagtggatattttgcagtcgacctgcaggcatgcaagct

SEQ ID NO: 4545 - DNA, 1067 bp, Oryza sativa
taactccatcgcctagactctactgtcttaaaaacttgccacaatcagaacctgtgttggaacatatgagaacataacaagaatataaatgcagaaaaaaaacaaaacagaagatgagaaagcatagaaacttggtgtttgagacacaggaattgttatccatcattccaatggaatatttcccttgtcttcagttcatttttattttcctttgtgaagtacatgaaagagcaaaacttcaaaggaatctggcctattcatccattccaattgctacaatcggtgaaagaacacttatccgagaggggaaagcactatatgtttgtgtctttgtgatatgggccatttgtccaacaataattataaatgagtggatattttgcagtcacaaataaattggaccaatcatcagatgtattcatgaacaatgccaactttccttatttgtttctttttaaaagtattcatttttcagtaaaggactcatgtgctatatagaaattatggttaacactaagttaatgtaaactccaaaacagaccttaaaaagtgcacacgactctgaaaaactcaaatcagccttatctgacctccattggttcatgatggaatacaaatagaaatcacgaagggaatttcaaggtcccaaatgcaagtaattgtccatgcatagcctagcggcatattttgccagctactctaaaatcgacccatacattgttccttgccagttatctaatttgaatgctcttttagttagtatttgactcttctcctaattcaatagtgaaatatataagaaaccaattcctcatacatatatttggtccagtaatgaacatcgctacactactcattcagcttagagtaaagtccatcaccggtccctaaacttgtaccgttgtgtcatcccagtccctaaaatcgcaaatcgaccgttcaggtcctcaaacttgttcgactatgtcatcccggtccctaaacttgcagatcactcgtttaggtcctccaacttgttcagctgtgtcacaacggtccctaaacaggacggtctaaaaactttatat

SEQ ID NO: 4546 - DNA, 714 bp, Oryza sativa
cggcccgcctgcaaagatcaatcttcgcaggcagaccgccccctccaccctgggtactttttttgccggcggggttttggctccgaattacatgcccgcctgcgaaaatcgatcccctacgacgccgaaaatgagttttctagtagtggcaaggaatcaagtagagagtttataatgcacctcagcgtaagcatcgatgctatggagggaagagtcgatgcggacgatgctcccgacggcgaccccacgtatccacacgggcgtgcccacgcagatcccgcaggcctgggtgaactcgaagacggggcctggtacttgccgaagcgggagcgcagctggaacccacggatccacgccaccgcgagcgcgagcagcgccgcgccggtgaccatgaagagcccaacgccgccttcccacacgccacagcgccccgggcacctcgacgagcgccgcgagcgggttccagccaccggtcgtcggcgtcggcggcggagcacgcgacggagctagcttgggctcggtggggcctgggcgcgcgggcggagaggtgggttggggagggaggaggaatggcttggtggtggccatggatgattggtggaggaatctagcgagagatgcggatcagttcttgggggattggactggggggaagcggcagtgcgggacacaaagaatggttttgaggaaatttgttcggaaaccggagaaagg

SEQ ID NO: 4547 - DNA, 622 bp, Oryza sativa
  unsure (1)..(622): unsure at all n locations
nnnnnnnnnnnnnnnnnnnnnnnnnnnnnnnnnnnnnnnnntcctttgcggatattatgcgtgcgaattccttattaacgcggaggatgtaagtctttatactatgtattagacagctcttgatatttatgatactaatatattgattaatttcaatgcatgcagttgccaagattagaatgtcgaacaagctttgacgatacaggtatcacaaatgtgcagcgtgatctgtgccacttcatccaccatgagtgctctcatgtcaaaggagatttcttcgacccagagggtgccctagcggcaagtgacgaattcaaggatctttgggagtagaacactgctatgccataatataactaaatgacgttatttgaagtgacaatgtaaaacaatattgtaatatatatattttggcaacacttttgatttatgcaatataagtagatttctcagtaccaaatgcttgataatctttcaatatatgtacctgcaagaatttctaataaataatttaaaagtaatttacggccaaattataattaaatttcaatattttctacctatcttcgcaggcggaagttttttttttgcaagcggacgattcctattttcgcaggcggac

SEQ ID NO: 4548 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnagtgcagtaccgaaacttctccaatatgaaggtagtttcgcaataatgcacccagccacaaatttgtcgggtaagacacacttacggagttcgagttccttagccatggtttgtatctcatgagcctgttcgattacagaacggttgtcagccatcttgtagtcatgaaactgctctatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaaaaaatcatgacattacagatgaaaactagcatgaacgcatcattagatctacacatgtgaactacacagtataacatgaacagatcaaatatgcg

SEQ ID NO: 4549 - DNA, 766 bp, Oryza sativa
  unsure (1)..(766): unsure at all n locations
nnnnnnnnnnnnnnnnnnnnnnnnnnnnnnnnnnnnnnnnnnnnnnnnnnnnnnnnnnnnnnnnnnnacttgaattaatcctcctcctgaagactggagtctaaacccgactaggatacctcaatgatttctagtcggttggcaaaccgacgtcccctgcgacggcgatgacttgaatcttggttgatctcgaattgttgatgacgatggttccgatctcgtcgggacacgtactcttgccgggttggatctccttggtccaaagtagttgaagtatctctcatcaaaaaatccatagtgacgcggccatgacgaagcttgagatgacgagggtcccgatccgccagataatgcacttcggttgggttggatcccccctatagccgaagtcgtcgagtagctcgttattggagaatccatcttttgaacccatctcgtcgaaatcttgaagcaccaaaattcccctacctggcacgccattgtcgacgtttgatatcgcgactacagtgtttggatggtatggggatcgttggtaccagggtatatgcgagattgaggtaaaagagatggaaacagtgatttttatacaggttcggaccccttatctaataggtaatagccctacatcctgttgaccgaagccggtgttgctctttattcatctggatcacacaaatacaatatttgggataacatatctggtcgttgtcgacttggcagctagataaccaacttgtagtcgacgacaggggtagtctttctcctt

SEQ ID NO: 4550 - DNA, 693 bp, Oryza sativa
  unsure (1)..(693): unsure at all n locations
nnnnnnnnnnnnnnnnnnnnnnnnnnnnnnnctatggactttatagaggggctaccaaaatcacaagggaaagatgttattctggtagtggtggatcgtctgaccaaatatgctcatttcatagcattagcccatccatatgatgtggagcaggtggtagaggcgttcatgaacaatattcacaaactgcatggtatgccgatggtcatcatcactgacagggaccggatttttactagcagtctgtttcaggagattttcaaagcaatgaaggtcaagctgagatttagtactgcttatcacccacaaatggatggacaaactgaaagagtcaatcaatgcctggagtcctaccttagaaatatgacgttccaagaacctcacaaatggtattcatggctggcactagctgagtggtggtataacaccactttccacaccgcaattcagatgactccgttcaaagcaatgtatggttattctcccccacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4551 - DNA, 726 bp, Oryza sativa
ctcggtacccttatttggtgctatctatacactcatgaggacatcccagctacacttgatgtaaaccaagttaatggattatgtctcagcatgaacgatcaaacatatcttggtctaattacgtgcaaccgtgctaggaaaatacatcaagaggtgaactcactatttactcatcttaacccaaattttagtgagaattttatactacctaaatgctttatccttgtattgctaaggtttacacctgaggatatcatcactacgtcaagaaggatgagttacgttgaggacgacaagggttatgccgaggaggaatcaacccatgcccaaccagcagctgtctatgctaacaagaagatggtttacgttgtaaagactcaacttccaaggcttgtgcgacctagccaatcaagtgacggattgcatggcatacattgttggaaagagggacaagtctagtttccaacgcatcaaatcctacctcaatatctttatccaataagaagttatagcatttttaatgaaggctgggcaggaaagagggacaagtctagtttccaacgcatcaaatcccacctcaatatctttatccaataagaagttatagcatttttactgaaggctgcgcaggagctgaagggctatgcgcgaacccgagaaaaacactttgccttctcatttatgttagccttgacaaccacgacgtgggttcttatgttcacacct

SEQ ID NO: 4552 - DNA, 832 bp, Oryza sativa
  unsure (1)..(832): unsure at all n locations
agcaatatttaaggacctgcactagagttaagcaaatctctcagggcaaatgtgtgtttttttgcatcaacacgcttttggcatgccaggtgggaccatttcttgaagaatttgctagatggtggacacaaagacatctgatgttagtccagacaatgtcattccaataacaatggacaaattaccaccagagcaaaaggcagaatatgaagatctgatgaataagctctaaaatcaatacttgcattcccttgttcagaccagatcaggaacagtaattcagaggtataaagtaaatcttctaagcaatgaagacctagagtcaagttctgggaaggacaaggaagtcaagcaggaagaaactcctgaagaattcaagagtttacaagacaggattgattatgctgtacacaatgctttgatcaatcaatcaggagtgcttgtcaatactttgactaatatgaccaagtctgtagttgatggtactattgctgaacatcatgccaaggggccaatattcttgccagagggagtttttccacaatacaggccattgataaccaatcagcaacaacccgtgccaggactagtgccagaacagccgatatcagcaacatcagctatgattaagcaggaggtgtcagcatcggcacagaatcaacctggattcaatcctcaagttctgatgagacaacaacctcaacacatagggcagaacattcctagagtttctcctaaacaagttgcagctatgtttggccctaatcagtcagttgttcagccgatcttgcagnnnnnnnnnnnnnnnnnnnnnnnnnnnnnnnnnnnnnnn

SEQ ID NO: 4553 - DNA, 959 bp, Oryza sativa
  unsure (1)..(959): unsure at all n locations
nnnnnnnnnnnnnnnnnnnnnnnnnnnnnnnnnnnnnnnnnnnnnnnnnnnnnnnataaacggcgcagacgactccatcccacaagcagcttgaccagggctacgcctaatcctctacaccatcaacatcactgtagcactcctcctctgatgaatgattgcaaggtgagtataggatatactcaacaagccacgcagcaaatatgcaaatgcaagatataacaaaggatggcataatatagtctcatttgcataaacggcatttaataaatatttcagaatttaataaaacagtaaggtattaattaaacaatattaatccaacactatacaacatacccgttgcataggtccaaccattctgaacaaccattcccgactgcacagttctatctccaaaccaggaatgtaacattccaaaccaggagctacacaaattattaccaattacagcatcatttattatggtgagaggtgtgaaactaatcacgaaagacattgttagacccacccataactgcgggcacgactattcgaatagttttactctagccagaggtgtaccactgtacccacaagacacaacctcaacatcatgtcaaccatgcgtcgcgatacttaacaagtacccgaatagagattgtgacaataccctctgcataacacaattcaaagcagtgcaccattcccggatcataatcacccccttgtaaacaaggcatggactccccagcgacccccgtgggcttatctccgccacttcacagtctggtgctctataatgaaccatactatacagaaagtaaagccgttgcccacgctggcttgtggttggcacggttaatgtttcacaaccgaaaaccgtgaaccagtccttaattgtcatgagcaaaannnnnnnnnnnnnnnnnnnnnnnnnnnnnnnnnnnnnnnnnnnnnnnnnnnnnnnnnnnnnnnnn

SEQ ID NO: 4554 - DNA, 638 bp, Oryza sativa
  unsure (1)..(638): unsure at all n locations
ttacaaaaaaaaaaaaaatgcatcggtagcttttgctgttcaaagcgaaatcgacaataacaaacaagatgagatacagcaggcacctagattgttataaatcttacagctcatttatttctcggaggcaatacagatcgatcaaagcagctacccaactatatccacagattcaactccttatgcctcttcatttgctgcatcaatcacaagaacaagatggaaccagctcaaagatcaattaggcgcacaaactcaaactggactagcatgtcatgtatgctcacccactcaggcaatggagtttcacttagaagatcaagatataagctaaggtcgttcgaattgtctattgaatgatgtttttttccaaaccccaaaacaggacgtgcacatatatccatattaatttcatttacccttcaagtgatgtttatttgtacccccaaaagatgatagtggaaactcttggtccttctttttttacattttgtgctttcatgctgggctgtataagcaaccaaagtatcttctgattcttgccatgttgaaaaaangttacnaaanttccaannacaaacccaaaattttcagggtgcttcaaatgtgtgtactaatggtaagttattgtactttca

SEQ ID NO: 4555 - DNA, 510 bp, Oryza sativa
gcactggatctgctactgttgagccagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaat

SEQ ID NO: 4556 - DNA, 1934 bp, Oryza sativa
  unsure (1)..(1934): unsure at all n locations
aaggactcaagtactaacccgagtaaggaagtgacgcaccgtcagtatagttttggatttgcaactgccgctgcagttaggccaggggcttcaaatttatgatttgacccagtcctgtgtaactttaccatactatgattttatattaattgcggcgtgatatggtttctatggatggatcaggctccctttggctgtgtttggctgtgtggtgtggcgcattttccatccacatctgagaggctccctttggccgtgttacatcaaaattgaaagtttggttgaaattagaacgatgtgatggaaaagttaaaagtttatgtatgtaggaaagttttgatgtgatggaaaaattggaagtttgaagaattattttggaactaaacacggtgtttatcggttttggaggttgaccgttgggtccatcgacagtttgggacgaagacttcagctaccctactccacatgtcagttgataggtgaatccgtcacatccgacttgctagcttagtggaacatcgacaagacctatcttataagttggcccccacctttgtatgtatgcatgggtactatggacgtactcctattagcatatcttatatcctataacctatatatcgggaaaatatgtatatatctatacgagtgatccatctaaacttttcgtaccgcccggtacctactatctagaccatccatcacgctaaatccaacgggtgacaatgctcagtactgccaggtaccaaaatcccctcaatggtacctccccttcgtatgcacgcgttaaacaagtggaagggcaaaattgggttttcgcatggtctattctccctgagtccaagccgctcctccctgacgcctatgcctgcgagccgtttctcccgatcccctccccttgaggcgcctcctctgcatctgtcctccatgcgcggccaagctcgccggccatccgagctagctggacacctccgccaccatccctgccccatcctaactcaactcccctgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcgggggaccacttgagtggtaaaatggctgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacaaaggtatcagagcaaggttcaatccttggctctggaatccatcgggtgagggttggtggaaggcggcggcgagatccattgtaaaatccctaagccttggtggattttatccggtagcggaaggaaaacacagattactggagcgagggtttgtgaaccacctttcggtgtgttcctgtaaaatctccggagctcgtgatctgggttaggcggcggtagacagttctacttaggcacaaaggggagggagtcagatcctaaaccgacctaagcagtggtgtgaatggtgactactaggtacggaggagctcaacgaattccgggttgatatggcggcactgaagaaggaggtggccgatctcaaaggtctgaagggggaagtaaaagagattaaaggattnnnnnnnnnnnnnnnnnnnnnnnnnnnnnnnnnnnnnnnnnnnnnnnnnnnnnnn

SEQ ID NO: 4557 - DNA, 1103 bp, Oryza sativa
  unsure (1)..(1103): unsure at all n locations
gttcctgtaaaatctccggagctcgtgatctgggttagccgtcggtaaacagttctacttaggcacaaaagggaggtagtcagatcttaaaccgacataagcagtggtgtgaatggtgactactaggtacgtaggagctcaacgaattccgggttgatatggcggcactgaaaaagcaggtggccgatctcaaaggtctgaagggggaagtaaaagagattaaaggattgttactggaattgtgcaagagaaaagaggctgaataagaagaagaagcggctgctactgcaaaggcaagcaaggcagtagcttcgcaaggaggagtagacgcggctgggacaagttctcaggcgcaaggtaacccacctgtgactgaatcccaattccatattgaagctaatactgtgaacccctcgatgcctatgaatatgcattcagttgcacctacgatgcctatgatgacagtacaagggcatcccacacagccagggcatgagaatcagtttgctgctaatcgaaccaatgagatgtttacctcctctatagtaactgctactcgaccacagctcgcatttgaaatacccgggggcacattccagcttttcagcctaatgggaatagggttggtggacatgcagactttgtccaaaatcgtgcaggagtgaggatgttggaccaacagaggaacatttatctgggtcaggcaggagaagggaatcagtacgctgaggctgtcctcaaggggccaagattagaaatccctctgttcagtggagaagatccaatagattggcttaagcagtgtgagaagttttttgagattacgggtacccctctggatcaatgggtgaatttagcggtggctcatttgaatggcagggcattgaaatggttcggaggaattggtctgccatggcaagtgatagcttggccacaatggtgcagcatggtctgtactcgattttctgctgcgagtgaacatgaggcaattgagttgttccaaaatgtgaaacaatttggaacaacagtggagcaatatattgacaannnnnnnnnnnnnnnnnnnnnnnnnnnnnnnnnnnnnnnnnnnnnnnnnnnnnnnt

SEQ ID NO: 4558 - DNA, 892 bp, Oryza sativa
atatctttccggactcggcatttccttttctcattttgattcctctgtcctggcactggagttaggctgaaactgtaatcttggcgaggatttgtgttgccttgatgcttctttccgttgaaactggcgggttggttggccatcttcttcgtcagcagaaaactgaattgaaaatcttttggtacatgatcagttccttcacaaaagaaacaattgatcctgctcgttggacaccggtcgggtggatggtcttcctcacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcaatcactcgggagcttgaggtaccaatgtcctgacttctgaccttattgcctttctcattgtcag

SEQ ID NO: 4559 - DNA, 1811 bp, Oryza sativa
agatgggaagcatccatattgttcttctgccatatcaccttcgacccttgttttaataccagatagcttaattccaacccatcgactattatgttttcaaatattaatgtctcctagatcttcttatctgtttgcaggtgtatccgaacttatcaatgtagatgcatggcgggtacctttatgggtttcatccaacaatccttatcttgatctgtaaaaggggtatccaaactcctatccccaactactatctcgttggctttttaacccaacacagtttaattggttttcttttccatcaacaggttggttattaactcgaggttagaatatagttcctctgacatgagaccctaggtctcctatgtcagtaaacaattatacacatgatcacatatccgcatctttcaaaagaatcctcatggaacttgtctgtattacacatttctcccttattacacgaatacgaggcactgccgtaaacaaaaagggaaggtgcttatcatcggtacattgtatcctcaacatgaatcatccataaacatagtaagctcactgtttacagacatgaatatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattt

SEQ ID NO: 4560 - DNA, 463 bp, Oryza sativa
aattgtcaaggaatgggccatttcgccgacaagtgcccaaaaccgagaaacatagttgccagcacgtcagtccacgcaactccctgcaatcagaagcttgctcctcagcgaattgtcatccatgcatcccgaagcagtcttatagcccgcgttgcaacagctccaactccagcgagtgcattaccacaaggtgtcaatgctcaatttcagccccagccatcagttgacaagacagaggccagtatcggcattgtacctttggatgttccagcacagcagccaagaaatcaagttcaagatgaagaacccgagcgtaagaaagttattggctgttacaactgtagtacctgttaaggaagcagacatgccaatcggcaagtggtcactggagcaaatgcagtacctgttaagcctagcgctagtcagaagcaaccataatactcttatatcagtggtcaaatac

SEQ ID NO: 4561 - DNA, 464 bp, Oryza sativa
taatttaattggaaaagtaattaaaatgctttccttagctttgggcttaatctggcccacctctctctctcttagcccgatccagcgcctcccctcttgtctgcgcaagtctgtttgatctccctctctctcagtcggcccaagcaaggaaaaaggaagcccggcgtgaagtctgttttgcctccctctgctacagtgtcgtccctaacctccagccggctggagacagagcccgagccgggtgcgccgcgccgctttgccgctcaaatccgcacccaatccggccccgtttcttccggatttttaaggggttttgatcctctcgttctcctctatctttcccctcaagaatcggagcaaatggttgagtatcttgcccgaatcaaactcgttttcgagtttatctccaaaaccgagtttttgtttttccggatcgatttcttgcgggaggagtccgatctctt

SEQ ID NO: 4562 - DNA, 477 bp, Oryza sativa
tgccttgcttcaactctcggaattcccttttctttagggccatgactccggcgggcacatgggttctccgaaaagcggcggtgaagcgagcgcaagtaataggctgtccctctggctgcgtagcctggaaatggtcccaccatagagatgcgggcccctgcagctggtgggcggcgaagatgactttctcctcatcgttgcactgcacagtgtctagctttttccccacggcatgcagccaatccaacgcatccacggggttgttggagctagagaaggtaggtggacggatgcggaggaactcggcgagtttagagtgttgtgggggtggtggtggagcattatgttgtggcgggttttgaaggtggtgtaggaaagcagtcatcatgttggcctgctgggcgaggatttgggtgagaatggcgttggtatctggtggtggtggtggtggcgtagaagaaggtgaaggtggactgc

SEQ ID NO: 4563 - DNA, 1233 bp, Oryza sativa
ggtcttcctctgattgtgagtatatcagaatgtcatcaatgaaaaccacaacaaacttatccaagtattccattaaccctttgttcattaagttcataaaaaaggcagggtgctttggttagaccgaacgacatcaccgtgaattcatacagcccgtatcgcgtggtgaacgcggtcttagggatatcttcctcacggatacgtaattgggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtttttcttctccacaaaaatcacaggagcaccccaaggggaagtactcggacgtatataccctttttcttttaactcttccaactgtttcttgacttcggccagctcatttgctgccatacggtagggtcgcttgtgcagaggagtggttcctggagcaagatctatccggaactcaatctctcgcttgggcaagccgagcaatgtacccaagttagtgttttaatccttaaaacctgcttaacaactaaaatgtggaatggttggcctgggttggcttgggacgagctgggacccagggtcgggttgccagttcggtccgaatcatcataggccttgggttaaggcaggttcgtgtgggttcacgggcttgattaataacattgtatagttctaggatcgcgtttacaaaatagctttgagcaactaaacgtctttaaatgctgtttactgcaaccctaacccttattataactcccttgtactcccttgcatttatcctgcatttgtgggtgtgtcttgttgagtacggtggttgtactcagtcttgctcaattttttttcccaagcccagaagaggagctccttgaagatgaaggttttggtgtctagctcgtgcctgccgtcaagcgcctgtggtcgtcgccctagtcttccgctgtttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgacaagttggtatcagagccacccttgaccctaggacgagccg

SEQ ID NO: 4564 - DNA, 5482 bp, Oryza sativa
ccaagcccagaagaggagctccttgaagatgaaggttttggtgtctagctcgtgcctgccgtcaagcgcctgtggtcgtcgccctagtcttccgctggttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgacacaacgtcaccttcagccatatgagtgaggtgattgacggctacgacaagctgctcgccatgctccacaaggcgaccaagaggctcaacgatcagaagcttgtgaggatcgctgagttgcaggataagaacgctcgccccaagaaggaggttgccaggcttcagggacgtccaccgcctggaggagcccgcatccgcaccatgtcgaggaagtcgaccatagctctactgcgcatccagcttacacccaggaacccgccgctgcctccacctccagcacctcccgtagctccagctccagcccttgttccaatgccagctctagagtccgccctctcctttgtgccaaattcagcctacaagggtccagcaggtggcagtggaggatggttgccagcatctcccagtggtggtcgtgtgatcatcagcagttccagctcagaggcaggcagcggtgacacctatgagcaggagtactccaggagccgctcagagggatcggacgacgagcaggaggacgccttcgactccacctaccgcaggagccgttccgagcattaggctcgctttccctagtttatcgactgcttagtagttgtttgttagtttgtgtgtttagggttgttcgcttgtgggttagtcgatggtcgatatcatgtacctatgatatggctgtcctaataaggatttgcttgctgttttaagtgttttaattcatatcagaacaattgcagtctaaattcctatataataaagcttagttcctaagcatctgtttttcttcttttctatcccctccgtctgttcttccttcagatggtcaacaccaggaatggcggtcgtgcagctggtaacagaagcaacagcgaagaacgcatcgatggtgggcaccccaatagcgcctgcggcaatggtccgccaccgctccccgagaacccgatgctcgcacaagtgatggcccatcagacccagatgatgatggccatgatgcacagatgcagcagcagcccctccagatgcaccagaggatgcagcagcaggccgatcagcagcaacaacagtttggtccccctcccccttagtccaagctgcttgaatttatgcgcgtcaggccacccaccttctctagtactaccaaccccatggaggcaaatgactagctccatgccatagaaaagaagctcaaccttctacagtgcaatgatcaggagaaggttgccttcgccacacaccagctctagggtcctgctcagcttggtgggacaaccacatggctacccgtccgccaggcacagatgtcacttgggcggagttctatcgcagcttcaagaaggcgcaggtgccagacgggctcgtggcacagaagaagagagaattccgggcactcaaccagggcagcaagacagtgacttagtacctgcacgagttcaaccgcctagcgtgatacgcaccggaagatgtccgcactgacgcagagaaacaagagaagttcctggtaggcttggatgacgagctcaccaaccagctgatctccagggattacgcggactttgagaagctggtagacaaggcaatccgacaggaggatcagcgcaacaagatggatagaaagaggaaggccgctcagttcagggcccatcagggaggtcaccagaggccacgcttcactcccggacagcagggtggacctaccaccatgattgtccgacagcaccaccccaacccttccggcaacttccaccagggtgctagtggcagccaaaaccatcagggaggtcagcccaaccatagtgcagctccacgcccgccaatggcaccagcacagccagctccatcagctcaagccaagaaggagaccagagcaaagccagggccctgctacaactgtggcaagcacggccactttgctgacaagtgcccaaagccaaggcgtgccgggccaaggttttttcaagcccggcgtcaaccatgcgtccgcagaggaggcacaagcagcaccagaggtcgtactgggtacgtttcctgttaactcaatccctgctacagtaattttcgattctggtgcaacacattcgttcatttccaagaagtttgtggggacacatgggttgagaaaagaagagcttagcacacccatgagggttcataccccaggaaatagctcgacttctgtcagttatagccctttagtgctaatagaaatccaaagatcacaatttcttgccaacctcatccttcttgaatccaaagacctagatgtcattcttgggatggactgacttaccaagttcaagggtgtcattgattgtgcaaatcgtacgatcaccttgatcaatgagaagggagaaacagtggtgtacaagtctctcgcctcaccaaagcaaggagcctcactgaatcagattgaggtggaaaattcagtgaacgcaaaggagaagagttcgaggaaattggaagatattcctattgtctgcgagtatccagaagtgttccccgaggacctcactaccatgccacccaagagagagattgagttccggattgatttggcaccggtaaccgctccaatctacaagagaccgtatagaatggcggccaacgagctagcagaggtcaagaagtaggtagacgaacagctgcagaaaggatacatccgaccgagtacttcaccttggggtgctccggttatttattttgagaagaaggacaagacgaagaaaatgtgcgtcgcttatcgcgcactcaatgagttcacaatcaagaacaagtatcccttgctgagtattgatgatctgtttgatcaattgaaaggagctaaagtgttttccaagatagacctgcgatcaggccatcaccagttgagaattcgggaagaggatatttccaagacagccttcactactcggtatgggttgtttgagtgcactattgtcctttggactcaccaatgcaccggccttcttcatgaacctgatgaacaaagtgttcatggaatttttggacaagtttgttgtggtattcattgatgacatccttgtttattccaagtccgaagaagatcatgaacaacatcttcgtctggtactcgagaagttgcaagagcaccagctttatgccaagttcagcaagtgtgacttctggttgtcggaagtcaaattccttggtcacgtcattactgttcaaggtgtggcagtggacccgtcgaatgtggagttggttacaaagtggaccccacctaagacagtgacccagattcggagtttccatggacttgctggttattaccgtcagttcattgaaaatttctccaggattgccaggcctatgactcagttgcttaagaaagacgagaaattcaagtggacagctgtaacaccctgaaaattcgacaaataaaatgaaacccgaaattgagtactttcaaaaacttctaaataagtttgcatcatgccgatgttatttcttttgttgtgcatcatgatggatgttatggtcgttattgcttgccaaaccataaaacgtcacaattgaaaattaagctaaagctatacaactacataacaattataaaaataagatatttattatgaaccctgtaaatatttatgcacaacacaataaagccatacaaagagaaggttaattagtaatttaatttataggtcacattagaatattccaattaattttagaaatattaaagccaccgagttatataggatgaatttaggatgatataaagtaaagccaatttcatttgggaaatgatgaataatcaaataaacaaatatttaaataaaatatttgaattccccaaaccaaaaagtataggttacatctcaattcaaattccaatcccattcacttttgcagtttagcccctccctattctcgtttttcctgtttttccttctctctcttccactcggttactgttcatgggccaccaaccgttcgatctgggattagcccagaccgaactcttcccaacccagcgccgctcctcccggtcgctactaagccgcgcacgcaccttcccaacctgtgcgaagcattttgtgtgaccgtgcgccgcactgcgtcgcgccacgcccgcgtggtcccaccgcccgaccgagccaccgggttcccgcgaaagctgcgctgccttgagcaatggcatcatctcatcccatcgcgagtcgcatcgaagttgagggataatggccgccacgtcgcccggcgtcactgtagaaaataggcctgcacctccctatcggcggccgttaccactgcccgtcgccgccaatcatgttgccatcgcatcgccatctcgtcgcccctagctgagaccgctggataaagcggtgcccctttctccagctagcgatccctctcctgcgatactaccgcgtaggcaatcatgtcgcgcctgtacattgaactggaacctaggtgagatcgaacctaggccgagtcatcgattatgcttatccataagggatcgccttcctctcactggtataagctcacccctagctcgtcctcatccaaaatcaacccctcatttgcttcccttctccccaaagctcttgctccatctcagagaaacgaaatcatgctgccgccgggtgtcgaacacttggtgggcgagggctgccccgccgccacaaggcctctcagcctgagttggtgcggggtgtgaaggtaaggtgcttgcgcttctgatgccgccgtgaaggagccaggagccgctggacgaggaggaccgggagtcgagtacctacaagcgtcgtcgatcgccgtcgtcgatcgtcgtcggtgaggcctcccctcctccctttttctctctctcccgtgccgctaagccgttgcctagccgcctagccgcgccgccgccgcgtcgccgccatcggccgctcgccgttggtcgcgcctccggtcatcgcccctagcgccgagccgccgtgcgccatggctgccgggccggcttaagctgcccgcgcgtgtgcccttgctgtgcgccgcatctgccgtccgagggtagatcggggccgtccatcgccgccggcatggcagcccacgtgtccgccacgtcggcgccacgtggtgctcccttcccctctcctgtggactcggtccaatgtgggccgccttgtcgcgaccggaaaaattgccttttcccgaacgctagtgtattaatccccgtcccaggaaaagccggggtacacc

SEQ ID NO: 4565 - DNA, 1713 bp, Oryza sativa
gattgagcccctagcaataggatctagaccgggtgtgccacacgcataggggtgagaccacccgtgtactagtctagtgccatggcatctcgactaacgggcaccgacccgtgtagccttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgaaaaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagaattcccaaagtctaaagttataaaaccatctagtgttgcctaattaatcagtgaagcatctacctaaattcatactagtggaaccattattagagtacccactagttggggttttgttttgctagggtaagcaaggtgataaaaacaataacaatgataaggctataacaaggattaataggaagtgctaaataaaacagtgataacgcgggaatttaaataaagcggtaatgcaataatttaaatcaaaataattttataaactgggattcaatatgctcaagggtgatgtgacttgccttgctcagagagaacggccttctgaaccttcggcgacgaccgcgaaccacgcttcgagaaccttcggaacgacagaagctacgcgaagcacacaagcaaagctacaagcctataaagaagcaataacaatacataaaaagaaagcacacggttctttaggttacaacaaacattaggagacttgaacgggtcgattcggggttcgtatgaccaacatatgatcatccgaagtttaatgctgttacatggagatttacggattattgtgattaggttttgcaattataaaacatgtataagtgctagcctggaaaagactggaagactacgctgttgacatgtggaccccacatgtcaacctaagggaccacagtagaccgagtacacagagacgttccacgggtcgaaggaagcggatcccgtgtgtcaaccgaggcaagcggtcgacaaatggactccactagacaccacacgggctgcacacgtggaaaccacgcggctaccgagcgggcacactaacacggacactacacgcacaagcgaacgactaccgacaccagtacacgggtaccggggtcgacaaccgcacaacgggcacgggcgacaccgaaaggactaggatggggcagcgagaggacggacccttaccaccacgtgacgaggcgtgggaacgacaaagacaaacgagcgcggcggagacggctcggagacgacggaggcgaacggcgagggagcgacttcggcggcgatccttggacgaaggcgagacgcggccggcgcaacgcttggcgacacggaggcgaggacgaagatgacggggctggagcggctcgcttgatgaaccacgggcggcgaacgcgatcggctttacggagggacgaacgccacgacgacccggaacgacgggaggacgacgacgacgacgaccgggaacgacgggaggacgac

SEQ ID NO: 4566 - DNA, 2973 bp, Oryza sativa
  unsure (1)..(2973): unsure at all n locations
nnnnnnnnnnnnnnnnnnnnnnnnnnnnnnnnnnnnnnnnnnnnnnnnnnnnnnnnaggacggacccttaccaccacgtgacgaggcgtgggaaccacaaaaacaaacgagcgcggcggaaaccgctcggagacgaccgaggcgaacggcgagggagcgacttctgcggcgatccttggaccaaggcgagacgcggccggcgcaacgcttggcgacaccgaggcgaggacgaagatgacggggctgcagcggctcgcttgatgaaccacgggcggcgaacgcgatcggctttacggagggacgaacgccacgacgaccgggaacgacgggaggacgacgacgacgacgaccgggaacgacgggaggacgacgatgacgatgaccggggccggcgaggaggcgacgtgggcagccggcagcggctgcacggagacgaggacggcgtggaacacgctgctgcgatgccgacgatggaggcggcgccgcgagacgatgagccggcgaggatgaacggtgaagacgacgacgaacaccggcggtgttcgggtggaggggaggcgaggccgagggcgaccttgccgctgtgatgccggaggtggagatggcgacgtcggccagcgcacgggcacggcggaaggggctgccgaaggcgacgtcgacgaggagaaaggagaggccggcgcggcggcggtggtgttccgccgaaaccgaggagcagccggaggagaggacgacgctgcgacggcgacggaggagacggcgacgtcggtcggcgtaccggcgacgaacagcagccgaccgaagatggtgtagtggtggcgacgccactggacgccggcgggggcgcgtctccggcaatttccacacgaatcgaaggcggcgccggggaagagaggcggctgcgatgccggggaaggcgacggcacggcgcacgcacgtgcgcggcacgggcgggagggcgccgctcggcttgggcccggaggcggcccaggaggagatgagggagaggcaggcccgggagagagaggggagggaagggagctgggccgggagggggagggaagaggtgggccgggaggaggagggaagaggtgggccgggaggaggaggagaggcccgggagaggagggaaagagagggaggagagggagactttgggctgggcttggcccaaaggaggaaggaggattattcccaagtttttctttttaataaactttaatcatagttgttgttgcttaataaatatttccggtgctctgaaaattcaagtaaaatttaagggctccttttagaccaaggagaatttaccaaaaattctccgtgccacattcgaaattttcttgtacgtattttagtgtttgccaatttcttttcgaattttaattaattctattattccttttagaaaatgatttttatttcgggatgaatttatcaggacgtgacagcaatgccactggacgctggcggggatgcgtttccggtggtccccgcgcgaaacggaggacacgccggggaagaaaaggtagctgcgaggctgaagacggcgacggcacggccggccggcgcacggctgaggcagctggaggtggctggtggcacgggagagagaggaggacggcagggaggcatgatgcggccacgggggagctcgggaaagaggctaaaacgagagaacggaaggagggggttccattttataggcgcggggagggatccggcggccatggaaggtggccgaaaaaaggcgtgggcgttccgagtgatggagggcgccattcaagggggaattaggggggaaataaagaggaaggaaaggggattaattcccccaatcaatttcggaatccaagtttgaatcgcgcggatttgagagaggaagaagctagggtttcacgggagagagaggagaggaggccgccggctggagatcggggacgcgcctgacaggcgggacccacgtgggaggcacgcggtcaacgcacggcaatggtgcgcacgcgcgcgcacgtgcgtggcacgggtgactctaggctaaaacctgtagttttgaagcaagggatgagcgcgaaagcgggaggcgcggctcagcttgggccgggtgaagccaaggcgtcccaggaggagaagaggagggagctgggccgaggggaggggaggcccgggagaagagggaaaagggagggaggggagagggacttcggccgcaggccgagggggaggaggggaactttgggctagactgggccgaaaggaggaaggaggattgtgtttagttgttattgcttaataaattattccgttgctctgaaaatttaagtaaaatttgagggctccttttaggacaaagagaatttaacaaaaattatccgggctacattggaatttttctcgtacgtattttagtgtttgccatttttttcgaattttaattaattctattattccttttagagaatgatttttaattcaggatgaatttatcaggacgtgacattcaatcacctccctgggaactcccggcatgtatgacggttgccaagcgaacacgtctgcattgtcgcggagaaaggtgatgagcgcgggttcctatttgtcatccagtgtagcccctatcctgaccatcttgtcggagttggaacttgacaacaggattatcttgatggtaccgtctggctttgctttcttgctgggcttgctcactttcttggggtgctcagttgtggcgggtgggttagagtatgctcgaccatgtcgaggctccgcttgtcacattgtactgccaacttagcattgccctggatagtgattgtcccttttggtactggcattttgaatacctgataagcgtagtgagatgctgccataaacttcacgagtgcagttctcccaatgatgtcattgtatgcggtgtcaaactccacgacatcaaaggtgatttgctctgttcggaagttattggcctgccga

SEQ ID NO: 4567 - DNA, 2945 bp, Oryza sativa
cttttccgttggtcgtgtagacgctgcagcttcggaagatccgctcttcgtggaagttgaagccgacgcttgggaaagcgagcaaggcaagacacatcatcttgatcatattgaatcctagtttataaaattatgttgatttaaattattgcattatcgctttatttaaattcccgcgttatcactgttttatttagccatgcctatttatctttgttatgaccatatcattattgttattgttatgattattaccttgttcaccctagacaaacaaaacctcaactagtggacactctactcatgacaccactagtttaattttaggtagatgcttcgcaatttaattaagtaacattaggtggttttacaactttagactttggggatactcatatcacctggacactttggaattgttggtttattgtggaattggcttcacaccgctccttctattcaaaattccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttcgatgctgtttactgcaaaacttaacccctatattattatccccttgtactcccttgcattaattatgcatctccggtgtggcttgctgagtactgtggttgtactcattcttgctcaatctttccccccttcagtaagagaagctttggagatgatgtcttgggtggagtcctggcttataccccagttgagcgcctgtgaagatggagccgtaggcccgctagtccgctgctgtttatttttgattgtcaggccttaagcgcctttgtaataatgtaaatattatcgatataataaagatgtgtcttttatatcatgtttgtttggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctttttgcaaaaggtttactcccttcttccttcttcggatttcaactagtactagatggtcaggtcagtgaagaagaagacatcgtcagttgtttgccgaagctccggaagactgcaggatctgcgagcgaagtggaggaagcagtgaagccagctgtgaagcaggagtgaagatcttgagaacccgtcgcagaacctaagccaccctctagggtagagtcattagtcgtgtgtttccttgcttgtgtgtgtagcgcgtggtttgcatcagtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggcctccaccaggaatgacaagacgtcagagaagaaacaccttccgaggtgcaccacagttgacagagcatcttttagctaatggaggtagagtgtctgatagtgaagattcagatcaagtctcctcagaagatgaagatgagaaatctccccaaggtttcaaccaggataaaatggaacgtaaggcatgctctcgttgtggagaaatcggacatgttgccagctcgtgtgcctctacatgcgttcattgtgaggaagaccatccacccgacaggtgtccaacgagcaggatcacttgtttattttgtgaaggaactgatcatgtaccaaaagatgtcaattc

SEQ ID NO: 4568 - DNA, 2393 bp, Oryza sativa
agaaaagaaaatgccgagtccggaaagatatctgttgcttcaattgtcaaggaatgggtcatttcgccgacaagtgcccaaaaccgagaaacatagctgccagcacgtcagtccacgcaactccctgcaatcagaagcttgctcctcagcgaactgtcatccacacatcccgaagcagtcctatagcccgcgttgcaacagctccaactccagcgagtgcattaccgcaaggtgtcaatgctcaatttcagccccagccatcagttgacaagacagaggccagtatcggcattgtacctttggatgttccagcacagcagccaagaaatcaagtacaagatgaagaacccgagcgtaagaaagctattgtctgttacaattgcagtacctgttaagcctagcgctagtcagaagcaaccataatactcttatatccgtgttcaaatacttttgttttatagttgttccccgtcaatcatgtaataatagagaaacatgagataaggaatgagtttggccagtttatgaagggtccatattaagattgcaagtgttgtgtgatgtgtacatctggttgatgattaaggagacctagggcctcatttccgtaagctcataatctattatgaatcaaataacctagcgattgatggcgaagaaaatcaagtaatcaaccaaagagacatttgtttggactgagagtttcagatgtgccttcttcggatcaaaggcatgcacccgttgtggagaaactggacacgttgctagcatgtgtctcacactctgcactcactatgaagaagaccattcaccaggggagtgtcccactcgcaaggtgacatgttttctgtgcgaaggtacaaaccatgtgcccaaggattgccaactcagtgtgttgttgaccaagaccgcagaaatccaacgaacaaccctacaattgtctcatcagctagtcagctccaacagcaacctcgacgatatcatccacagcaccaatgctcctcctgctccacctaactctgcaataaatcatggcaataatatcttcagcaccaaccattctctgcaccgacagcctcagcaaagaattgtcgtcgatggaagaagttgtgtctctccccgacctactccaggccgagcaaagggcaatcaacctcaggagggcgataccaagcagaagaccgttattcgcttcaaccagcaatcagaaggaagcttctcctgtgaatgatagcaatatgcagtcctatcacatcatcacagaaccaatcaaggatgatgcagtcactagaacaatgccagctatacctcttcagaatcagaatgagtagccatgtttgtgattttcagttcgctacttatcaccgtaatcgaaagtttgcagcaatcctgtaataaataaatatattcatgtctataaacagtgagcttgctatgcttatggatgattcatgttgaggatgcaatgtaccgatgttaagcaccttccctttttgattaaggcagtgcctcgtattcttgtaatatgggagaaatgtgtaataaaaacaagttctatgaggactctttcagaagatgctgatatgggattaggtgtataattgtttactgtcaaaggagacctagggtctcatttcagaggaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcatctacattgataagttcggatacacctgcaaacagttaagaagatctaggagacatcaatatttgggaacataatagtcgatggttggtaattagtctatccggtatcagaaaagggtcgaaggtgatatggcagaagaacaatatggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaagggcctcatcgtccccagaagcgtccgcaatccccattaaagaataccacctgttagagataagccgaaaggtgatcgataaaagagattggcaaagatgttctccagcatgaaagaagtaggccgaaaggtgatgtataaacagaaacatgctctgcatcgctcaaggaagacccctgatagtaatcgccccgcaacagtcaccttgtcattaagtaagcaagatgacctaggtaaaagtgtttctatgaaggcaaggagtgaaatcttcaa

SEQ ID NO: 4569 - DNA, 1924 bp, Oryza sativa
ggatttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacatcggttatctgcataacttttctgccgggactgtgccacctttagattatcccgaatggttctgactttagcttcagcttctctcaggatgtcagtcccgaacacttggctttccccaacttggtcccacaaaagcggtgtccggcatttgcgcccatacaacgcttcataaggtgccatttgtatgctggcttgatagctgttattgtaggagaactcagcataggggagactcttatcccaggtcttcccgaaatctaggacacatgcgcgaagcatatcttccaggatctgatttagacgctcggtctgtccatctgtctgcgggtgatacgcggtgctgaagtttaatcgggtacccagctcttcttggagcttcttccaaaagtgagagggtgaattggcttcccctatcagatacgattttcttgggaacgccatggagactcacgatcctagcgaagtagagctcggctagttcgttccctccataggtggtctttacgggaatgaaccgtgctaccttgggtagtcgatccactactacccatatagaatcatatacgccttgggtttttggaagtccggtgatgaaatccatcccaatttcatcccatttccattctggtacttggagtggttggagaagtccggccggtatttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcaactgtttaagttctctattatctggaacgcatacccgatttccgttccatagggttccgtgttcatcctctgtgaaaccaacagctttaccctgtttcatattcttgaggagtccatgcatatccggatcattcttctgagcctcgcgaatttgatcgagcaaggtgggcttggcttccaacgcagccaaaaatccgcgactaactatgcttaggttcagggcttccatctgttgattaagttcgggtggaatgcctcggacgttaagagtgttgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattaccaatgagatagtgccgccagatttttagagcatgaaccaccgctgctaactccaagtcatgggtagggtagttgccttcatgaggacgtagctgacgtgaggcataggctaccacatgaccatcctgcatgagcacgcaccccaatccttggcacgaagcgtcacaatacaccatgaaatccttgcgagtatctggcaagactaacactagcgaggaaaccagcttttctttgagagtttgaaacgccttctcgcattgcgggctccacacaaatttctcttctttctttaacaactgtgtcatgggttgagcgattttggagaagttctcgatgaatcttcggtagtatcccggcaaacctaagaaactgcggacttgaatgactgtcttgggttgcttcc

SEQ ID NO: 4570 - DNA, 2122 bp, Oryza sativa
tttcgtgagctttcttaaagtatcagctgtttaagttctctgtatcgggaaacgcaaaccgtatttccgttccatagagttccgtgttcatcctctgtgaaaccagcggctttaccctgtttcatattcttgaggagtccatgcatgtccggatcattcttctgagcctcacggatttggtcgagcaaggtaggcttggcttctaacgcagccaagaatccccgaccaactatgcttaggttcagggcttccatctgttgattaagttcgggtggaatgccacggacgttaagagtattgcaatagctcttccgacttagagcgtcggcaaccacgttggccttaccgggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaagtcatgtgtagggtagttgccttcatgaggtcgtagttggcgtgaggcataggctaccacatgaccgtcctgcatgagcacgcaccccaatccttggcgcgaagcatcacaatacaccatgaaatccttgcgagtatccggcaagattaacactggcgaggaaaccagcttttccttgagagtttggaacgccttctcgcattgcgggctccacacgaatttctcctctttcttcaacaactgtgtcatgggtcgagcgattttggagaagttctcgataaatctccggtagtatcccgccaaacctaagaaactgcgaatttgagtgactgtcttgggttgcttccattcagtgacggcggtcactgtttcggggtccacagcaactcctttagcagatatcacgtgccccaagaatttgacttcggacaaccagaaatcacacttgctaagcttggcatacaattgatgttcccgcaactttcccaacaccagacggagatggtgctgatggtcttcttctgattgtgagtatatcagaatgtcatcaatgaaaaccacaacaaacttatccaagtattccatgaacactttgttcattaggttcatgaagaaggcaggagcattggtcagaccgaacgacatcaccgtgaattcatacagcccatatcgcgtggtgaatgcggtcttcggaatatcttcttcacggatacgtaattggtgatatccggaacgaagatcaatcttggagaatacagtggcacctttaagctgatcgaacagatcatcgatccggggaagagggtacttgttcttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttgacttcggccagttcatttgctgccatacggtagggtcgcttgtacagaggggtggttcctggagcaagatctatccggaactcaatctctcgcttgggcggcataccaggtagttcttccggaaacacgtctccgaactctctgactatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtatctagcagaatcagatccgagggaaaaggaatcccctggatttctatagggacggcagggctataatactttgctgtcataacccctccaggggtggtgatgagcagagggtttctaagcctttctacccccaactgatttctccccacgaatggcacggatataaacgagtgggaagctccagaggtcaacaaaatggtagcagggatggaatgaatgaggaacgtaccaacgatgacgtctggagttgtcagcacgtcttgggcagtcacgtggttcacacgacccggaatgacgt

SEQ ID NO: 4571 - DNA, 7904 bp, Oryza sativa
  unsure (1)..(7904): unsure at all n locations
nnnnnnnnnnnnnnnnnnnnnnnnnnnnnnnnnnnnnnnnnnnnnnnnnnnnnnnaggaaaggggggggaaagaagactttttaggatttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaaacctaccccccttaaacggaatctcgaccccgagattcggaggaactggcgaagagatcgggatgggctgccttcagctcgtcttcacgctcccaagtagcttcttcttcggcgtggttgctccactggaccttgcaaaaacggatcactcggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttacccaaggaggcgggcaactccagctggtaggcgacttctccgcgtcgagcaatgatacggaagggacccacataccgaggtgcgagcttcccttttgtctgaaacctgtgtacacctcgcaatggcgtgacccgaagatatacaaaatcacccactgcgaattccaggtcacggcgacggttatctgcataacttttctgccgggactgtgccacctttaaattatcccgaatgattctgactttagcttcagcttctctcaggatgtcagtcccgaacacttggctttctccaacttggtcccacaatagcggtgtccggcatttgcgcccgtacaacgcttcataaggtgccatttgtatgctggcttgatagctgttgttgtaggaaaactcggcataggggaggctcttatcccaggtcttcccgaaatctagtacacatgcgcggagcatatcttctaggatctggtttagacgctcggtctgtccatctgtctgcgggtgatacgcggtgctgaaattcaatcgagtgcccagctcttcttggagcttcttccagaagtgagaggtgaattggcttcccctatcagatacgattttcttgggaatgccatggagactcacgatcctagcgaaatagagttccgctagtttgttccctccataggtggtcttcacaggaataaatcgagctacctttgttagtcgatccacaattacccatatagaatcatatccaccttgggtttttggaagtccagtgatgaaatccatcccaatttcatcccatttccattctggcacttggagaggttggagaagtccggccggtcgctggtgttctgccttgacacgctggcacacatcacatagggccacaaactctgcaatttcccgcttcatgctgacccaccagtatttctccttcaaatctaagtacagctttgtactgcccgggtggattgaataaggactttcgtgagcttcctgaagtatcagctgtttaagttctctgttatcgggaacgcacacccgctttccgttccatagagttccgtgttcatcctctgtgaaaccagcggctttaccctgtttcatattcttgaggagtccatgcatgtccggatcattcttctgagcctcgcggatttggtcgagcaaggtaggcttggcttctaacgcagccaagaatccacgaccaactatgcttaggttcagggcttccatctgttgattaagttcgggtggaatgcctcggacgttaagagtattgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaaatcatgtgtagggtagttgccttcatgaggccgtagctgacgtgaggcataggctaccacatgaccatcctgcatgagcacgcaccccaatccttggcgcgaagcatcacaatacaccatgaaatccttgcgagtatccggcaagattaacactggcgaggaaaccagctttttcttgagagtttggaacgccttctcgcattgcgggctccacacaaatttctcttctttcttcaacaactgtgtcatgggtcgagcgattttggagaagttctcgatgaatctccggtagtatcccgccaaacctaagaaactgcggacttgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggttagaccgaacgacatcaccgtgaattcatacagcccgtatcgcgtggtgaatgcggtcttcggaatatcttcttcacggatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttgaattccgccaggttctgatttgctgccatacggtagggtcgcttgtgcagaggagtggttcctggagcaagatctatccggaactcaatctctcgcttgggcggcataccaggtagttcttccggaaacacgtctccgaactctctgacaatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaagaatcacatccaagttcttggtatctagcagaatcagatccgaggaaaaaggaatcccctgaatttctatagggacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcggggcgcggagcgagattgctgctgctgttgttgctgctgtgaggaggatccccctggatagggattggtgtagcggaccctttggttagcaccctgttgattgcggaagttcgccaagcggcgcttgtgcgactccagttccttgtgcttggcttccaagcggatgctcttgtccaccagacgttggaaatctggatagtccccggagactagacggacggacagctcagggtccatacctgccaagaacttctcttgcttcttctcatcttcccgcacatcctccggggcgtaccgggccaggttgttgaactcatgcaaatactccatcacggagcggttgccttgcttcaactctcggaattcccttttctttagagccatgactccggcgggcacatgggttctccggaaggcggcggtgaagtgggcccaagtaataggctgtccctctggctgcgtagcctggaagtggtcccaccatagagatgcgggcccctgcagctggtgggcggcgaagatgactttctcctcatcgctgcactgcacagtgtctagctttttccccacggcatgcaaccaatccaacgcatccacagggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtggaggtggattgccttgggggttggggttgctgccttcgggttggttgccttcaccggtgctaacatttctcctggtcgtcaccatctgaaaaccccacacagaaccagcagacagggagagctaacgattaaaactaaccacccacgactactataaatcttgaatttattactgacattaaattggttcattaagttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctaccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgttgttctccaccatgccacgacgcaccatctgatggaagtcgatacgagccgcgtcgtatgcctccaccatgcgtgccagatgcacgacggtagcgtcatcctccgagctagcatctcagaaggtggcgtagtcacgggctcctccgcgacgagggtggtagcgatagggcgagtgctgcaactcgtccgggtagcgctggtgaagggtgccgatggcgaggaaagcggcgttctggcaagcggcgggaaaggaatctccacccgcggtgactgccagcgaagtccgctcgggagagccggagaggatcactgcggtgacctcccaaccagcgtggggctctgcatcctcaccctcctgctccgggagcggcctggcctggtagtccactccatgtggatatcccaagaccacgcacatgccccgcagctccaaaacgaagccagtcatgtccaaaccacgacgggtgacgctgccggccatctacaaacaaaaacaaagagaaaagcaacattttgaaggtcaggttttgatgataaatgaagcagcaagacagagagagactagacaattttcacaaataatcaaagatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataatcattacacgggcagcgaaggcccagcacacaaagacaacgaaaaacagcggaagactagggcgacgaccacaggcgcttgacggcaggcacgagctagacaccaaagccttcatcttcaaggagctcctcatctgtgcttgggaaaaattgagcaagactgagtacaaccaccgtactcaacaagacacacccacaaatgcagagtaaatgcaagggagtacaaagggaattataatataaggggttaaggttgcggtaaacagcatttaagggcatttagttactcaaagctattttgccaacgcgatcctagaactaaacagtgttattaatcaaggccgtgaacccacacgaacctgccttaacccaaggcctacgatgatccggaccgaactggcaacccgaccctgggtcccagctcgtcccaagccaacccaggccaaccattccacattttagttgtttaagcaggttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggtagtacggtagtgctttgcaacagaggcccgaagaccggtccttatacggccgaggagctactgtcaaaaccatgctccccgagcccagcctaaaaccattttggggaattttgaatagggggagcggggtgaatccaattccacaattaaccaacaattccagagtgtccaggtgatatgagagtttcccaagtctaaagttataaaaccacctaatgttgcctaattaaattgcgaagcatctacctaaagttaaactagtggtgtcatgagtagagtccactagttgaggttttgtttgtctagggtgaacaaggtagtagtaataacaataacaataataaaatggtcataacaaaggtaaataggcatggctaaataaaacagtggtaacgcgggaatttaaacaaagcgataatgcaataatttaaatcaacatagttttataaactgggattcaatatgatcaagatgatgtgtcttgccttgctcgtcttcccaaacgtcggcttcaacttccacgaagagcggatcttccgaagctgcagcgtctacacgaccaacggaaaagaaaaggcttaaccactaaataactccacataacagcagaaacaaagcacaaaaatgggttctttacatcttaaggaaaaattagggacttgaacggtccaattccgagttcaaatggccaaggtatggccatttgaagcttatctgctctttaaatggatatttagaatttcttcatttaatttttaattaaaaacc

SEQ ID NO: 4572 - DNA, 4284 bp, Oryza sativa
  unsure (1)..(4284): unsure at all n locations
gcacagatataaacgaagtggaaggctccagagtcgaacaaaattgtagcagggatggaatggatgagaaccgtaccaacgatgacgtctggagttgtcagcacgtcctcggccgtcacgtggttcacacgaccccgaatgacatccttgccaccgttgttggggcggggaggcgcttggccttgctgacgccttggcttcgggcatttatccgcaaagtgcccgggctcgaagcagttgaagcacagacgctgctgaccttgagcgtccctgcggacttgaacaggctgcacagttggcgtaggaggacggggtgcacgagtccctggttgattctgctgctgctgcggctgtgggacgcgcaccacgaattgaggtcggggcgcggagcgagattgctgctgctgttgttgctgctgtgaggaggatccccctgggtagggattggtgtagcggaccctttgattagcaccctgttgattgcggaagttcgccaagcggcgcttgtgcgactccagctccttgtgcttggcctccaagcggatgctcttgtccaccagacgttggaagtccgggtagtccccagagactagacgaacggacagctcagggtccattcccgccagaaacttctcttgcttctcctcatcttcccgcacatcctccggagcgtaccgggccagattgttgaactcatgcaaatactccatcacggagcggttgccttgcttcaactctcggaactccctcttcttaagagccacgactccggcgggcacatgggttctccggaaagcggcggtgaagcgagcccaagtaatcggttgcccttctggctgcgtagcctggaagtggtcccaccataaagatgcgggcccctgcagctggtgggcggcaaagatgactttctcttcatcactgcactgcacagtgtccagcttcttccccacggcatgcaaccaatccaacgcatccatggggttgttggagctcgagaaggtaggtgggcggatgcggaggaactcggcgagtttagagtgttgtggaggtggtggtggagcattctgttgtggcggattttggaggtggtggaggaaagcagtcatcatgttggcttgctgggcgaggatttgggtgagaatggcgttggtgtctggtggtggtggtggtggcggagggggaggtggaggtgggttgccctggtggttgtggttgctgccttcgggttggttgccatcaccggtaacagcggttctcctggtcgtcaccatctgaaaaccccacacagaaccagcaaacagaaagagctaacaattaaaactaaccacccacgactaccataattcttgaatttattactgctattaaattggttcattaaagttcaggttgcttaagcaaataaaataaagacaggctccgacacagttatgccacacaccggcataaccatgccccacacgactcaaaaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcaggctcggcacgaggggtctcgacgaagcaagtccacgccagggactgacgaaccagctcgggcctggaggtgctcttgcgggcagtgatcttctggctgcggcagacgcggcgacgcttggggcggcagtcctctccctgggcgatcttgagctgctgcagctgcgcctccaccgcgtcgaggtccttcttgagctgcaggttctcttgacgcagctccaggatcttcatgttgttctcgaccatcccacggtgcaccatctggtggaagtcgatacgagccgcgtcgtacgcctccaccatgcctgccaggtgcacgatggtagcgtcattctccgagctagcatcccggaaggtggcgtagtcgcgggctcctccgcgacgagggtggtagcggtagggcgagtgctgcaactcgtccgggtagcgctggcgaagagtgccgatggcgaggagagcggcgttctggcaagcggcggggaaggaatctccacccgcggtgactgccagcgaagtccgctcgggagagccggagaggatcactgtagtgacctcccaaccagcgtggggctctgcatcctcaccctcctgctccgggagcggcctggcctggtaatccactccatgtggataccccaggaccacgcacatgccccgcagctccaagacgaaaccagtcatgtccaaaccacgacgggtgacgctgccggccatctacaaacaaaacaaaaaaaacaacatttcaaaggtcagatttttggcgataaatgaagcagcaagacagagagagactagacaattttcacaaataatcaaagatttttatttttgaaaatattgctaaggcttgggatctacggctcgtcctagggtcaaatgtggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacaataaaccaacaattccaaagtgtccaggtgatgagaatatcccaaagtctagagttgtaaaaccacctaatgttacctaattaaacagcgaagcatctacctaaaatcatactagtggtaccatgagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaatgccggcttcaacttccacgaagagcggatcttccgaagctgcagcgtctacacgaccaacggaaaagaaaaggctttaactctaataaactccatataacaagcagaaacaaagcacaaaaatgggttcttggcttcttaagaaaaaattaaagacttgaacggtccaattnnnnnnnnnnnnnnnnnnnnnnnnnnnnnnnnnnnnnnnnnnnnnnnnnnnnnnnn

SEQ ID NO: 4573 - DNA, 1813 bp, Oryza sativa
ccggcgagctctccgtcccgagccggccgccgtcgctgacgtcatgccgacgtcgtcatccagggctgacgtcattatccttagggctgacgtcatcgttcccttttcttttcctttttccttttctctaatagtttaaatctttggaaaatcatatctaaataaccgtagatccgttttaggtggttcaagtttctaaatttttctaaaataaagatctacatattaaaattgtccatgaattgaattaaatttatttaattctttttaaatgggctttaattagattcaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttctgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgaattgaatatcctattccttgataccttgggtaataaattgattagcttgaaccttatgtattggtttggttcagctaaaagttatatatatataattgcttagcaatgcttagaaacattagctcactaatgggatgaatcatatatactacattattatttatggttatatttaatggtagctcacgatggttaatcgtgttatgataattaattggtaattaaaatatgattaaggtgggttgtgagcacatggttttgaaggtcgtgctcatggcaattaaggaccggttcgcgagctactgttgtgaaacatttaccgtaccaaccacaagccagcatgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacaacctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaatagtttgcttagctcctggtttggagattagatctgtacagccgggtatggttgttcaggatggttgggcctgtgcagcatgggtgtgctgttcagtgttgattaaaatttctgattaattaatttactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaagaattcagaaggagaagacgtttggcttatacctcagttgagctgcctgtgggagtggagctgaagccctcgctagaccgttaattccgctgctgttttcttttcttttgtaagtatgtgatgttattattatgatgcatttg

SEQ ID NO: 4574 - DNA, 1627 bp, Oryza sativa
gaactcggcataggggagactcttatcccaggtcttcccgaaatctagtacacatgcgcgaagcatatcttctaggatctgatttagacgctcggtctgtccatctgtctgcgggtgatacgcggtgctgaaatttaatcgggtaccaagctcttcttggagcttcttccaaaagtgagaggtgaattggcttcccctatcagatacgattttcttgggaacgccatggagactcacgatcctagcgaagtagagctcggctagtttgttccctccatacgtggtcttcaccggaataaatcgagctaccttggttaatcgatccacaactacccatatagaatcatatccgccttgggtttttggaagtccggtgatgaaatccatcccaatctcatcccatttccattctggtacttggagaggttggaggagtccggccggtcgttggtgttctgccttgacacgctggcacacatcacacagagccacgaactctgcaatttcccgcttcatgctaacccaccagtatttctccttcaagtctaagtacatcttcgtactgccagggtggattgaataaggactttcgtgagcttcctgaagtatcagctgtttaagttctctattatctggaacgcatacccgatttccgttccatagggttccgtgttcatcctctgtgaaaccaacggctttaccctgtttcatattcttgaggagtccatgcatgtccggatcattcttctgagcctcgcggatttgatcgagcaaggtaggcttggcttccaacgtagccaaaaatccgcgaccaactatgcttaggttcagggcttccatctgttggttaagctcgggtggaatgccacggacgttaagattgttgcaatggctctttcgacttagagcgtcggcaaccacgttggccttaccaggatgatagtgaattcccacatcatagtctttgatgagttctaaccatctcctttgcctaagattcagatccgactgggtgaagatgtatttcaaactcttatgatcagtatatatttcacagcgattcccaatgagatagtgccgccagatttttagagcatgaaccaccgcggctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatctggtaagactaacactggcgaggaaaccagcttttctttgagagtttggaacgccttctcgcattgcgggctccacacaaatttctcttctttcttcaacaactgcgtcatgggtcgagcgattttggagaagttctcgatgaacctccggtagtatcccgccaaacctaagaaactgcggacttgagtaactgtcttgggttgcttccaatcggtgacggcggtcactgtttcgggatccacagcaactcctttagcagatatcacgtgccccaagaatttgacttcggacaaccagaactcacacttcctaagcttggcatacaattgatgttcccgcaactttcccaacaccagacggagatggtgc

SEQ ID NO: 4575 - DNA, 804 bp, Oryza sativa
acgcgtcgaggtcttcttgagctgcaggttctcctgacgcagctcaagaatcttcatgttgttctccaccatgccacgacgcaccatctgatggaagtcgatacgagccgcgtcgtatgcctccaccatgcgtgccagatgcacgacggtagcgtcatcctccgagctagcatctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaggtccgctcgggagagccggagaggatcactgcagtgacctcccaaccagcgtgcggctctgcatcctcaccctcctgctccgggagcggcctggcctggtaatccactccatgtggatatcccaagaccacgcacatgccccgcagctccaaaacgaagccagtcatgtccaaaccacgacgggtgacgctgccggccatctacaaacaaaaacaaagaggagagcaacatttaaaaaggtcagattttgttgataagtgaagcagcaagatggagggagaatagagggttttcacaaatacgggggatttttatttcgaaaatactgctaaggcttgggatctacggctcgtcctagggtcaagggtggctctgataccaacttgtcacgaccggaattaacccaccgggcgttccttacgtgcgtgtattattccttgtcccaagaagcaaggtacaccaaa

SEQ ID NO: 4576 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnnnntcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagcgtcgccgccgcgtgcacgaagtccgccgccgccgccggccatcttcggcatcgtcgcgccgccgtctccgccgtcgcctttggtcgccgccaccaccgttaggtgcgccgtggtgtggagaagttcggccgcccctccgttttcgccgccgaccaccggagcgccgtcgtcgccactaacccgagccgccgccgccttcttcttcgtcgccggccgccgtcgtgcatcctttgactacgtggtgagtaccaacgggttcgcctcgttgccctctacgcgttgatgccctccaatcccgccgccgatgtccctagcgccggcgagctcgtcgacccgagccggccatcgtgctgacgtcatgccgacggtaaccctagggctgacgtcatctttgccagggctgacgtcatctctctctctttttcctttttcccgattttctaatagattaaaacttcggaaa

SEQ ID NO: 4577 - DNA, 2561 bp, Oryza sativa
ccattgtgcccgtctgtctccgccgcgcccgttcgtcgttgccgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccacgtggtttccacgtgtgcaggccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatatataacagcattaaacttcggatgatcatatcttggtcatacgagctccgaatcgatccgttcaagtctcctaatgtttgttataacctaaagaaccctgtgctttgttttttatgtattgttattgcttctttataggcttgaagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttagtttaaattaatgcattatcgctttatttaaaattcccgcgttgtcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaacattaggtggttttataactttagactttgggaatattcatatcacctggacactatggaattgttgggttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatgaacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttggaacgagctggaacacagggtcgggttgccagttcggtctgaatcatcatagaccttgggttaaggcaggtccgtgtgggttcacggccttgattaataatattatatagctctaggaccgtgttaacaaaatagctttgagcaactaagtgtcttctaatgctgtttactgcaaaccctaaccccccctatattatggctcccttgtactcccttacatttattctgcacttgtgggtgtgtcttgttgagtacggtggttgtactcagtcttgctcaatttttcccaaccccaaaagaggagttccttgaagatgaaggctttggtgtctagctcgtgcctgccgtcaagtgcctgtggtcgtcgccctagtcttccgctgtttctcgtttgtttttgtgtgtgctgggtcttccctgcccatgtaataaattaactatttatgattccgcttgataaactctgaaatgtatcaactcttggtgtaccttgcctcatgggacaaggattaatgcacgcccgtcaggaacgccaggtgggttataaaaggtcgtgacatgtgtgctagttgaactaagcatggctaaacaatccctaatccaacatctaatcaagttacattccaagctagcaaaggaacatgataacaaataatatggctgagacagtagggtaacatcccatggtaacattataaaacaatgtaatatttaaggaaaacaatagagcatttgcaatctgggatcaacatattcaagtgacaagcacgacttgccttgcttttgggctgaagaaacctcggcgactatctcaaagtacaccggagcgtccgaagagccatg

SEQ ID NO: 4578 - DNA, 1704 bp, Oryza sativa
gtcagttaacgttgccagtgtcggtgtagctcttagggagatggacggtattgattgcctgtctggaaaggtttgggatggagattttctaaaattgttcgattgtgatatacagccaattgaagatggagagcccaaattattatttagagggcgtcgtgaagggttgaaacgtctacaccaaggacatagtagatgatctcgatgacaagcaaggacaaggtttcatgtcggccgatgatttggaagaaattgatataggaccaggtgataaaccaaggccaacatttgtcagtaagaatttatctccagagttcagaaccaagttgatagagcttttaaaagaatatagtgattgtttcgcttgggagtatgagatgccaggactcagctggcatgccaccacgacataccggaaagaggccgtgataggacccttcacataacccactctaaccaaacataccacaccttaggtttcacccccactcctcgcaaggcggcgggcagtctcctctcatgcctaggtgaatcaaaaagccgcataggccatcgcagggcccatccgaacttcatcacgctcacccttgcttggatatgtcagctagagaagagctacactacaagcccaagcgttgcccacgctggcttgtggcaagtacgaggaattttttcagggtttcccgcgaaccggtccttaattgccattagtgcgaccatcaaaaccatgcacccacagcccaccatttattttaattaaccaacaccacagcggtggcactaatccaacatcaaactataatctgaagtctatgtattagtgtgtttcccccattgtgtgctagttgaactaagcatgactaagtaatctctaatccaacatctaatcaagttacatcccaagctagcaatggaacacgataacaaataatatggctgagacagtaggttaacatcccatggtatcattataaaccaatgcaatatttaaggaaaacaatagagcatttgcaatctgggatcaacatgttcaagtgacaagcacgatttgccttgctcttcggctggaggaacctcagcgactatctcaaagtacaccggagcgtcgggagagccgtaatctatgcgacaaacaaagcaaacaggctacaagactattgaaatagagaaaaaaaccatttttaatggattctttgcatttttcttgatttatggagagttgaatgggcttaaacggagcacggatgaattttctatgaattttcgaagattcaatgtgtttaactataaaagaaaaagccttaattgaattattgcgcattaattaaccccggatgacgtcagcgaaggaaggggggcgccgacatgcgggcccacatgtcatcgacacggaggaggcgtgtcacgtcctgataaattcatcccgaaataaaaatcattttctaaaaggaataatagaattaattaaaattcgaaaagaaattggcaaacactaaaatacgtacaagaaaaattcaaatgtggcccggggaatttttgttaaattctccttggtctaaaaggagccctcaaattttagtggaattttcagagcacaaataataattattaagaaataaacaaagttaaaatggttttataaaaagaaaaatcctaaaaagtcttctttcccccccccttaccttactgggccggctcggccca

SEQ ID NO: 4579 - DNA, 652 bp, Oryza sativa
atccgagggagagagagaggggaaagagggggaaacgggggaggggaacgcggggagtgattcccccctctttattgcgcgcggggccggcgggatgcggcggaattcgcggcggcggcggcgctagggcacgggcgggcggcgggcgcggcgggaggagggagatgacaggtgggtcccacccgtcagcgagagtggcgggcgggcccgcctgtcagcggcgcgcgcgcgcgcggggagccgatgggccgcgggggagaggagagagagggagggaaagttgggccgagccggcccaagaaggaaaggggggggaaagaagaacttcttttagggtttttctttttataaaccatttcaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacattgaattttaattattctttgcacaatttcgaggatgaattttagagtcgttttgggacgcgacaaacctaccccccttaaacggaatctcgaccccgagattcggaagaactgccgaaaagatcgggatgggctgcctt

SEQ ID NO: 4580 - DNA, 668 bp, Oryza sativa
cccgcgggtaacgtgaaaaccatgtttaccgatgcagttacaacactcttccctttggccaaactttttgcttcattggctacaacctcatcggctgttgcaacctggcttttaacatgccactcttgcctgggctttgctttttccagccgatggttgatttcttgctccacctcttgaaaacgttctctgttcctcaatctctgaacccttctcgtcttattcctcgtgaaaataccagaaggacaccattgagtctttctatcctcattatcttcttgatcacggtcttggttcaccgggcccaatctctgatgaacaggaactcttgtctgcctcagccgattgcttctattgtaggatcagcttgagctctctgcggcatcactgcatccagggcaatcttcaatagatggcagcctcataccttcgttccagcagaatctaaaaaactcacagtcccaatgaggatcaaaaccatcatcatcttcttcataatgcctctcctgttgcttgtcgtattttctctagtacttgttgataattctagccgaattcatctgaaagttgtcgcgaccgggaaaattgccttttcccgaacgcgagtgtattaatcccagtcccaggaaaagccggggtacaccacacaaacatgatataaaagacac

SEQ ID NO: 4581 - DNA, 1145 bp, Oryza sativa
atatattttagggtcgttttgggacatgacaaaaggcctatagtttgggaaaacaccacctggcagatagactggccctgtagcttgatgctgagctattgtgccatcaaccaatgacttcaccatttttgttaaagtattgactaagactcctgattgattgatcaaagcatgttgcacagcgtagtcaatccgatcttggaagttgttaaactgaggttgtaatccattggcatctggaccaagatcttcaaccattccctcctgaaaaccatcacatttgtcgtgtagttcaccatcagtacctttatcaccttgagatgagcttgagccgacttcatcggcagcaactacttttaccttgtacttttggtaaactttcccacgggtttctacgaaagacttcatgaattgctcctgagcattcttcatcattatgtcgaaaatccttcttctgttctggtgagagcttgtccatagtgattggaacaatgttcccttcatgaacttcagacccagttggatttggaggcctgttttgaggatctgtcgacttgcccgtcgaggacggagattgcttttctactgacatgcttgccgtctcccactgggcatgccaaaagcgtgttgatgcgaaaacacgaggcctggaagatctgcttaacttcagtgcaggtccaaaaatcttgcctttaggttcgtgagcgtgccagttgatttgatcctgcaataaaagagaaataaagacaaagaaactacggttaaatccataaatggtagccgatcggccagccgccgatgacgtatcatttatctttgagccgatgtcatatgtgaatcgatcggcaatcatgaatcagtaagaaagaactaaatctactcgatcggctgtatatattaacaatatataatccttatgttgatatatacttaaatcaagtgattgggatagatcggtcgccatgccgagacagtataaatcacttagatcgaaatatatattaacaatgagattatatatgttcatagcatagccgatgagatagatttagcatgtatcgtctaatactccgataccactctactattaagatattaaagcaagtagaatatatcaaacagaagcctgatatactttgggggat

SEQ ID NO: 4582 - DNA, 1239 bp, Oryza sativa
tgttgttgtattacatggggttcgggatctatttataccccgagattacataacaaaatatgtccatatcggacacgactcttatctctaacaaactctaaaataccataagtctttacggctgacttttgcccaaacttatccttaaggaaattacatgaaatatcctaattaatagatacaattgacttttcaggacttaatctggttgaattgttgtttaacaatttcatctccaatacttgaattaccaaatttggttgttaacaaattgttgttctatctttcaaccgataaaggcaaggagaagtagtgtctcgtgggaattaggggtaagggtaagcccccgtgctaaagattatttaaactaagagagaatacatataccttgcacctgtacctttgagatatatagtataatagcaactcttgatcaacaaccaagtttttgttcctttcgtccttcactcgggacgagcaaaagtttacccttgggggttttgttgacggtcattagcgatcactttcgaccgttaatattacgaaaatagggggaactagttatgcttgcaatacatatatatgttagaataatatattccactagtattaggttcactaaccttttgcagagaataaacataaaagtggagcagaatcgacatcaactcagacgataaatcaatcggacgatgtcgaaaatcatacttatgcatgaatgggccaagaactcagaattgacacgatgaattgggccaaaattcacaagtctgcataaaggagcaacagaggaggccacctgtcgagtttgggccaggtgggcccagcccatggttcagccaaaacccgccgaacttcccgtggcgcctatgaatgcagtgtttggatggacggctgggactgttccccaatgacggttggagggtattaccgaccattccaaccatcacaaccgtcattacctacgtataaaaggagctcctcttctcacttcactcgtacacctcaagcaaagctctctcatattctctcaagtttagtttagtgttcttaacctaatggaataggaatagagtagaaatcggagtccggtagccttcggaagagttcgggtatggctctagaagctattctcttctcttttgtaagcttgaactttatttaaaacactcttctttatacatttatggtattgaaatacttcctgagtatatgaatcccaactttacattatgttaa

SEQ ID NO: 4583 - DNA, 1159 bp, Oryza sativa
  unsure (1)..(1159): unsure at all n locations
accacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccttctggccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcacccctagcccagcccaaaaccattttaggggttttgaaaggaaggagcggtgtgaaaccaattccacaatagtccaccattccaaagtatccaggtgatatgaatatttcccaaagtctatagttgtaaaaccacctaatgttacctaattaaattgcgaagcatctacctaaaattaaactagtggtgtcatgagtggagtgtccactagttggggttttgtttgtctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaaacgtcggcttcaacttccacgaagagcggatcttccgaagctgcagcgtctacacgaccaacggaaaagaaaaaggctttaactctaataaattccacataacagcagaaataaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaactcattnnnnnnnnnnnnnnnnnnnnnnnnnnnnnnnnnnnnnnnnnnnnnnnnnnnnnnnnnnnnnnn

SEQ ID NO: 4584 - DNA, 955 bp, Oryza sativa
  unsure (1)..(955): unsure at all n locations
ctgggacggggattaatacactagcgttcgggaaaaggcaatttttccggtcgcgacaagctggtatcagagccatctcgactggaggataagccaagtggataaaacctaaggacatattttataaatgaaactatttgcgaaagttcctttttcctcctttcccctatgctatttgcaaaatgtttactctttctttctttttcaaatttcaactagtactagatggtcagctttgcggagaagaagatgtcgtcaattgtctgccgaagctccagaaggctgtaggatccgctagtggagtggaggaagctgtgaagcacgagtgaagatcttggagaacccgtcgcagaacctaagccaccctctagggtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacagtggtccaacacctgattaaccagaaccgattgcttatagagatactacagcagcatcagacgccaattttgaacccgagtcagatgcaacctcaggtgcagttggaggcagtccaagcactcacaccaccagtcagcatgccgccagcatcccgaaggacccatggtgacgtgccacatgttgactcaaaagaagcaagtatcatttgnnnnnnnnnnnnnnnnnnnnnnnnnnnnnnnnnnnnnnnnnnnnnnnnnnnnnnn

SEQ ID NO: 4585 - DNA, 1380 bp, Oryza sativa
tcacgtggttcacacgaccccgaatgacgtccttgcaaccgttgttggggcggggaggcgcttggccttgctgacgccttggcttcggggcattatccgcaaagtgcccgggctccaagcagttgaagcacagacgctgctgaccttgagtgtcacatcctgattttcgtttcaggatttataaattatttaataaattattaatagaatttatattaaatgttctttaatttacaagtgaagtaaaaatgtgggaaataaaatttcttaaatattaagcatggatggatttaattttgtattaaattctccatggttaattatactctctggaattttctcggatttttcggagctcaattattaattttaatcatacaaagagaagttcagcaattatttaaatattaaattaatcatataatgacctaattataattgttaagtgattttcttgtttaaaatccttaaattataaattgttgtttaaaaggaattaatagaaatgattttaaaaaaaagtttaaaagagaagatctttcttttaatttgctaaatctcaacataaaaatgagctagataaaattttgttaaatactttgcttgctcctctattttctagatttttctgggaattatttgagcaagggaagtatttttaataaatgaaacaacattttacaaattattttattcaaaaaagttcaaaagtttccccttcttggtccttgggccgttttcggcccatctctccctttctctctctttcccgcgcgcggcccacgccggcccaagccgccgccgctcgcgcccgcgcccctctctctctggaggctgacaggtggggcccacctgtcaggtccatcccctacctccggccgccgccgagccgaaccctagcgccgttttgcgccatcgattccgcccaaatccgagcccgattccttcgattgattgaggggttttgttcctctcggtctcctctttcttttcccccaagaatcaaagaaattcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagcgtcgccgccgcgtgcacgaagtccgccgccggcgccggccatcttcgggatcgtcgcgccagcgtcttcgccgtcggctttggtcgccgccaccaccgttaggtgcgccgtggtgtggagaagatccgccgccccttcgttttcggcggcgaccaccggagcgccgtcgtcgccactaacccgag

SEQ ID NO: 4586 - DNA, 1006 bp, Oryza sativa
ccagtcacagaacctaagccaccctctagggtagagtcgttagtcgcgtgtttctttgcttgtgtgtgtagcgcgtggtttgcatcagtggggtgtgatgtaaccatgctaggttgtttgcttaatcaacctgcagaaataagcaaaacaaacaacacatcaacaaaaagagttagttcctttaaggtcttgtccctagttctggtctattctttccttgtatgcttcccctctcaacctctaccttgtgacagatggataatactggtaacaaaggctatgggaacgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcaagaagaagctagggttgattcagtgcaccgaccaggagcggggtggcttcgcaactcatcagctggttggaccggcttcagagtggtgggatagctacgaagcatcacggccagaaggacataccatcacctggaacgagttttcatctgtattcaggagatcacatgttcccgcaggaatgatcacactaagaaaacgagagtttcgctacctgaagcaaggagatttgaccgtcacagagtacctgcacgagttctatcgtttggctcactatgcaccagaagatgtggaaacagatgaagacaaacaagagaagtttctccaggggttaaaagatgagcttgcagtgcaactactcgctagaggattatgaaaattttgagaaacttgtggacaaagccatgcaacattgaaagtgagcataatccgatgacgaactgc

SEQ ID NO: 4587 - DNA, 493 bp, Oryza sativa
ctcccatgcgaaccctagcgccattcctccctcaaagccgcgtgattcaagcatggaattcccaaattgattagggggaattaatcccctttccctcctctctctttcccccttaatttccccttgaatggtgcccccaatcgccgggaacggccgcgccattcccggccgccttccattgccgccggccggcttttccgccgccgttccccgctcctcccgtggccggctccctcccctccgctataaaatgggatcctcatcctccgttctatcgttttaaccccatcccgagcctccccgtggtccctagccatctccccgccgtcctcctctctctcccgtgccgccggccgcctccagccgcctctcccacctcgccggagcgccgtccggtcgcgccgtcgcctcctccagcgtcgccgccacctcctgttcgccggcctgccctccgttttccgcggagacccccggagctgcgttcccgccgtcg

SEQ ID NO: 4588 - DNA, 2051 bp, Oryza sativa
  unsure (1)..(2051): unsure at all n locations
cttggtatctagcagaatcagatccgaggaaaaaggaatcccctgaatttctataggaacggcagggctataatactttgctgtcataacccctccaggggtggtgatgagcagagggtttctaagcctttctacccccaactgacttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcgaggcgcggagcgagattgctgctgctgttgttgctgctgtgaggaggatccccctggatagggattggtgtagcggaccctttgattagcaccctgctgattgcggaagttcgccaagcggcgcttgtgcgactccagctccttgtgcttggcctccaagcggatgctcttgtccaccagacgttggaagtccgggtagtccccagagactagacgaacagacagctcagggtccattcctgccagaaacttctcttgcttctcctcatcttcccgcacatcctccggggcgtaacgggccagattgttgaactcatgcaaatactccatcacggagcggttgccttgcttcaactcccggaactccctcttcttaagagccacaactccggcgggcacatgggttctccggaaagcggcggtgaagtgggcccaagtgataggttgcccctctggctgcgtagcctggaagtggtcccaccagagagatgcgggcccctgcagctggtgggcggcaaagatgactttctcttcatcactgcactgcacagtgtccagcttcttccccacggcatgcaaccaatccaacgcatccacggggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtgaaggtggattgccttgggggttggggttgctgccttcgggttggttgccttcaccggtgctaacatttctcctggtcgtcaccatctgaaaaccccacacagaaccagcaaacagagagagctaacgattaaaactaaccacccacgactaccataaatcttgaatttattactgatattaaattggttcattaaggttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctgccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgttnnnnnnnnnnnnnnnnnnnnnnnnnnnnnnnnnnnnnnnnnnnnnnnnnnnnnnnnnnnnnnn

SEQ ID NO: 4589 - DNA, 439 bp, Oryza sativa
gtcaatcaaagagtgggaggataaaaagaagataaattaactgaagggctctccgatgatctcttcaagatggctctgccaaacgcggagccagtgtttctgatcatcgatatagtcatgaaggttgtaatgcgccataacccccaccatctgatgcccgagcagcttttcaattacgtgcggcgggcaacctaactcagagagatttgtggctatcgtccgcctcatatcatgaagcgaccactctgccatacctgttccattccaaatagaacgggcgtaattggatgccacaggtgaatgaacgggcgaatctttgatcccgccatcaattttacgttgtgaagtcaccaggtgattggtgtttattttcttgaggtgatttctgaccaggttaacggcggcgtctgagagtccccttctaatatgtacccgagtt

SEQ ID NO: 4590 - DNA, 435 bp, Oryza sativa
ttcaacatcatgtctaccatgcgtcgcgatactggaaagtacccgaatagaggctgtgacaataccctctgcacaacacaactcaccacagtgcaccattcctggatcataatcgcccccttataaaacaaggcatggactccccagcgacccccgtgggcttatctccgccacttctcagtctggagctccgcaatgaatcatgctatacaaaaggtaaagccgttgcccacgctggcttgtggttggcacggttaatgtttcacaatagtagcttgcgaactggtccttaattgtcatgagcacgactctcaaaaccatgtgctcacaactgtcacgaccggaaataacccaacgggcgttccttacgtgcgtgcattaatccttgtcccaggaggcaaggtacaccaacagttgatacaagtaagagtttaa

SEQ ID NO: 4591 - DNA, 437 bp, Oryza sativa
aaggaaaggttagggttagaggagagagatgaatccgaatccaactcaaatccaccggtttccaaagaaaattagccgatgtttccaaaagagaaaaagaagacgagatctcaaggatcatttgccctcaatcaatttgaccggaaatagagaggggcgacggaatttggatgggcagcgccggcggctcgggcgcggctcggttagggttcggccgggcgacggcgcgaggttgacgacgggtccgacaggtgggccccacctgtcagcggcaccgagagagagaaggaagcgacgccgggttgggccgactgggccggggagggagagagaaagagagaggttttgggccgactttcggcccaaagccaaaagagccttctcaaaacctttttcgatttaaattattcatgaaatgcaattccatttattaaaaa

SEQ ID NO: 4592 - DNA, 637 bp, Oryza sativa
cgagctctactccgctaggatcgtgagtctccatggcgttcccaagaaaatcgtatctgacaggggaagccaattcacctctcacttttggaagaagctccaagaagagctgggtacccgattaaatttcagcaccgcgtatcacccgcagacagatggacagaccgagcgtctaaatcagatcctcgaagatatgcttcgcgcatgtgtcctagatttcgggaagacttgggataagagtctccctatgccgagttctcctacaataacagctatcaagccagcatacaaatggcaccctatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcacgccattgcgaggtgtgcacaggtttcagacaaaaggtaagctcgcacctcggtatgtgggtccttaccgtatcatcgctcgacgcggagaagtcgcttaccagctagagttgcccg

SEQ ID NO: 4593 - DNA, 3460 bp, Oryza sativa
cggtgttcagagtgtcgtcctgcagctccctcaaattggccatcatcctgagggcggcctcctcacaagcatgctctaatgtgcccttgcaagctgtcacctccatgttgggcatgtaggaggggatgccgtgaacctacaagcgaacctggtgcgggaactcgccactgagagggtggatgctagtgtattgtggctcccttggaaaaccgatcacgaacgccatgtgggacaactctgcaatgaagcctcccatagtctgaccttagtgcgttaggggacagccggtcatctatagaagacaaaggatggagaatcaaggcatgctcaaatccaattatagaataaacggaaaaggactcaaataaaataagcgaataagagcggaattttgtgcatagatcatttttgcatgagaacgaataaataagactgatatacatagcaataagataatgagaaattagatacatagtagtaataatagtagtagtagtaagaaattgatataggaccaggtgatagaccaaggccaacatttatcagtaagaatttatctccagagttcagaactaaattgatagagcttttgaaagaatatagaaattgcttcgcttgggagtattatgagatgccaggactcagccggaatgccaccacgacataccggaaagaggccgtgataggacccttcacataaacctctctaaccaaacacaccacacctcaggttttacccccactcctcgcaaggcagccggcaatcccctctcatacctaggtgaatccgaaaaccgcataggccgtcgcagggcccatcagaactccatcacgctcacccttgcctggatgcgtcagctagaggagagctacactacaagcccagccttgcccacgctggcttgtggcaagtacgaggaattcttccagggtttcccgcgaaccggtccttaattgccatgggtgcggccatcaaaaccattatcacatcctgatttttgtttcaggatttataaattatttaataaattaataatagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcttaaataatacaaagaacagttcagtaattatttgatcattaattatatttgttaagagcttttcttgtttaaaaacccttaaattataaattgttgtttaaaaggaattattagaaatgattttaaaagcttaaaagagaagatctagttttaatttgctaaatctcaacataaaattgggctagataaaattttgttaaatactttgcttaattctataattcttagatttttctgggatttatttgagctaaggaagtatttttaataaatggaattgcatttaagaaataatttaaattgaaaaaggttttaaaagtcttcttttggctttgggccgaaagccggcccaaaacccttctctctctttccctcggcccagccggcccagtccgccgagccgccgctctcctctctctctcagtcgctgacaggtgggccccgcttgtcagcttcgtcgtcctccttcggccgccgccgcccgcaaaccctagcgccgccgccgccttcttcttccaaatccggccgcgcctttccttctccggccaaattgatagaggggaaacaatctccgggatctcctcttccttttctcctttggaaacgtcggccaaatcggtttggaatgagtttgattcgagttcgaatcggatcggctttcctctctccaagccgagcttttcttcgccggtgccgccgccgtgggcctccgtcgctgctcgctagcccctttaaaaggatccccgagctcccctctacccgtcgcctccctcgccttcgctcgccggcgtctgtagcgccctagcgccgtgctgcttcgcgccgccgtcgtcgccgtcgctccagccgtgtcgcgccgccgttgcagtcgccgtcgtcggtcgccgtcgccaccatcgggttcgcaaggtcgtcgtcgtcctcgtccgccccttcgtcaccgctgaagaccgccggagcgccgttgccgccgtcgacccgaagagcttcgccgcttccttctcgtcgccctcgccgtccgttgcccttccgccgttcctttggtcaccggtgagttcgccgcgtcgtcctcttcgtcttggtgccctccgtttgtgccgaagtgccgccgttcgccggcgagcatgcgagcccgagccgccgagccgccgccgccggggtgacgtcatcgctgacgccatcggagccgttcgccgtgagccggtcgtggaccgatcgatctcggccgtccgttttggatagggttgatctcggccgtccgttcccgtgaaccgccaccgtgcgcccggtccaccgaaaccctagcccgctgacgcaataatccttcttttccttttcaaaaataattcattattgcgtcataattcaattaaaatcaatataaaggttttaatccgatttaatctttaaaaattcataactaattcatttgaactcagtttaatgtgcttcaagttgcaaaagttgtgtaaaataaagatctacatcttaaaattgtccttaaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtatggtttatttggtttttattagtcttttccttcgttttgcgtgttagcttgtcgtttccgtcgttgcgaaggttcgcgagtgcgccggaagtattcaagaagattaattgaagaccgaatattgtaaggcaagtcacacagatcttaaacacaatcctttgagcatgttgatcctatatttaaattctctatttatttcaactgtgcatttattttcgaatgtcactgggtggtgtgaatctattcctttgttatggcctgtttgctatatatattggttcagctagatattagatatgattgcttagccatgcttagaaacattagcacacaactgggataacttattattcactattatttaaggatggtctaatgatagttcacgatggtcaatcgtgattggttaattaattaattgccaactaaaacttgataatgatgggttgttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgatatgtcctaaaagcctagaatgtgtaa

SEQ ID NO: 4594 - DNA, 2006 bp, Oryza sativa
ttgattactttattccttgataccttgggtaattataattggactagttgagctttatatatattggttcaactagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattatccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctgataagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactattttacttctcttaaatgttttgctaaatgctgcttttgcaaatgagcctatattatgccatcctttggtatctttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttgttttccgctgcagttttcttcatgatgaggactaagtgcctcataagtaagtacttatcgttttagttaatttgattaatctgtatattaaattgtcagtttgtgtacctcggctgattcctggacgaggattttatgcacaaataagttcggaaattactagtgaatttccgggcgtgacagtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagttaaagccttttcttttccgttggtcgtgtagacgctgcagcttcggaagatccgctcttcgtggaagttgaagccgacgtttgggaaagcgagcaaggcaagacacatcatcttgatcatattgaatcccagtttataaaattattttgatttaaattaatgcattaccgctttatttaaattcccgcgtgatcactgttttatttagccatgcctatttacctttgttatgaccttaatactattgttattgatattaataccttgttcaccctagattaaacaaaaccccaactagtgggtactctattcatggttccactagtatgaatgtaggtagatgcttcgctgattaattaggcaacattaggtggttttataactttagactttgggaattctcatatcatctagacactatggaattgttggtttatggtggaatttgacataca

SEQ ID NO: 4595 - DNA, 4982 bp, Oryza sativa
  unsure (1)..(4982): unsure at all n locations
ggacccagggtcaggttgccagttcggtctgaatcatcataggccttgggttaaggcaggttcgtgtgggttcacggccttgattaataacattgtataactctaggatcgcgtttacaaaatagctttgagcaactaaacgtctttaaatgctgtttactgcaacgctaaccctttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacatcataactatgggcacggctattcgaatagattatactttgatcagaggtgtacaattttacccacaagacacgttttcctcacgtgaaaccacgtgccacataccaccatggcatacggacggaagacgtgacataccatcctagccataaacaagagtaccgacccaaccctgtctacggccggaatcccgggacaggtaaccaaggttgagcccctagcagcagaacaccggccctgtgccatgacatctcgactactgggccgcagctcgtgtagccttcattctccctagagatgtccatcgagccccgacttcgtccatctctatccgtgtacttttgcccatgaccagactgagccacaaactacgccttacccactagacatgtggaagtacggtagtgctttgcaacagaggcccgagcttaatccttatattggtcggggtgctacttcccacaactggcatgcaccaaaaccccaccgaaaaacaggttttaggggttttgaaagaggaagagatgtgtatgtccaattccaccacaagccaaccattccatagtgtccaagtgatatgagaattcccaaagtctaaagttataaaaccacctaatgttgcctaattaaccagcgaagcatctacctaagttcatactagtggaaccgtgaatagagtacccacaagttaaggtttcgtttatcctagggtgaacaaggtaataataacaatagcaataataataaggtcataacaaaggtaaataggcatggctaaataaaatagtgataacgcggggatataaacaaagcgataatgcattaatttaaatcaaaataattttataaactgggattcaatatgctcaaggatgatgtgacttgccttgctcagagagaacaaccttctgtaccttcggcgacgaccacgaaccacgcttcgggaacctctggaacgacaaaagctaccgaagcacacaagcaaagctacaagcctaaaaaagaagcaataacaatacataaaaagaaagcacagggttctttaggttattacaaacattaggagacttgaacaggtcgattcagagttcgtatgaccaaggcatggtcatccgaagtttaatgctgttatatggagatttatggattattataattatgttttgcaattataaaacatgtgtaagagctaacctggaaaagacaggaaggctgcgctgttgacatgcggaccccacatgtcaacctaagggacacgacagaccgggtacacagagacggtccacgggtcgacggaagcgggccccgtgtgtcaacagaggcgagtggccgacaaacagactccactagacaccacgcgggccgcacacgtggaaaccacgtggctaccgagcgggcacacaaacacggtcaccacacgcacacacgaacgactaccgacaccggtacacaggtaccgggttcgacaccgcacaacgggcacggggcgacaccgaaaggacgaggacggggcagcgagaggagagagatccttaccaccacgcgacgaggcgtgggaacgactacggcgaacaggcggcagagatgaacgggaatgacggagacgacggcgaggggacgacttcggcggcgatcgttggatgaaggcgagacgaggctggcacaaggcttgacgacgcggagccgaggatgaagacgacgacggggctgcggcatacttgacgaaacgcgggcgacgaacggacgcggcttgacgaagggagggccgacgacgagcgcaaccaggaacgaggaggaggcgacaatggcagccagcagcagctgcacagagacgagaacggtgtggaacacgccactacgatgccgatgatagtggcggcgcagcgagacgatgggccggcgaggatggacggccgactggagaagtcgtcgatgaggacgaacggtgacgacgatgaagaccggtagggttcggatggaggggaggcgaggccgaggacgaccttgtcgctgtgatgccgaaggtcgtggtggtgtggtgcggccgatagtcgcacgggcgaggaggaagggacggtcgaagggacaccggcaaggatggcgtggaggcgacgtgcggtggcttcccgaccaaggagaggcttggccaagggagaggacgacgctgcgacgccgaaggaggagacggcgatgtcggtcggtgtcacatcccaaaaatcttaaaaatataaattgttgtttaattggaatttttagaaattaaattaaaagcctacaagttaaaccctaattttctaggaaaattttcaatataaaaatgagctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccgcccgcgctcgcgcccctctctcccggaggctgacaggtggggcccacctgtcagggccgtcttcaacctccggacggccgccgccgagccgaaccctagccgtcgtttcccgctccaaatccggccaaatccgactccgttttctccgattgattgaggggttttgttcctctcggtctcctctttctttttccccaagaatcaaagaaatccgttgaggattcgatccgaatcgaactcattttgatttatctctaaaaaccgagttcgtgttcttcccgatccgattcctctcgtttgcggcttggtctcttcgattcgagctcatataaaccttccccgtgatctcctctttcatttgcccttttcccgagtcctcccgtgcctcctagcgccgccgcgacgcgtcgcacgtccgccgccgccgctggccatcttcggcatcgccgccgtgccgtctccgccgtcgcctttggtcgccgccaccgccgttaggtgcgccgtgaggagaggaagctcgtccgcccctccgtttgcgtcgccgatcatcggagctccctcgacgccgtcgacccgagccgccgcgccgcctcttctcgtcgccggccgccgtcgtgcatcgtttcttgtcgtggtgagtaccaatgagttcgtctcgtcgcccgctacgcgttggtgccctccaatcccgccgccgaagtccctagcgccggcgagctctccttcccgagccggccgccgtcgctgacgtcatgccgacgtcaaccctagggctgacgtcatcagggccagggctgacgtcatccttctctctttttcctttttctcgattttcaaatagattaaaactttggaaaatcataactaaataaccgtagatccgttttaggtggttcaagtttctaaatttttctaaaatcaagatctacatgataaaaatatccacatgtactgtttatgcttgtttttgtactgttttgttgattttatttatttgctttagtttccgacgttccggaggagagcgtttccgttgaggaaggttccgaagcgtttgtggaagcccaaggcaagtcacacagatcccaaacaaccctttgagcatgttgatcccgtttaaagctattattttatttcaactatgcattgttttcgaatgtcatcgggtggtgagcctttcccagttaattattggccgaagttgactttattttcctatgggttataatttgaatagcatgaaccttatatattggattggttcagctaaatgctatatttaggtttgcttagccatgcctagaaacattagctaattaaaaggggttaagtataaattatattacataattattatgtattaattagggttataatcaatggtagctcacgatggtaaatcgtgcgatgttaattaattgataattaaaatctggataaggtgggttgtgagcatatggttttgatggttgtgctcatgacaattaaggaccggttcacgagctactgttgtgaaacatttatcgtgccaaccacaagccagcgtgggcaacggctttatcttttgtatagcatgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatgnnnnnnnnnnnnnnnnnnnnnnnnnnnnnnnnnnnnnnnnnnnn

SEQ ID NO: 4596 - DNA, 1350 bp, Oryza sativa
ggtgggttgtgagcatatgttttgatggttgtgctcatgacattaaggaccggttcgggagctactgttgggaaacatttatcgtgccaaccacaagccagcgtgggcaacggctttatcttttgtatagcatggttcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatgggtgagttgagcaatgtttttcgtgattagtctcacacttctcattaatggtaataatgtggtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacagtcggcgctttggcgcggcgaccggggcggctggaggcggtgcagtggcggcaattgtcgcgaccgagaaaatttgcattttcccgaacgctagtgtattaatccctgtcccaggaaaagccggggtacaccacacaaacatgatacaaacggcacatctttattatatcgataatatttacatgattacaaaggcacttcaagcctgacaatcaaaaataaacagcagcggactagcgggcctacggctccatcttcacaggcgctcaactggggtata

SEQ ID NO: 4597 - DNA, 818 bp, Oryza sativa
taagctttacccactagacatgtggaagtacggtattgctttgcaacaaaaggcccgaagaccggtccttatatggccgaggtgctaccatcaaaaccatgcaccccgagcccagcctaaaaccattttggggaattttgaatagaaggagcggtgtgaagccaattccccaattaaccaacaattccagagtgtccaggtgatatgagagtttcccaagtctaaagttataaaaccacctaatgttacctaattaacttgcgaagcatctacctaaaattaaactagtggtgccatgagtggagtgtccactagttgaggttttgtttgtctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgtcttcccaaacgtcggcttcgacttcgacgaagagcggatcttccgaagctgcagcgtctacacgaccaacagaaaagaaaaggcttaaacactaaataactccacataacagcagaaacaaagcacaaaaatgggttcttgacttcttaagaaaaaattagagacttgaacggtccaattccgagttcaaatggccaagatatggccatttgaagtttatatgctctttaaatggatatttgcgaatttcttcatttaaattttaattaaaaattccatttattgcgtcagccgaggg

SEQ ID NO: 4598 - DNA, 545 bp, Oryza sativa
tttgtttgtagatggccggcagcgtcacccgtcgtggtttggacatgactgacgtcgtcttggagttgcggggcatgtgcgttgtcctggggtatccacatggagtggactaccagggcaggccgctcccggagtaggagggtgacgatgcaaagcccctcgctgcttgggaggtcactgcagtgatcctcgccggctctcccgagcggacttcgctggcagtcaccacgggtggagattccttccccgccgcttgccagaacgccgctctcctcgccatcggcactcttcgccagcgctacccggacgagttgcagcactcgccctaccgctaccaccctcgtctcggaggagcccgcgactacgccaccttccgggatgctagctcggagaatgacgctaccatcgtgcacctggcgcgcatggtggaggcgtacgacgcggctcgtatcgacttccaccagatggtgcaccgtgggatggtcgagaacaacatgaagataaatgaaactacgtcaagagaacctgcagctcaagaaggacct

SEQ ID NO: 4599 - DNA, 982 bp, Oryza sativa
  unsure (1)..(982): unsure at all n locations
nnnnnnnnnnnnnnnnnnnnnnnnnnnnnnnnnnnnnnnnnnnnnnnnnnnnnnnnnnnncggccaacctccagccacgccgctccgccacgtccgccgtcgccgccgcttgccgccgtcgccaagaggtgcgccaaggggtggagaagcccggccgcctgtccttcctcgccgccggcgacctgagagtcgccgccgccgttcaaccgagccgccgccgtcgcccttctcgtcgccggccgtcgtcgttcgtcgtttgtcgttgtggtgagtaccgttgggttcgtctcgtcgtcctctacgtgttcatgtcccccaaattcgcagccgatcatccaatctccggcgaggtcgccaacccgggccggccattgatgaggtcatcgctgacgtcatcatcggtttttctttttcccgtttttctaatagattaaatcttcagaaaatcataactagataaccgtagatccgtttcaggtggttcaagttgctaaatttttctaaaataaagatctacatattaaaattgtccataaattgaattaaatttatttaattctttttaaatggactttaattagatttaatcttgtaaaattcatcataaattcatttgaagtcagaataaggccgttcaagtctcataattcatctaaaattatgatctacatgtttgtttactttatatgtactgtttatttggtttttattagtctttttcttcgttttgcgtgttagcttgtcgtttccgtcgttgcgaagtttcgtgagtgcgtcgaaagtgatcaagaagattaattgaagaccgattattgcaaggcaagtcacacagattctaaacacaaatcctttgagcatgttgatcctatatttaaattctctatttatttcaactgtgcatttattttcgaatgtcaccgagtggtgtgaacctattcctttgttatggccaatttgcattgaatgccctattccttgatac

SEQ ID NO: 4600 - DNA, 841 bp, Oryza sativa
  unsure (1)..(841): unsure at all n locations
taaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaatatccagaccattccaaggtgtccaggtgatatgaatatttcccaaagtctatagttgaaaaaccacctaatgttacctaattaaattgcgaagcatctacctaagataaaactagtggtgccatgagtagggtgtccactagttgaggttttgtttattctagggtgaacaaggtaataataacaataacaataataaggtcataacaaaggtaaataggcatggctaaataaaacagtggtaacgcgggaatttaaataaagcgataatgcaataatttaaatcaacataattttacaaactgggattcaatatgttcaaagatgatgtgacttgccttgctcgctttcccaaacgtcggcttcaacttccacgaagagcgggtcttccgaagctgcagcgtctacacgaccaacggaaaagaaaaggcttttactctaataaactccatataacagcagaaacaaagcacaaaaatgggttcttgacttcttaagaaaaaattagagacttgaacggtccaattccgagttcaaatggccaagttatggccatttgaagtttatatgctctttagatggatatttgcgaatttcttcatttaaattttaattaaaannnnnnnnnnnnnnnnnnnnnnnnnnnnnn

SEQ ID NO: 4601 - DNA, 900 bp, Oryza sativa
gggaggactttgggccagacttggcccaaaggaggaaggagggttatttttaggtttttctttttattaaactttgataattgtttttgttgcttaataattatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagagaatgatttttaatttcgggatgaatttatcaggacgtgacaaagttccgattcgtccctccatcggctgtccttccagatgcatgcaccatattaatagggaaatgattaccatctaccttcatcggcttctttgaatcatcgaatttgatatttcccccttcaatggccacctggatctgctgtctgaaaactttgcagtcattagtagaatgagattcagaattatgccatttgcagtacctccttttgccaagttccttagccgatggaattatatgaccagcaggaagttgaatttgtttctcccgaagcaataaattgaaaattttgtcaaccttggtgatatcaaagtcgaatctttcttcttttccagaactcctcacccacggtgtcacgaccggaaatcacccaacaggcgttcctgacgtgcgtgtattattccttgtcccaggaggcaaggtacaccaaaagttgatacaattcagagtttacaagcggaagcgaaaatataaacactacacgggcagcgaaagcccagcacacaaagacaacgaaaaacagcggaagactagggcgacgaccacaggcgcttgacgggaggcacgagcttaacaccaagcccttaattttcaa

SEQ ID NO: 4602 - DNA, 543 bp, Oryza sativa
ttcttcatggtaaggactaagtgcctcttaagtaagtatttatcgttttagttaatttgatgatctgtatattaaattgtcagtttgtgtacctcggctgattcctgaacgaggattttatgcacaaataagttcggaaattactagtgaatttccgggcgtgacaaccatgcacccacaacccaccatttaatacattttaattaaccaacaccacagcggtggcactaatccaacatcaaactataatctgaagtctatgtattagtgtgtttcccccattgtgttgtcgcgtcccaaaacgactctaaaatacatcctcaaaattatgccgagaataattaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaggttttataaaaaaaagaaaaaccctaaaagtctt

SEQ ID NO: 4603 - DNA, 892 bp, Oryza sativa
gtatagttctagattcgtgtttaccaaatagctttgagcaactaaatatctttaaatgctgtttactgcaaccctaaccctttatattatagctcctttgtactcccttgcatttattctgcacttgtgggtgtgtcttgttgagtacggtggttgtactcagtcttgctcaatttttcccaaacccagaagaggagttcctagaagatgaaggctttggtgtctagctcatgcctgccgtcgagtgcctgtggtcgtcgccctagtcttccgctgtttctcgtttgtctttgtgtgtgctgggccttcgctgcccatgtaataagttatctatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcaagtattttcgaaataaaaatcctttgttacttgtgaaaaccctctagtctctctctgtcctgctgcttcatttatcgtcaaaatctgatcttttaaatgttgcttttctttttgtttttgtttgtagatggccggcagtgtcacccgtcgtggtttggacatgactggtttcgtcttggagttgcggggcatgtgcgttgtcctggggtatccacatggagtggactaccagggcaggccgctcccggagtaggagggtgacgatgcagagcccctcgctgcttgggaggttactgcagtgatcctcgctggctctcccgagcggacttcgctggcagtcaccacgggtggagattccttccccgccgcttgccagagcgccg

SEQ ID NO: 4604 - DNA, 793 bp, Oryza sativa
gaccgccgccaaccgcgtgcgcacggtccaccgtgtaccgtggggctaaagcgtgggccccactccccgtggacccggtccgcgcgtcccctccctcggctaacgcaataatcagttttttttaattataatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattggtattggtattggtattaccttggtcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaatggacatacacctcttttcttttttaaaaccctaaaacc

SEQ ID NO: 4605 - DNA, 1095 bp, Oryza sativa
ttctttccccccccttttccttcttgggccggctcggcccaactccctccccctctctcctctcccccgcggcccatcggctccctccccgcgcgcgcgccgctgacgggcgggcccgcccgccaccctcgctgacgggtggggcccacctgtcatctccctcctcgcgccgcgcccgccgcccgcccgtgccctagcgccgccgccgccgccgaatccgccgcatcccgccctccccgcgcgcaataaagagggggaaatcactccccgtgattccctctcccgtttcccccgttttcccctctctctctccctcggattcgtccgaatcgcgcccgcaatcctcgccggcgtcatcaatggcggccgagatctccgcggccggtttctttcttccccggccaccctctctccctcccgaccctatataatcgtcccccgagccccgctcttccgtttccgccgctcgccgctcgctctttccgtcggattcgtgctcgcgccgtgctcctctctctccgccgtcgccgccgacctccggttcgccgccgccgtcgctccgggcttcctcctgactcggcgtcacctccatcggcttcgccgcgttgtcgccgaccccgtccgcccctccgcttcgcccgccgaacgccggagcaccgtcgtcctcgccgtcccgaaccgcgccgccgccttcctccgcttcggccgccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccagccgcgtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccctttaaagagcatataaactttaaatggaactatcttggccatttgaactcggaa

SEQ ID NO: 4606 - DNA, 695 bp, Oryza sativa
  unsure (1)..(695): unsure at all n locations
nnnnnnnnnnnnnnnnnnnnnnnnnnnnnnnnnnnnnnnattcttgcttcagtacgactgtgcttgccgcgtccgccgcattggcggcgaggtgaaacaaacaccccaatggaagccgtgaaccttattcagtcaacaaattatgtgagatcagaactggcttacctgattcgggagatatgagctgatctcaggaaacagggcaataactatttagaaagtgttgcaatgccagaatactgtctgtcacttactagctaataggggtcggactgtgtgtcgatctgagctttggccagacaacacttgttacctcataacacaccttgggtgtgaggattctttgattgattaatgaaacttacctttattcccggaaaaaaaaaacaaacgccccaatggaaacatgttccgttgctaacgcgtgaatagacatgtgttcccaacttttaagtttttcaggtaggacctgctctatatgggtcggcgccatatatagccttttgatcgataaccacaaaatctgtgaatgtcaggcagattaattatttatccgatataaagtccaacaaaatgtagtactgatttttatggagtgagtgaaattataaatggctttcgatgtgtaagcactatgacagtgagtgtcttcaattggctgacactgcgtctaaataaacataaccttagagagt

SEQ ID NO: 4607 - DNA, 1224 bp, Oryza sativa
  unsure (1)..(1224): unsure at all n locations
agcggcataatagcccagccgtgtaggcgaaggcaccactcggcgtcgacgtaggcaggccggcggtgaagtcgtagacgcccaacagcggcggcataatagtccacccgtgtaggcgaaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcgggccggcggtgaagtcgtagacgcccaacagcggcggcataataggccagccgtgtaggcggaggcaccactcggcggcgacggaggcgggccggcggtgaagtcgtagacgcccaacagcagcggcataataggccagccgtgtaggcggaggcaccactcggcggcgacggaggcaggccggcggtgaagtcgtagacgcccaacagcggcggcataataggtcagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcgacataatannnnnnnnnnnnnnnnnnnnnnnnnnnnnnnnnnnnnnnnnnnnnnnnnnnnnnn

SEQ ID NO: 4608 - DNA, 1410 bp, Oryza sativa
cagcacctatcagaagatattgatactgaattgatacattgagttgcacatgtgaatcaatcatctgtatattttcctggccatgctatacttgttttaatcttctcatccagagatactcagcatgatgctggaaattcattttcagatgttttgcatatatttgtgcacatattttacttatccaaaaaaatatatgaaaaagtatattttccttgcatattttctatgtgacaggggctgtgagaaaaatatgcatacctaaatttcgaccttcttcatctttattacattatcaattcaacaattaaacaactaaaaagggacatgtacatattgtaacagaaccaagccacaacctcaaacagcttggtgtaaaaagccagcaaaattgtagtggtaggctaatagcaggcctgacactgcaacggaaatgcatggagatgatagagatcaattgcataggcatcaaggcccgaacgcactgagattatcattactaacatcatgtacagtgagagccacttaaacggaagcagctaactacaacggaaatcatactagcatccgttcaagccaacaaaaaaagaaaatcatagcatccacgattactaatttctcagaggtttacgcaacaagtcaaaacaggaagcttaccaaggaaatgtgcaaggcccaggagcctctctggatcgcagaagtagcccaccgagacattcatcgacgccgccgcctgcaaacaaacaaagccgggattcacccattcaagccaaaaacccaggaggcaggcaccaaaacccccggcacatccccgatcgaaggagccagcgaaagcacggagaccttgtcggtgtcggggtcgctgacgaggaggcactcgagggcgttggggagcacgacgcggcggtacccgcgcttgtcgttgcggggcctggtgatctccgcgtcgccctccgccgccgccgccgccgagggtgcggccgcgaccgcgccgtcggacgacggctcggcgggggcgtcggtcgtcgtctcgcgcgctggcctcgaacccgccattgcggccgccgcggattcgccgccgctggcggtgggtggtgttggagttggagtggactgcgtccgcgaagacgcgaagttggcttggcagttggaacggcgagtaacaagttgtccccggagacaacgcgagagagggtggcacggcagcagtgggtggacctgcagcgcgggttggtggacttggtagttgggcacgtcaggagtgggcaaatgggctgggccggaatgccggatttgtgcacggcggcgtgcaccgggacatctttctgtttgaagtccggcgtgtaccgggacatcttactgtttgaagttcgaagtcaagtaaacgtctactcgaacgttcggaatttt

SEQ ID NO: 4609 - DNA, 462 bp, Oryza sativa
ccgccgttgttgggtgtctacgtcttcaccgaccggcttgcctttgccgccgccgactggtgtttctgcctgcacggctggcctttatgccgccgttgttgggcgtctacgtcttcaccgaccggccgcctcgtccgccgccgactggtgtttccgcctgcacggctggcctattatgctgccgttgttgggcgtctacgtcttcaccgaccggcttgccttcgccgccgccgactggtgcttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggccgtctagtccggcgccgactggtgtttccgcctgcacgggtggcctattatgctgccgttgttgggcgt

SEQ ID NO: 4610 - DNA, 409 bp, Oryza sativa
ttccttcaaagggtctattttgtccaactactacagtaatgcttgtcaaagggtcacattgtttttgcgtgcttccttcaaattctattttgtccaactactatagtaatgcttggaatttgtataattgtctaactggtgaacgataatgacagtgtctatgtgtttttgcgacattgtaaattgtaatgatgcacatgaagtccatttagcattgcacacagctaactacctcactctgttttgattgtcaagcttgtagctatttctgagatgggattccactaccgagacaagagtcctcctatccattatgttgtcaatatttcctcaaacatgcaggtatattttagtcattgctttgggcatctgtattgcatgtccataattgccaactaataatctttat

SEQ ID NO: 4611 - DNA, 734 bp, Oryza sativa
ggcgatcgactcacgcgatgaccaagccagacttgtcgcgatagagaagaagacgcggtgcgcgcgcggtgtgccggtgcgggaatcggtccactaaccggccggggcgtggggtgcgacgcgaccgaccgcgtcgtctccggctgcgtccccgcgagatcggccgtaggaaaccgtggtctcgtgggggcctgcagaatccgcgacttcgcgacttctttttcttgccgtcgcgcgcgtcccggtggcgtggttgacgcggccgccaatttggttcattgcctcacggggcacgggctcgtgccgttgcttttccggtgcttttgcttagcgcaggttttcgcgggtgtgcatgaccgcgagtccgtgaaccatttcgcgcgtacgccatgcggtgcgcgtggaccgtggagtcaggcctttcctctcagagtcaggcccgtttggtacagcttcagctccagcttcatcccttctgaagctggagctcagccaaacagtttcagctccaccaaaattaggaatggagttgggtggagctctctcacaaaatatactagagttgtggaggtgggtttaggcagctccacaactctacttcagactaaactcctggacttatatttaggagttggagctatttaaaacaagccctcaggtctaagctagtcagctacaaagcgtgtggtcggatttgggcttcttaaggggggagtttggatggggttaaaaaa

SEQ ID NO: 4612 - DNA, 24800 bp, Oryza sativa
tatattaaaaataattaataactaacacgtatataaaatacaatataaacattacacattaatagtttcgtaaagttagtacaaaattttaaattatgttataattttaatatattttaataataaattcagaaaacatatatgctattatatgagataaaatataattatattagctgcgcaatctacgcggccactatgctagttaatagtgtagtatatgtttataggtaactatcatataaattggccattaatttgtctatagataatttgaagctagtagcgagctatactattaaacttgcacttaggttgtgtttagatccaaggttgaaaatttttactgtgtcacatcggatatacggacatacattgtctaataacaaaataaattacagaattcatcaataaaccgcgagacgaatttattaagcctaattaatctatcattagcaaatatttactgcaacaccacattgtcaaattatagagcaattaggcttaaaagattcgtctcgcaaattagtcacaatttgtgtaattagttatttttagccaatatttaatatttaatgcagatgttctgtgacagggtggaaaattttagggtggatctaaaacagggttttattctcgacggtacaataccaaatccgtctattatattcgcgcgaatatgctcggccagtccacctgtcacgcgaggcatgagaagggcgaccgagccgggtggagctgagcgagtggtggtgctgctgcagccgccgccgccgccgcctgcaggcgtgctgaaaacaagtccatgccatggtggacgagaacactgtggacgtggtcagccatggatggtggcgatttggacagcctcgcgaccacgacatatactagtagtactcacatatatacgacgactagccaaaggtgattgctttaatcaaacaccggcgatgttcgcgttcctctggaagttggtgcagtttctctcctcctcctcctcttcttttttaatttttcgtccctaaagaacagaagaagtctcatgtctaaagtgatactcttcgagtcttgacggccagaattgtcagactgtgtgatccagaagcaagctaaagaaagggagtatacggtccagaaacacgttaataaagggaaaggaaaagggttgtctattcttgcttcagtctgactgtgcttgccgtgtccgtcgcattgccgtcgtggtcaaacaaacgccccaatggaagctgtaaacctcattcagtcaacaaataatgtgagatcagaactggctcacctgattcgggagatatgagttgatctcaggaaacagggaaataactattaagaaagtgttgcaatgccagaatactgttagtcacttcctagctaataggggtcggactgtgtctcgatctgagttttggccagacaacacttgtaacctcataacacaccttgtgtgtgaggattctttgattgattaatgaaatttccctttttccccggaaaaaaaaaacaaacgccccaatggaaacatctcccgttgctaacgcgtgaatagacatgtgttcccaactctcaagttttccaggtaggacctgctctctatggttcggggccatatatcgccttttgatcgataaccacgaaatctgtgaatttcaggcagattaattatttatccaaaataaaataaaataaaatttagtatgattttttatgaatttagtgaaattattaaatggctttcgatgtgtaagcactatgacagtgtttctctccacttgtctgccactccgtctaaaaaaacataaccttagtgagttttttttttttcgaatggagtactttcattacttggtcatcgagcgggcaaaaatgcaaactactccaaattccaaaatgggagtggcagccgatacaaagacaagcggtggacttgtgggcctgtggcttgtgggtgatcagcccggatggcttgcttttctgttagtgggctgggaggtgaaggcgataagcttaggtgggctggcttgctgctacgctcgacagaaagcgggctgggcaagatggggaggcaggccgtggctaacgcttgatctctttttgtggcctcttgcctcatgggtggcttttagtgtgagaaatgaacaaggctacgaagcagtactttgttgccctctttagccgatccttccatcgatttcaactgtcaatagtgtcattcgctacagatctcgacgccaaaccaaaaaaaaataaagtttcgagccaatgttggaacctctggaaggtagacttttcgaaatggaggacgatcagatgcgtaatggaaggggaaaacagagtataagatcgcaccactgagcagtgagcatgagggttcggctttccgtgacaggtactattggtgcacgcgttggaggggacgagagttgcaaaatgccggatgaaagagcttcacgacttcacgtgtggtttggtttttatttactcgacgggtccctacacgatgctactgctacacatgaacgtgatgcgcgtgtcatccgcctcgtacagtcgtacctccaatgtaccgccaggcggtgcgcgcgccggcaaaatcctttcggtcacaggatcacggccggtaacactcgtacacggtcacacggatacgtacatctcggaacaatttgatgcgttcgggtcatctgaaattaataagtgcagtgcttcatcctcgttgtaacttgtaacccataattgtgcttcttactagtgttttttgttcccttcctggagcaacaatgcccatcagagagaggggagactgcagttcacagccgtgcgccagacattcccagtgtcccagcaccgtgtaccctctttctcgttaacgatcgattgagcaaaattaatgggactcggtgttgggctggagactggaagacaggcacttccaagtatgtaaacgtaacacttatcaaagcatcctgctttaagctagcctctaacccggcctcattaagttagcccaatttcctggcccatgtacgcagataggctagatctattatattattaagacagctcgaaaagaagacatcacgtttaccgtggaggctagaaattctcacgttaatcgaagaaaatataaattatttacaccgttggattgtaagaggcatagatttcaatgtctgagatttaacacaaacttagcatgttaactgaattagaatcaatctctaactaggatctttacatgcaaacggactcaaaatagttttgtccgattttctaaacttaagttaggttctagaatagttaggctataatgtatagtagcaacggaaatccacagcagcaggtcgagccgcgcggctgcacgatgagcaagaattggacgatgcacgtcaacaaacagaaggaacgatggcatgtgcacagcagctagccaggtgcacaccttaagcgatacaattaaaaagttttcctttgaaaatataggttccaaaataaacttaaaaataaaatttggaataaaaatataataccaataataaatatgtaaatattctttgccaaatatgtacatttatctatatatatattattaagatagctttagaaaaatcatcagagacataaaaaaaacgtagaaatctttattattaagacaactcgaaaagaatgtgccatatttattctaaaagatataaattatcacattaatcgaagaataaattccaagccattagactgtggtagaaccaaattagaacggtgaagattgataacagaaatatatgtaatataattatatctttagaactaaacaatggtatatagaagagtacagtgacagcatttgatgagacttctaaatattataaaaatgaaacgaaacaagataataaactctaaaaagtacaaggtccaatttttaaaggttcgggacttttaaaaagtaaaaagaacaatgaaaataatgttccaatttaaaatctcaatgaaataaagagaggagggagcatgcgagccatagaatagtacaatggcaaagccgataattgtttggtgggacttttagaaagtaaaaaaatgaactcaaacaataattatgtttgatttttagaatcccaatgacaataaagagaggaggcagcagacgggttatagaagagtatagtggtagtgtttgatgagacttctaaaaatataaaaatgaaactcaacgaaaataaactctaaaaattaccaggtcctatttttaaagattcggaacttctaaaaagtaaaaaaaatgataataatgttcgattttaaaatctcaacgacaataaagaggggaggcagcggacgggccgtagaagagtacagtggcaaagccgctaacggtttggcgggagttctataaagtaaaaaataaacccaaacaataattatgttcgattttaaaaatcccaataacaataaagaaatgaggcaacggatgggcaatataggagtagagtggcagtgtttgatgggatttctaaaaattataaaaacgaaaccctaagagacaataaactctaaaaattataagatcaaaattttaaagtttccaaggagaatgaataggaatagtgatagatcgagcaagcaaataaaaaatagggtaacttttaaaaactataaaattaaacacgaggatgatatggtttgatttttaaaagttttaaaataatgagataactatttattcaataaaatttaagtaaaatcatattaaaaatagataattttatatggatgctagccgcgcaattgcgcgggccacccagctagttcttattatcccagacaggcagcatcatgcagaaagtggggtatcctaccactttacagtagatccacagtacacggtatactgagttgagttcaaaaaggaggtgtacccagttagcgctcgcaagtacgagtacaagaacgaaaggcaaattatatcaaacacttatcatttcgatgatacattagggcgatccataacgtacattcacaatacacacacttgcatcatcatcatcatcgtactccatacacggtacacgtacgcacacgtacacacggctccctcgtttcgtacaatctgaaggagagtcgaccacgcacgcgtgcaggcactctaccttggttacaatttgtactaacgtaaacccgcccagtaccctgcacggctgcacccgtcgtaccgtgtactacacggccacgtccccgtacgcgaaaaaacaccaaacacgtataccgttacgcaccccgggctccaccttacgtggcagcatcagctcgccggcggtgatggatggatggatgctcacgattggtggcacccgccgagcggggcgccgccggcgcactggttgtgctcgtacggcttgcagccgtggcggatgacgccgtgcagcctcgggagcgggccgcagaggcggttgtagctgaggtccagcgtctgcagcgtggagagcgcggcgagggagcgtggcacggtgcccctgatgcggttgtggctgaggtccaggtaggtgagctccggcgggaagacgagcttgctgaggtcgaagtcgaggtcgttccacgagaggtccaccttgccgatgggccggccggcggcgaaaagaaagaaggcgtccccggtgaggcggttgtgcgagaggtcgacggtgttgatctcgtcctgcgcgtcgtcgcgcgggatcgggccggtgagctggttgtaggagaggatcagcgacctgaactgcccctgcacgagccccgccgggatgcaacccgtcagcttgttgctgcggaggtcaagcgaccggaggttcgggaggtcggagaaggagttcgggatggggccggtcaggctgttgtgggagaggtcgacggagtcgaggctgcggatccgcgcgagcgagtccgggatgacgccggagacgttggtgtgggagatggtgaggaactggaggttggagagcgcggtgaggcacgccgggatggggccggagaggcccgggaggcggaacagcgacagcgacatgagcgccgtcagccccgccacggcggacgggatctggccgcggacgtcgttggcgccgtcgatgaagacgttgttcacgcgcccggcctcgtcgcaccggacgtggtcccactcgcagcagtccgccgacgccagggaccacgtcgacagcgtcgccgggtttcccagcgactgcttcactctcatcagcgcctgcttgtcgctcggcgggcatcgcaccgccctcgccggcgccgccgcgacggccaccgccagcaagacggcgagcatgaaagaggcggtggacgccattgtatctacctgaactaggctcgtgtggctggagctggcttgagtgtgtgtgagtgagtgcgggagtgatgagctctcgagggtggtataaaaagagccgcgcgtggaggcgtcaggatcagtgtgcatgcatgatgggataaacgatacattttcctcccattttttttctctctccctctcatatcctttttttgaccacccatcgaaccgggacatgcttgggctcggggcctcggacaccgagacggccagcggtgcggtggtactacgagcggacacgagaaggattcgcggtgaatgatgagtgaaaacgaatcaatccctgacaccgcaacatgccaaacgcacacacacgcacaggcacagagataggtggtgccgtggtggtgataaccgggaagcatcgccgtgggttcggccacggccggcgcgtgattggtgcgtgcatgattagcaatggcatgtgggatgggaacgaactggggctttcgcccgctccgtgctccggccagcgcccacattgctgggtgcagaagcagaaagcagaagccgctcgctccgcccgcccggccggccgggcggcacggcacgcactcgtattaactcgcggacatgtgcgctcggatctcccggagcctcaagacgggggcgtcgcgtagctaagctagcacctgttctggatacgcttgtctcggttatgatcggcaaagggccgcaaatggacgggaagacagctcgttttccgtgtaagtcaacatgataggagtactagcaatgaggaggttatttaaatccacatgaaacaattatacgcagtttgcaaattgcagccccctctgattgaattcgcatataatgagtatcccgcactaattatttcggatgagaaaaggtcgaagtgcatgttctactgttcgatttcgtagagatatgcattgcattatcgtgtcgcagggattagatcgatcacatatagcacaggcccacgagagacaatcaaggagacgtcgtcacgtcgctcgcactgtcgcaggcggtggtgcatgcatgaatgcaaactgagtagctgaccaggtccatcactccaccagcccgtgaaaaaacgtactagtagcaggaggacggacacagcagcagcgagagccaccgtcgccgcgccacgtactcgcacaagccggggcccaccacaccgccacccatgcacgcgacgtctctgtccgatcccctgaactgaaacgctgtcacgctggagcgcgcacaagccaaaggtgctccctgtccgactcggcgcgcgcttgcccgtatcacgtcttcagcgagcgagacgagaggaggaggcacgcagcggcggccatgtgggggctaaataatgcggcatggacgtggtccgacagggttcaggccggcacgagagcgcatgtggaggcttgggcggcgaggggaaaagaaaggattctttcggctttctgggctggctgcccgggccgcttgcagctttgcgttaaacctcccccttgtagaaaatgcagtagagatttcggaggtttggaatctcattatgatgctttagaaccaagaaatgactcccctatcatgtttcacatatttatgtagatctagtttatataggatttaacaaagataattcaatcttgcgttgcaatttgcagagctgccttgacgcttgacgcttttgctctgtgctctgcggttcggcctggccgtccagctacgcacccacatgcatcgaccgaactggagatagatgtaccccgcctgggcgctgctctgtccagtctctgcctctgctcgcaccgggcacaccagtttcaccagcgagcgtgcggtacgccagcaccaccagaccagatagcaccgtcgtctctgcgatttctttacgcgaaaagcagggcgggttggttggatcgcgaaaccgatcagccgaggcgacgccgcgacggagagattgtgccagcgtcaagttgcatgccgacgtaacacacttgattttctttagtactgagatttgtgcgaggtactagtagtagtcgtagctttggctctccatgcgattcttggctgccaaagcggtggctgatgcctccgtggtttgttttggtgcgtcgtggtgttcatcgcaggatctctcacgtgttgactgaaaattgttgtattaggtgtagtctccaggttgcagctttttaacgacggggaattataatcagcctatatgggtggtgtatccttttgaattttagtacgtacgagcacatcacacgacaaatactctattactgctacagtcaccagcgcaaacatttcttaacagagatattattgtactatcggccagctagcacttgtatacttttcattttggatcggttccgccctgaacggcattcatctctctctttttctcagtgtatactacagaccgagtgaaaaatagttgcaccgtgcgcgtgggacagctcgcagtaattcttcttcaaaactagtactgctgttcattcatcagatgacaaaatgacaaccagcaactagctggcggcctggcgctgcagcacttggtggcacacccatcacgtgcctgtaacgagaagaaaaaaaaacttactactaccacagtactattctctctaaaaagaatccaattggtggctaggattgagttttcttagacgaagaggttagctggctgctactccttccgtcctataatataaaggattttgatattttacttgtactgtttgactattcatcttattaaaaaaaatttagaattattatttattttttgtgtgacttactttattatctaaagtactataagcataactttttgttttttatatttacataaattttttaaataagataagtaattaaacagtacatgtaaaatattaaaatctcttgtattagaggacagagggagtagtagttatagtactccacgctccacaggcaacaacagtgaatactctccctcacgcatggataagttcaatcgctaacgttcgtagccctctgccccctcccgtccctagctgccctacccggccagaataaccagatgacagccaagccgtggagggcgatccgtcctttgcccagttgcccccgtgcgatcattacctccccagatccgagctgctcccaccctcccaccgtgtcacgatcgaagaactgcatgcaccatgcatccgcgaccgcgacggcgcggcggcaccgcaaccggccgcggcccatgcatatcccccacgcgcggttttgacgagccgcacgcaagccacgcgcaccggcaggttgccggctaccgacgagcgctccctcgcggtcgcgggcgggcggggcgcggtgtgccggtgtcccggcggaggcatgggcacttgtcgcggatgggatgcgcatgcgcggatctggggagacgcacatgccgcggcggggagaggagagacgtgacgcgcggtgcgggtttcttggggggcggaaatgaattgggggaggacgtggacgctgcccaagatctgcgtagcacgcctgaagtgccgttcccatcggcgaaacgcgaaatgatcgttcgtttcttctcatcgccgcgtcagcgcttcgatgagaaatacttctacaatactggcatgctgctgctacgactaacctaggctcgattcggcaaggctatgtaggagatgatattttgtggtggtatgaacgagccactcgctcgggtcacggcacatgaggtgtatggttgttggactgcagctctgcacgcatcgaggagagaaaaaaaaggctgagagcatgttcttcgctcagataaactaatctctttatgtacgagactcgctcttaaaaaagggatacgatccacatgcgaacagaataagcaacggggaattaatgatctagcataaaaagaccaagtaaagacgggaaatacatgggtggggtttgacgtcgggtcaaagatcgatcaacctgtccgtgtaccacatgtgctaaatcagggttccttgtttatcaccctgacgaaacaggacacaaaccaaaatgcactataactacgactcagaaatcagaatcctgctcaggggaaaacgaaagcgaatgataaagctggacgacgtgtcgacgtttacgggaacttcaaaagagagagagatagagaacgctaactttacagatctgaacgagataatccaaagcggcgagaaaaagaaagcgaaaaaaaaaacagaagagccaaataaacagacaagctgaaaaggctaaaccagtacagtactccattagcgacacagtagaagatcgtagagctctggaccgctaccacaccagagcagctctgtgctgcttctcttctcccctctcacacggccattgtcgacagcgcattcaagctctgcgtttatgacacccaggatgtttactgcatacagtggcacttcagaattcctatccttcagagggaaagtagagtgcatttacagccgaccttatcatcatctcctgatatatgcatctgtacatctgctgtatttgatgtgtggtccagggttgccaatgttcaattttcttacatgtgccgtgtttgatcaccaagatgcccaagtctctgaccaaaatgtattttgataaaaaaagaggagaaattttcaccctttctgctaaaagctaggcagaaactggatacacctgcaagtcccatacagccataaccttccaggagatagcgtcaaaagaccatacaggcatgtgcaaaacgtcctactattattgaattcccagagccaacaaaatgattcatttagaacgtatgggtgctaaatacaaaaagaagatatggttgaatacacatgaatcatgatctattttactagcatatcatatcacttcttgctataacaaatttatatgcctagtctagaagctacttgaattgctggtctgctggattaaccataggcaccctctcaattcttacaggctgatcgacgccgtccacggaaggtttgatgtaaagattgaacacaacgttggtgaatatcgtgaggataacaagtgcaagtgttgagaatgttacatacgttggagaaaattcaggaagttcatcttttgatccccgcccagttatcatatctcggtccatgtaagggtctgtttcaagcaaatcacagttagatcggagtccatctcactgtgatgttaacattgttaagaacaactgatcaataaaccatgatgctgatgcaacgtggtagctctcctaaagacaactggatgggttttcagagcaatagagactcaagatgcaaacattattactgtgtttcaaagctctgtctgccacttttggatggcttcatccccactgaactgttgctgttgtccttaggttcttcataaatgacaatatggcatgttgtgctactgcatacagaagcaatgaagcatttgtccaagtcatgggtgaggcccctataaacgttgcatacttgcataatgtcagaggtttcattaattgagtagtttcagtacagaggactgatccatctccaccaaacactttataaaaaatatttatatttgttgctgagagatctgtcctgccgaccttttaaagctcttgatctgatcattgacaaagttagtatgagtgagcctagtatgttgcataatgcattgaggtctccacgaacagtttcagccgattgaatgatccatctcttctattttaaacatatattccatctccaaatatataggtcattgcaggataactatggacaacatcttaaaactttgatcaatagtatatgtaaaagtagaacactatacatataattttgactacttaatcaatcataatctcattagattttttgggttaacgagcttgagaaaacgaagatgcttgcacgcacaaactagtgtaagtttaccactaaaagttttcagttgatatcaattactgaccctgatgaacatagtgaattgttgatgaaatggacacagcgcacatgtaaactggaaaagcaatttgccatgagcccatgagaggagggacgaggtaggcaaaagcccaacgggacgtacccggtggaagaggcggcgccggcggccgttccctgggctcggaaagcccctccagctgcgagtcgagctccgccagccgccgcagcgcctcctcagcccgcggctcgcgctcctcccccgaccccggccccggccccttctccgacgacgagaaggcgaccacgtcggagcaccgcctcctcccgcttccgcccactgcacgtgtgttatcggcgaggaatctcaagctcgctccgccgacggcgatcgccgggaacgggacgaagcggagatgcatcctcgccgccgcgcacagccgcgatgtggataacgtactgaaggatttcttttcgattttagcgagataataactgggctggatctaagcccaataaggcccattattatctcacgatgggcttagcccaaaatgggcccagttttagcggtcggcgtgggggcccataagatgggatctcgtgttccccaccggccacggccatcagattcgtcgtgtgtagcgaagcactcgacggaatccggaagcgaagcgagcggagaacgccgacgagcacaccaccgccgccgccgccggctcacggtctacccacgcgcgtggaagcggggcgatggaggcgtcgggatccgagccggggcggccatggacggtgtccgccacctgggctccggctggcggcgcggccgtggaggacgccgtctcgttcgagacgtccgccgacgacgcggaggccgtcccctccgccgtcttccttgaacgcccttcccctgatggcgacggcgacgctcctccctgcgaggtcactggtgagtcgtcgtttttgacttggggggtagcttagctctctgggcttgtcagaattttgcgagtttgccgcgggatcgcggtgtttgcgttggtccgatcggatgcaggtgcactcactgttgtgaattttagttttgcagcatctagtctagcttatggtcggataaaccctagtaggctggtagaaccaaccgaacctagtaggctggtagaatcaaccgaagtggttatcgctgttcgagttctagtgcgtgaatcattcatagttatcgttaaaatgttctaatgcgtagagtccatggattggaggtatctgttttagagatcctttcgtaacttgaggaatcgtttcgactttcgactaataccttaagataaaaattatgacaggttagtatgtcatataacggattcatttgctactgtctactggttattgtttgcgtgatactcttaaacttaagcttcttatgcttccatgaccagagcattcttaattgataactgatagtttgcgttactatttaggaaaatatctggctaagtttttactactttagatttgatttttccatcagtggtaagcggtaagtgtagatacctagtcttgtagtgaagctgttgcactgtgaacagtccaagcatcatcgatcatactgaagtctcaatgatgtatttgttcaattcctttgtactgtcaatttgcagaaattggagctacctgatattaggaattcaaacaatttattgaattggtggcatttctttttggaagatgaggattgggtgatattaccacagaaagctctaagcactgtatacttgcagaaattgtagagttgctaatattaggaaagtatctgtactatagtttcgtcatcctcatcaaactactactagtatttcttttatgaaagtaaaaggaactggcagtattccattgaaagttgaaacctttacatggaattctgtataaactacaaagcccatcgtgccgaatttagagtcgattttcttttcattgattcattgtataaatttcaagtcagtgtctcacatctcatagcatatacagcacagtacctagcatgatgaaaatctaagctatttttccatttcagtatgcatatatctgattcacagctgttcatcagttcatttcaggggaaagtatgagattcacagggtgtatgtgcgaagcacagctcggatttatgaaatatactatacaactgaccccaaggatagctctaaggattatctatgcactgtgcgttgtggacctgcagttaaagagccactcccctctgctgaagaaagtatgccccaatggagtagtgatgcctcaactagtgaaaagcatgagcatgaaaccaaaagcgtaagcagtagtattgatgaagatagctgggttgatgtcaaaatcccagagttacatgtggaaaagaacagatctaaatctcaagaacctaatgcaattggagtcaaacaggaaaccactctggtaaagccttatttcttggtttgtatcatgaaagattgttaaatactcaaccataaacttctgctgggagtgctcctattgtgatattagcttctaaaatttttctgtaactttgtttcgctatgtggaatgcaggcacactatgaagcaactgctgagataactgatgcaagcccatgtgtatctctaactgttcgcctcctttcacttcagtcaaaaacatcagtgcacatcgaggagatttacatatttgctgatcctgttgagccaaccaatgatgaatcagaaacacgtcctggaaacatgggaggtagttctttgttggctatgcttgtccctagcctcatgcaaatgtccaaatcaaggaaccagaaaacggacaataaatatttttctgatgcctcaaggactcagctttcccaaggttgtgcaatggcagtgaataatagtccatgtgaaaatgtagtgcgagatgcagagccgtgtagcacagatgatttaaatttcaagtcagcagggatggaaagcaaactaaatgctatagatggcgatacaataacttatgaaaaaggcaaccattatgagctaaaggattccaagtctattctattgcctatacaaacaacagaaaatacacaagctcctttgacaaagaaccagagtgtgtcaaatacagatcagcctgttactcctctcatggatgaaaatccaaatccttacagtcgcattgagggaaagctggatactcttctctctaagatggagaagatggaactatactgctccaggtttgacgatggtatgatgaggcctatctgtagcatcgagtcaaggcttcagcgattggaacaacagtttgatgtgttctctatggagattaagactttacaagcttcttctgcaagaatgacagccccagatggtttatctgatatgattaatccacaggataaaacagataatgatggtaaggctgaaaattctgcttccacaaccaacaggcagccaggtctggttgtcagagcaccagagttttctttagaagaatccttcagttgcgataagtccaatgaaaatgcagttaccttacgtggaccgagcatggtgccaaggcttcttgttaaggctcctgattttgtttctgaatctgagtttgcttgtgagaagcttcatgatgggtctttctcaccagttgattttgctctgtcttctgagaaagaacctaaaacttccccaggtttagttgtcaaggttccagaatttccaaatgattcagatgatgaattggaggaagagaaagaaacagaagttggtgatcatgatgatggtcatacaaaatctgatgctgctttgagtgaaagcactgttgacagcttcaaaagcaaatctcatgtatctgtcgatggtgctctagcatcagccttggaggcacttcttggttcaaccaagaaaacaccatcttcgcaatctgctgcttgccctgccagtaattcaactgctgaaaatactactgattcttctacctgcccattttcttctgaacaagttgatgagacatccactaatgatggctcggctggccaattatctggtacattcgttgatgcaaataaggtcaataccttcatatcttgtgaggaagcagatgcagttccacaaacttatatctctaaggcaaacttgaaggctgaggtaaacgatctgaataatgttctcgatttgaacatgatggcatttgctgaaagcacagaacccttgtgtgttccacagcttcacacagttgaggaatctaaagatgttggaagccaagcaaatctaaagaataatggctctagttcatacatgatgcaatccattgcaaacactgagcacatcatcgctccttctcagcttcctactgtcttggaatctattaatgatggacaacagttgaatggcaacagatctaccttgtccttggcagagtttcttgtggcaagaaatgctaactttagtaagaatgtgatttctgaagcattatctagtaatggtggtgctgaaatgcataccttcaagagaacatcgatggaatctgctaagaatataaaggatatcaatcaacttctgctgcagaaagctctagaggttaatgaggatgacagtgctaagttttctgtttctggtgggatgaactcttgttgtcttagagcctttactgattccaagaaaagatgcattgagagcagcggcttggaggcaagcctcaatgatagctttacaaaatcagaggtagagcactccttgtcagatttgtgtagtatggaatcatttagtgcagaacctgctagagaagctgtcggctcaggtggtgtcacagctggaaattgtgttgatgatccttttacaggtagttctactgtaaacccaactgcaggcgaagagctgcaaaaggtgtgtgacttgctttacgagtacaatgatgatgttttaggcatggctttcgtggcaaagaaaacaagtaagagcagcccttctctcgaagtcctacttgctgaatcatctgattcggaagcggaaatttctgatgcgaaggacactgacaatgatgctggcttaagttcagctaggttgtttagtacattctcgtcttcagatgatgaagctcctcgcactgatgaacctataattgatgtagttgatctgccaacaccattggatgcatatgcttcttccaagaacgagctggttgatgatgagtctttgcttgatatggatgatccgccaattcctccagagtcgtatgcttctgtcctaagcgacatgcatcatgcatgtctaaatgatcaatcaaaaccttcagggacattcgctggagagggcaatggagagtatcctgacagccttatataggttcaatcaacattgtcccacttgttagaaataagtcgaacatactcaaaaagcctcagctgcactactttttttgttggttttactgtacatatatcaacgtttgcttccacgcccatgcggttttctgtacatataagacttactgtgagtaaacaatttaccttttggtattacctgtgtacacttatcacctgtcctttcacagtttcactgctggccattcaaccttaagcagtcagcaagtaagcatcacaagaaaaggctgaaaagcgcccagatttccactctatacagttaccatcttgtgacttcgtcttttcacgtggttgacgaatatcctgaactaccagagaccgactcatcattccaaaccaggtatgacttattatgaggtaaattatgttcaccaccgtagagttggattgcccgatttactgcaactgtttcattcataccttctctgatccactgtaactgctaggaaatttctttctttctttctctaatcatgcaaccaggtatgtctaatgttcaccgtagagttggattgcacgatttactcgattgtttcataccttctctgatccttgtgatccactgtaactgttaggatctttctttctttttttcccctctaatcatgcattcatgcagccacttatttctagcaggtcagtttctggaacacgccatgttacgtgatgaaacacaagaacagggctacataatgtacacatgtgagcttgcttggcgccccagcggtctgcaccacatggactaatccttaattcctcatgccatgggccaggtgaaatcgtcgtcccacacggtacagctacagcattaacactgcagccggccagccttcgccatggcgtccaagttcaaggaaagcatggattcgtatcaatttgcggctcaactgaaaaggcgcggacgtacagaaatttcaggtatggtcggatccaaacttattaggattggtcgctttcttattggatgatactgtgcgagattttcccacaagaatctgtgcgtatacggactttggaatagagtcaatgcaccgcgatcacaccatcacttgtctaggagcactttcactgtgtgaccatatccaatctaaacagaaatatagccacaagaaaatgtaggggggtgctgtttgtcggaaaacacccttatcaaaaacattggtattatcaaactttggtacgataacaaattgaacaatgaaacagctccaactatcatagcgctaccaaaatttgataatttttggaaccttacactaaatctggtaagacctcaaaccaaacatcaccatccctatcgttaccttaccaagtaaagcaaaacttgttaagattattttggcatttctgccctttcgtccgtcgctcttctcatgcggcatattcgactcttaattactcggcccagacccaacgctggccttacaaatctctcgtttatcaaccatcatcaataaccttatcaaatttggataattatagaactttgcattctacatcaaaatctgataaggcctcgaaccagatgtcaccatcacatctttaacatattaaaatttggtaaggtttatttttattacaaaccaaacatgcgcataaatctcatcactctcttcactgtgcccaatttaaacggaatattttagtaagaagaaacatcttaatcttaccgcacaatggaatctgaatacggcttcagtttaactaagttatctgaatacggcttcagtttaactaagttaaaaaaaaactcgaatactccatattaaaaactgctataaaaatccagagatcagttttttttttaaaaaagcagagatgcagatgatgggataatccaactgtcgactggattgcaaatggcactttcagatatactggtaccataatagtactgtttaataactgcagttcctctcgaagtctcacctttgttagtgtgagagcgagctgatgtgacatttgacaaacaactcaatcctcaattcaggcactttgtcctcgatgtgttatttacagctacgcagtaaactcgtcaggacaatatgaaagatcaacacacgttctaatgctcaaactcaattattcaaagtgaaaccgccaaaccggtgggtcacatgccggaatcaaggcggtagggttcagtactctatgctcaagtcctcttcctaaatggtgcattcatgtccttttgtcaaaatattgttaagcacttatgaagccataaaagaagcaggacaaggtgccggactgcagagaaacttcactcgtactcctacatagaatgaagtgaaggaagccactgaaatggtggtcaagcaattacacaaaacaggtagctccatatcttgttcatattgacatacacaatccttgatgatgacaaaaaacaaattacaggcagctcttgtccccctcaccataagctataaggggcagagcaccatccaacttatgctatttacttgttctgtctgtccctcccaactttgcaatacccttatcaagcacaagaaagtaaagagaacaagaaaaaaagaaaaaaaagagaggatatgatgacagtacatcatacatgtggatacaacactaaaacgagagttccacacagcaaccacatcacagcactgatccctgcgtgtgaagcgaagcggtgaacgatcagccgccggcgccggcgacgacgacgacggcgacggcggcgagcaaagcagagaggaggaggaggaggggaagagggtggcgcggtcgctcagaagaaggagcgcttggatggcgccctccccacggccctcatgaagttggcgagctccagcacgcgcgccaccttggtgcccctcttcgcctccgccgacgcccgcttctcctccgccttccgccgcgccttcgccacctcgttctgcgccttctccatcgccttggccctcttctcctccagcttcctctgcaacacacccccaattccatcagaatccagagctcgattggtagaaatcaatggcgattagatgatggatttcgttttggtttcttgttttacctcgtacttcttgagccaggcgttggccttctcgacctggtcgccctcccagccattgatgacgacctcctcgcgcttgaagcggttgttgaccttggcgacctcggcgatctgccacgcggcgatcttggactccacctcctccttcttcacctgccccaccgacacctcgtcgccgtggccgccgcccgccgacgacacgtcgccgggggcggggagcgcgaggtgggcgcggcgaggggacgggatggggttgctgtccgggacgatggcgagcgggttcgtctcctcgagctcatcctccccgatcctccccagcgcgtcgtccaccccggcgcggctggagtcgccgccgttcgcggctgcggcggcggcggcgttggcgttggctgctgcggcgaccatggccgagaactccctgctcatagtagggaagagctcacttggggcggtgtcgctccccacggagcggatcgacgtgtgcctgctccccgcggcggactcccacgactccctcctccgccggtggtacgacgacgacggctggctcggcgtcggcgtcggcggcgggctcagcgcgtggatgtccctgaactccggctcctcgagttcatcttccaccaccacctcctcctccctctcctcacccccgctgcttctgacgacgatctcccggccggtgctgatgacaatctcccggtcgtcggcgccgcggctgctgctgctgctaccactagccgccgtttgttcactcaacatgtgtcgccgccgtgggtgaggtcgtcgtcgccgtcgccgccgccgccgccgctagtgctcagccactagcacacacgcgtaaccatcggcgtcttgctcttcttcctcctcttcgcttctccgagctgagctgtggtggtgagtggtgagtaggatcggatgcctagcttggttaaataggcgggagaagagggggaggtgggcccgggcgtgtcagtgtcgctgagccagtgcccgccattggaggggcagtttgggtatttccgtttcgatccccatttcgtgtgccttttgggcggcttcgtctcgctttctgattttggaggggtctgtgtgtgtgtgtttatttttggggggtaaggtttagaggttagagtgtgcaaagtgcgctgactcacacaatcatatagttttaacattaacaagcgccgtatgattattttttccctttgattagtagtacaggtttggattggatacgtcacccattttttagggcaaagagcgtgaaggttctagccttctctcttcctacatgtttagttacgtacttccactgtacgatcatgcgtcgccgtaaaatattttaaaatggatcgataaatattactcactccgtcccaataaaaatcaggaaatcaatctatgttgatttttattaggacgctaagttactttttatcgagacggagggattagttgttttttaatggactagattgatgttctaaatagattaattaatataatactccatttaggggcgggacatacgatagattatctaattttgtgatgataatcgactatacaaacgaatgaattaattgtgaaaaaatagataagttgttctaaaatattattctaaacagtttatatatagaaagtttttaaaataccatgtttctaaacttgtaaaacgtgtctacgataatctataatttattgaggaaaagaaccagcctcaaaccaattgctacatgctatagtggtttgggtcaggcggtgatgaggacatcctccactattatccgctggcagagacgctaaagtcgggcggcgaccgtgtgagcctctgaataatcccaccttgcttagctaatcccaccttacttagcttagaaggaggaagccaccttaaaaaggagagccacccttcccctaccggactagtcttttagggagattgggcctttccctgagtgggtgtgctaaagaactgttggggtccggacaaccttaagttattgggcctcggccgaccccacctgggccggattgttatcaggcggccgcaatgaccttacacaaaatatatggttaaatgaatataacatcattggcttcgacataaatggtactccgtttcaggtcataagatgtctccgtttcaggttataagatgttttgactttagttaaaattaaattgctctaagtttggctaagtttataaaaaataatattttttacaaagataaatttattataaaaatatatttaattattaatttaataaaactaatttggtaatataaatattactatatttacctataagggcccctttgaatcgcagggtagaaaaaacggaggaatagaaaaaacgcaggattctgataggaattgaagtgtaaaacagaggattgcaaaacacaggaaaaacacaggaatggtcgtttgattggagcgcaggaaaaacgcaggaatcggatgagaaagatagactcaaaggaaattttccaagaggttggagctcttgctaaattttcttcaaaatccacatgcaatgtgccattccataggaatttcataggatttggaaagtttcaatcctttgaatcaaagggccaaatagaaaaatttcctataggatttgaatcctatgaaattcctacataaatcctttaattcaaaggggccctaaacctagttaaacttaaagctgtttaactttgattaaaattaaaacatcttataacctgaaagccacggagtactactcatatgatgtcagcgactcagcgtatcaaatatacacatatatacccacccctaccgaacgaactacaagtcggtataaccggcgaaccttcgagtgattctgccgccgcatgcaaacgaagggcctgtttagatgggattaaaacttttaagtccctatcacatcggatgtttgaatattaattataaatattaaacgtatactattaataaaacccatccataatcttggactaattcgcgagacgaatctattgagcctaactaatctatgattagcctatatgatgctacagtaaacattctctaattatggattaattaggcttaaaaaatttgtctcgtgaattagctttcatttatataattagttttgtaagtagtctatatttaatactctaaattagtgtataaagacagggactaaagttaaatctctggatccaaacaccaccgaagtctcgtgcactcctgtcccgagagagttcagtcaaacgcattcccagcggataaaataaatgaagatttggtgattaggccgtgtcaacttcaccccccccccccacccccaccaaaaaaaaagaagatttacgattcaaatgtcatcaccgaattgtttactggttacttcgcgagcagggaggcggtgagttacctacgtagtacgtgtgtgctggtttagagcaacgttgacagcgacgttttattaattcttacacacacgtaagaggtactactaccacgtctcataataattcttacactgtttgaccactcgttttatttaagaaaatttagaattattatttattatttattgacttactttattatccaaagtattttaagcataattttttatttttttatatttgcataaatgtttttgaataagataagtgatcaaacagtgcaaacaaaaactcaaaatttctcatattactccaatttaacagaaggagtagtaattatcatcgtttgcatggaggcgatgggtaatcaaaagacgtggtcggccgcggttaaccccgtctcgctgtcacggagttaaagcgggtgtgtgttagcgaaagggggttaggattattttgaggccgttgcgaattagcggcggagccgtgtggggcccagcccgcttgcattatcctactactctattatacaccgggttaggcgcagacaaggtgggcccgggggtgtctccgcgggtgggccccacgggtggagatcgacggcggagatgcgtttggtgtggtgcctgtcagagatcagaacgaacaaacccgtcaggtgaggcgttggccg

SEQ ID NO: 4613 - DNA, 24711 bp, Oryza sativa
cccctatatcgaccagtatgccggtatggtcgtctactcgtctcatgtttcatgctgcgagcctgcaaaaatagtagtggccttttttactagcacgtttctacatcgacgacacaccacgtggccatgcctgcaacagtgcttagatggagattagccatgatcattgttactatggtgttcaagtgaataggggcaggggtgaaaacgagagggggaaacaccggagcaagttaccgaatgttactagttactacttactatttcctccgtttcacaatgtaagtcattctagcatttctcacattcgtattgatgttaatgaatctagacacgaatgtgaaaaatactagaatgacttacattgtgaaacggagggagtactcgtgtattactttcgtccacaaatatttttttagctacatacattcacaaagtaacgagagctacattaggtttcatgtggtgaaacctattcatctaagttaaagttctaaatttaatatagacaagaaaaaactacccatacgttacaataagtgaaggctattttaatatattattgttagaatttttgtctaaaaaatatatgggatttttattttgatagtattgatatctaatttggaacccttattaagatgatggtcatatcatgtacgcctgacgagaattctaaagcaattaagaatcagactcccatcctaggtttgcatgtgagtttttttaaaaaagatttcttatatgactccttatatattttcaaaagcgaacaaacttagaaaccaagtcaaatacgaataacatgctaaagtatcagcgaaaatatttttaatttttataataatggagaagagatagagataccaataccgaaagagaaaatgaggggaaaagagaagagattgaaagaagagggagagaattaggattatcgggaaaaagaaaaagagaaaagagtaaaaaaaaagacagtcaagggaagagcacatgacttcgagtggatgcacgcgggatggtacgggtcgattgggttgtgttgggctaggagagggatgggtgggattaggctggggaggaggtgtacagtactccatccatctacttttgataggtatatttccaaatctgaaaaatttacttttgaaatgcatattttaatccaaccacctatcatcttaatgactttctcggatttaatgcgtgactttccattctttcacataagactggttacatgggcatcaagaaatataaatattaatgaatcgattgtttacgatgaataactagtaacatgtttaaatggatgataagtagaattacttatccttggtcattgtgtgaaatatgactataaaaagtagatggatggagtagttattttaggctcgagctgaactggatgcggacgacgtacaacctagacaccgataacgaaataaaattccgacaaaaacatcttcaaattttataatagtagatatatgatatgctctcatttacacataaacttttaagtaattttaagtttagataacatatctgttaatatctgttaacagtgaggtgtttatggtaatttcgtcaaatttaaaatatatccatttagtttcttacaagtgctaataatgtgtccctgtattcacaggggattagtatgcacacatgtatatgaatttgaatatctattgtattgtgcttgtatgagaaaaagacgcatggtcgtgtcgcttgtatgagtatacgtcttttaccctttccacgcgcggagcttcgctagctgtattccggctgtacaacgttggacgcacggccaggggaagaagagtgtagaacacgcggtgcatgcgatgcgatgcgatgagctcactcgaaccgcgaccgatcgaaacgaccgcgcgcatgacgatgacgtgcacgcacgtagcaatcagtcaaacacagccaccaaaaaaaatcacagcataatccaaaattcgtcttgcttaatttatgcctctactttgcattactttacagcctgtgaaagtgagaacgaatgtttttgtcacctgcatgccgctgatatttgacgcggccaaaacacacccgtctgccaaaataaaaccacacgtttttccctctacgaaatactacaaccgtccaaaaatactcaacttaaaagaggatgtaacctcttctgatacaatgtatttagacaaaaagctatccagattcattatactaagagcaagtttaatagtatagccaactaatagctccaatttatctatagctaatctagtagctcatttatacaatagttacgtactacactattaatacctggtctcacctgtcatacacatattgcgtctcgaagtccgtgctatagctggctacaaatgtatagcccgctgctcttctctctccttatttatcttattaaaatatgtttgcagctggtttataatctgctattgtacctgcttaaaagacgtggttgagtttttttaagaacgaaaagagtactaatcaggaaatttgaatttggttgtgacaagaaaaggatcttgttatcaagggtagacgtcatgagattgagaaggatcacgacatgtaaactccatgtcagtgactcggtcgcaatttcgcagtgcttaggtggtctttgaatttagggatttaactttagttttttatttagacactaatttagagtattaaatatagactatttagagaactaattacataaatgaaagctaatttgggagacaaattttttaagtctaattaattcataattagagaatgttttactgtagcattatattctaatcatggattaattaggcttaatagattcgtctcgcgaattagtccaaaattatggatgggttttattaatagtctatgttaatatttataattagtgtccaaacatttgatgtgataggaacttaaaagtttatagtcccatctaaacagggttagactatagattttgcagggggccagtgctggatacaacggaggaaacaaacaaagggaagagatggcaggaggtagtagtagcaaggatcctctgtaacaaccatatctacaacgatcgttgcagattcgactataatttgactggccccagcaggcaatggatgctccgagtggaggagcagggagttgcaatcatgactaagagaaagctaataggatttgtcaagtttgaagattttcgaaagagatgtcaagtatatatgaaaggcaatactgcaaaaatctaaaaatgtgccaaattaaggtggtacattctctcatacaatttatgcaatatctgatcaaataaagctcgaactctaagtagccgatgtattagaagattggaacccttgatggatttccctttcgatataatttggttaacagaatttaggtcgaatgtccataatctcctaaccttagagcatctgtagtgtgaacaaaaaatcgattttacgacaggagaaccaaatcatgcacattgtagctgtcgaaccgtaggtgtcaaacaacaaatcgaactccacattggagtcgaactgaaagagtaaattaatatactgtgcatgcatgcaggtacggttccagtgattggctcattccctttttacagatcccacaaaacaattttaacattatagctatcaaactgaaattttgtttggctcttctattagattgatcaaaccaaacactacagatgcccccagtgcctttgccaactgttagataagtgtagaattttgctttcacttttgaaatggaagtacactaatatatttgggaaatacaaagcataacttttaaaaaggccaaatgcgttttacactaaacttagctggtgctctgctccgctcacagaaggtgggtacgcagaagatcattgcggcagggaagtagtagtaggtcatggtcaaccttaaccataccctaccatgacagcagcagcccaggcccatcaatcgcccacaggccctgcaggcccgggcccactcgagcagaggggcactgtgaaaaaggcccagtcggccccaccacgtcatggggcgccatgcacgcaccggtcagacgacgcggttgtcggcctggccggggtgcccagccacgtgggcagcccgcgcgctaccgacagcggccgtgacccgcggggcccggtggcgcgcgctctcgcgcgcgcgcgacgtagttgagaccacgacgccgaccgatggcgagcgcgcccgcgcccccgccccgcgcgcgcgccgcgccagccaccatgcgacgacgtcgtacacgcacagcgcgccccgggcgcgagcgcgcgcgctctgcagcgtctccgccgccgaacgccatgccgatcgatgccgccgggcgcgcacgcgcgcgcgcgtcaccattgtgatcatggcgcgcgcgacgtgacggcgacacaagccaatccatcgctagcgactcgcttagtactattaattactccactaactagcggcatgtacaagaagcggtaggagaaatatcgtgtttctgtctaatcttttctgtggttgtacgcttgtttaatcctccttttcgtaggagttaatgacgatagggctcgatcagagaataaaaattgggttggtgcgctgatcactttcgcggcgagtgttgctgacttgcagcaacgcgcgccacttgccgccgttcggttggcctccgcggcgggggatgataataatggataatgctttatgcgagatacggctctgttggttttgcatttctttttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctacacggctggcctattatgccgccgctgttgggcgtctacgacttcaccgccggcccgcctccgtcgccgccgattggtgcctccgcctacacggctggcctattatgccgccgctgttgggcgtctacgacttcaccgccggcctgcctccgtcgccgccgagtggtgcctccgcctacacgggtggcctattatgccgccgctgttgggcgtctacgacttcaccgccggcctgcctccgtcgccggcgagtggtgtccccgcctatacggtcggttggtcacaccaccgttgatgggcatcgtcatcttcaccgccggcctgcctccgtcgccgccgattggtgcctccgcctacacggctggcctattatgccgccgttgttggatgtctacatcctcaccgttggctcaccttcgttgccgtcgactggtgtttccgcttacacggctgacctattataccgccattagtgggcatcttcgctttcaccgtcgaccgccttcgtcgccgccgactggtgtcttcattattattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctaacacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgtttccgcctgcacggctggcttattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggctgcctcgaccgccgccgactggtgtttccgcctgcacggctgacttattatgctgccgttgttgggcgtctacgtcttcaccgaccggtcgcctcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcatgttcacttcatcacggcgatgcaactttgtcatcatagtggagcgacttcatctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgatctttcgttgttgttgggcgcctacatcttcactgctagctgacctgactgttgccgactggtttcttcgcttccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcagctcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatgttatggcttaggctgattatatattgtggtcattttctaggcggttggtaaatcctttatgagtttatttactcagattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacaccctggttcttctaaatgtcctttttccccattaccgctatgatccggtgtaactgcacaacagttttaaaattaaacatttaccaatattgtgtctgaaagaagtgcgcgagacttaacatggatttgaatcagatgtgatagtgtgactgcaatttatgcaatctatgaccgcttattagattgggtccaatggtcaatatgcaccctggtagtgtagatcactgtggcaaaaattgtttacttttgtgttggcactgtagccaataatctggttcattcatcaacaaaatggatatagtcgcaattgcgtgccatagcttaacttgtaggcggctctattaattcaaattgtgccttaacgtagcatagaggtggacaaaaagcgcaaagctcatggcttagatcagcttgtagcgatctcgactcagataggctcgaactcgtaatcttaatgagtcaggccaggttagatttttaactcataaccttaacgagctaactcgcgagctcctcgtttagcttgttagtacaagatatcaccacatctttatatacttagtacttcttaactagtgcttagatttttaattacatcaaaattattcgtatttagtgagttcttcattagtttgtgtttattattatgttaatatatgataaatttgaaattatcgatatgatataaatgagatagagcttgttaacgagcctaatgagcttaacagctcacgacccgaaccgagctagtcttttagctcaatgttaatgagccgagatgactcgtactaagataacgagttttaacgaattgagccttaacgagtctagctggttcgttatccagccctatttagtggtggctaacgagccaactcggctcgacttgtaaaaactcgttaagttagcgagctagctcgggttgacttgttaacataatgagttaaaaatggaaagcgactcgacttgttaaaataacaagttaaaaatgaaagcaactcgacttgttaaaaagcccaagtcgactcattaaactcgttacatcgaaatacatggtttaaaattcatatacatggggcaaagcgaagtttgtccctcgcgtcgacctcgcgcggcggctcgggggcgaaaccctagccgccaccgcccctcctcctccctcctccctgcttcgccgccgccggagctcgtcgccggcaaagccgggcgacgcgctgggatggcggcggcggggtaatctccctcgactccatctcgccccggcgcgggtgtggcgacgatggcggcgggacggcgaggtcgcggcggcgggacggcgaggtcgcggcgatggcgtggtggtggggctccccgcggcgatggcagcgcggcggtggggctctgcgcggctccgttgagggcgtcgccagatctggtagccccgccagatctggccggggtacgacggcggcgcggcggcgggtctcggcgtggccggcgacggtctcggtcgacgccggcgccctcggacgtagcaggtggccagcagcttcggcgcggtttcatcggcgacgacagcaccgggtcggcggcggtgctccggcgccggctgccgcgtggtcctggccaggggctgccggcctgctgcggcttttgccggcgacggggaaggcgcctccatctccctccctcctggtcctccagatccggttctccccttcttcagtggtgtttcttccggtgctctctgacggtgcggcgtccgctcccctcttcttaggtgctcctcccttcttaggctaggctgcttccagtcgatgccggggagttccgtggttcggtaggggtggcgtgcggagttgtttcggcatcctgttcgctggtcgtcggccgcgccgttgtttccctgcagctgggttcctgggtgtgaggtggtctctggtcgagctgcagggttggctgttgaggtggagttggagctgcttgtcttgcaagctcggcaacgatgaccctcaacgaacgtcccggcaacgcgacgagggttttgaggtggagcagttcgagagagccttaggtgaaaaccttgcctagtgtcgtaggctctccagaccttccattatatttgagagatgaagtgaataattcaagtcatcaaacaagcataatgaaacatccgacgcctcgagagaggaattttggagacattgctgggcccttagcctgccagtcaacttcagcctgagatgtgcccgtcaaaccactcaaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccctattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaaggcaatatgtagttcaatttcagcatatagcaagttttgttttgcaattcttttgtaaaggaggtgatgcttcaattaacaaagacaagttttaagtttcattattaacttcttcataattccatcataaacaatctcttattgccatacttaacaataagtcataatgtatcaccacatacacaactcaacacatttatcaatttcaaaccaatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctggaaccgttaagtggcgggcccacgccttaaacttaacgccgtggtagcggacacgacgggaacccaccacgtggcacaataccgttgtattggacacgcttagtcacctaaactaccacgtcggggtaaataggaagctcctctgaattatacgaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatacccatcatattcattttattccagcaaaggttcaagtatcaaaaccacattttaattatagatggaatgagcatttgcatatttctaagcatggctaagcaagtaattgcacatagagcatatataaacccatatgagcacaaagagtgtactctaaccatttctagggttcaaacagcaagaggatcaattattcaaggtgggttatgcagcaaataggtcataactaccttaacccagtttcaaataccgatatagtctaagttcacatgcaactttgcaaacaaatattttcattcctcaaatcatgggatccaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcatgatttatgcacagtgggttggaaatgatctaaaatgaatttaggtgaaataattcctattttattttattccatttgggagttatgaattttagaagttttatcggtttacaatagtatagtcttaggtagtgttatgaaatacttttgtaaaatgatttttattagattagacttcacaggggtgtggagatgtgttttctaagactaacacatttggtttcacaatttttggaattataatgaattctttatgcattttacaagttataacgtgttttagacatatagtgttttatatgttcatgacttttgagttataggttcagaacatgctacttcctgtttaagttgaataaaaggaataatttggttaactaaaacatttttatctcacatgtttatggtctttactactatggttcatattttataaagtagagatgctttaatctaaactagcaatatattatattaacctagaaattgttatatgagctaagttcttctaattttagtggatggaaatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctatgttagtaaatccttatatgaatatttagagacttttactacacagcaagtatataatcttatttcataacatggaaatacatgttttagtgatcctacataacttaagtttattcaaattgaagctaaattgggttctacatgaatttctaaagtttagcttatctaaaactaatcattatagagataatagttttagaggcatttgatgcaaagtaagtaattacttttatttcacttaatcagagactgtatgatgatgaatctgtagaatttgattttgtttcaaaatgagttgaaatgaattttctatgtattttataagtttgtacatgttttatgtataacctatcttagataaattttagagacattatttgtacagtgagtgtcaagttttatattcctggaataaagttcataacttcaagaatctacagcaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagaactagccatggctgaactcgatctggagctcgccggcagcaaacggtggctcgtttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgtgcatggaagtcgattacgaatgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgtgcaaggaatcgaacaatggctcaccgaggcagcggtaatcgacgatgacggcagaggcgatcctagattggcgccggtgaagaaaaggatgtgttctccgtgttcttgatgtttccggctggggttcttgaggcgttttgaagaggaggttgaggtgatgacaatggcgcagcggctttctctgaggtggatgagaatggccggacgacaacgatggttgaagcggcggcgctccggtgcgtgctccagggcatcgtcggcgtggtcgcgttccggtggctgtgatacacaaaacgggaggtggtcaaaagagaaatggttcggcactgtgtggagagaagggaacgcggaaaacctggagatgacctttacccaatcagcgatggcgatggtcgtcgtctccacggccggcggcaaggtttggggcgatggagaggcagagaacctcctccctcggtttcttcggctctgagtggtgaatggagaatggcgacgcgtctaggaggagtagagagcgagaaaaaggaaaccgagatcgacgacacgttgcggccacgcgtcggctcgctcaatctctccctctctcggctggagcagtggaggaagtgatggacagagctgaacctagcctaaggcactgacaagtggggccaactcgatggaaactaggccagggagagagatatgggtagaagactggtaaactggatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcactgatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacataaatttttccatgattttatcttgcacaaaatattttagagaattaagttgacctttgtttgtatatgtgttcccacttcataattgcatctaatattattatagggattacattaaacttcttttagactgagaagatgatatttgagtttaatattaagtccacatgttattacccaagattaactataggtttgtttagtgaagtaattcttttagattatgctcatgggatctattatggaatgcaagaccaaaacttcaaatgcacaaagaactcgagcctaggcatgcattatgtacatgtatgcttggtgacatttctagtctaatgttgggaatgaaaatgttttattttgttctcaaattttaatcatgcaatggtttaagttgatcatcacctaaattaaaacggaaatttttggctctcaaaattggagaaattaacctctaactattttgataagaaattttaagtcctaaaatttcgggtatgttacacctagtctatcctaggttgatgatatcgacgcttgtgggcgccgtttcctccttggaggtgtcgtcatgttggttctctcttccttcaggtgaaaaccgggttcctttcggaacgggcgttgacagcatccttaatgttgtttccttgttgaaggcttcgctcagaaggtatttgctccactagaggatgtttggtggttctggagaccttgtcattatgttgtcgaagctgcttgccttttggtaagctcggtaacgacgacttctgtgaggtctcattagttgtttcttttcttttctgtattggtttttgccggtttcccgtttaattaaccgtgcttgtttggttttcgggcccggtttcccttattaactgggccaattctcttcttctataaattccggcaggagaaactcctgccgtcggttcctcgaaaaaaaaattcatatacatatataaatcatgatttgtgagcctatgaccaaagattatgattgtcgtgctatgtatcatgactaacaatacaaggaataattacgagtttattacgacctttacactggcaaaatgtggacaattaacttatatcttaatacatcatgcgctcaacgagctacctcgagttgtctcattaaacaaatgagtaaaagttcaaactcaactcaactcattaactgccaagtcgagttgagtcgagaagagttttacacaaattaaattggggcaatagcgcttttgaccctgttctagaacctaccaatttgaccatactttttcaactttgctcatttgaccctcgtttttaaaactgaagatcaggtctgacccccttctgttaaatcaacgtaacggtgtgcccttcttattcacacgtttgtgccgcctacctccttgtttggaacaaacaggagaagaccgcgtcgccatcctcttcgaagcaagaaggagcatcgccaccacacatcgtcctccccgtccagatcgaggaacagcgccgccaccgtcgccgtcctcccgtcacgacgcggcgccgccacggatttactccctccgtcgccgccgccgccgctaccgtcttccacgagctggcgtgaccgctccctctctccacgagctgacgccggcacggatccgcttcctccgtgtccctccgccgtcgctgctgccttcctccacgagccggcgcgtccgctcatccgccactgccgcaactcgcccctccatgcgccgccgccgcacaggatatatgagagagagaaacggtagtgaatgggtaggttagatgtggattggtttccttgagggtagtttggtcattacagtatttttttctaaaaaaaatggaaccttaacagtgcggtggaaacagggttagacggggtgttcatttttgaaaagcgggttcaaatagcaaactagaaaaaaaaaagctagtttagtagttagtctttcaaatgaggtcaaataagtaattatcccaattaaattagcttacgagtttcgagatttttgaccaacccctattcacacatatccatccagcatcatagacccggttaagcccctcctatttgggcaggcctacatcccgaaaaggtgctccatggaatgccaaaacgcacccgtcccggttcccattcccattcatagctatctaccacctttttcgatcgttacgcaatgctcgcgcaataacgaaatctaccgcgtgccataccgccacgcaactagctagatgccactcactcgaggttagttaggcatgggcatcacatagcaaactggccatcccatagctttcctagctcccacgagacgaccctgcaccctgcatgcggcagcacggcgcacacgctcctttcttgatcgtgcgcgtggagcccagacgtgaccggccggaacggactccggcttggttcgcccttgcacagcactgcacaagcacaacccggtcgatcaatcgatcgatcagtgagtgccgaatattccgcacctacacgtgttcaccgttatgcgatgcacaagtctagctagtgcacttgaggaataatttggatgcatgtatgctgctgctgcgctttcgaatgtcaggaaaaaaaaacacatgggtgatgatcgagtgaacaatgtgtctcatcaatcagctggccctaaacgaacgaaccatactctgattgcgtagcaagtaccgtgggtgattcgattcgtggatttttcgttcaatacaaagagcgctaactggtaacctggtgcgcttagataggagtaatcagataccactggttatctggtgcttagataccacaggttggtcgacaaatgtccagaccgtgtacacacctgcacgcaccaatgtggcaatgtgcaaaacacccggcctcaacctgtcggcaaatgccctcgatcggcatcaattccctaccaccacgtacacccccgggaaacggagagtgaccgtcgagccgctgggaggaggaaacaacaaccggacgagaagaaagaaccagagctcaagcacccaaacaaacaaaaagttcccggttgaaaataacctgcagtagcttagctactagtagcactgtgagcactagctttgtcctgttccaatccatgtcgtagtaccgctggtgatgctggtaggaccggctagatgcaggccggatgcacctaccttcctccccgtaaacaaacacgtacgacgtgccagcccgggacccgattcgatcgaccggatcaggcaaaaaaaatcataccagcacgaaaagcaagccaaccccgcgaaagcggccgcccggcaaccgccgctccgttcgcctgcggccgcagcagcagccgcagcgaccgtacgctaggaaaaaaattttccgaacggcgccaaacgcgcgaagcttccctccgacctcccccgccccgtctcgccctccgatttggcgcatgccgtgcaacgcaccggccgcgtgcgcgtcgcgtcggggacgagacgagacgtcatctcgcctcgggtctagctagccggtgcaacggctgtttcgcccgtgtcccctcccgcgcgttggctttcgttcgggccatctgatgatggggatcacgctgtcacgcagcacgcgccgtgcgtggcgcggacgtgccagaaaaatgctctcgcgtgcgtgcatcaacgcgcgtttcgggtggtgtgtgcccgtgtggagtacgtatacaacctttttcctggttcgcgtcagtgcttgggaagagataactgttttgtgttacatcaggtgaattcagggtttttttatggcaggcagcacgttcacgttaatcggggatagactatcacctattggaattgtcatatgcggtgcatcggtgtgaattaatatctcggttcgtaatcgtgattggctggtgcgttcgtgcttactttagagctcgtcgtgccgggacaagatgtttcacttcacggtcttcacgtccgtgggtgatgacgtatagatgaaagcctaagaaatttagccttttattggtcttttgtttaatcaacgaggtagctgtcgagctttaggggtgccacgtgtacgtccaacccagagaaatttagccgtggatgtagagccgctggtgaaatgatcgatgtttactggagttacgactaggtcatttgtttggaaaagtaaccactaaccagtcaaggtcactggccatctggctccacctggacagattggacgcacgcacttgaagttttgaatagttcatgacgtcttttttagtgctttcttctctaaatctaagatgagcataatatatactgtaaaatttggtcaaatcacgtgtaggtgcaccagatgatgtaggagtaattatgtaatgcaccgtgcgtaatcggttacggaactgggtagtaggtttaccgaattgcaccaatccattgttggactagatgatgcaatcgccttgtgagcttatttacgaacaatatgatcttatattttctccgttcaagtatataagggatattggcctaatcccttatctaaatatataagcaattttacaatcccaagacaatgtttatcttctatccatcaatgaactcatgcactagtttaatcctcacttaacaactttggtactactccctccatctacttttgatagttatattttcaaatctgaaaaatttatttttgataggtatatttcaatcaaacaacctatcatcttaatggctttcttggatttaatacgtgactctcaattctttcacataagattggctctatgggcatcgagaaatgtaaatattaataaatcgcttgtttacgaggaatgactagtagcatatttaaatagatgataagtagaattatctatcattggtctgtctgccaagataacatatgactatcaaaagtagatgaagggagtattagtttattttttcaacctttaccttatgtactggtttatttcctcaaccatcatcttttatactatgatttaaccctcttttaacttccttaattattctcaaaatggcataataccatgtatttaaagacagagagtactttgatcgcagatcattcagaaagaaggtctatttttgagatgattcaggcagaaagtttcttttttttgagagagaggaaggcagaaagtttcgactttcgatcatctggtagcaaacccagcaaaacttcagcttacaaggtgagcgtgaacccgacaggtcgtcgacccttcggctggatggagcagcagctaatcgcggttacacctttgggccctttcctcggttgggccactggaaggccgtagtgctgctcattgtagccattgggccagtgtcacatgggcttacaatgaaaagcccatgttctccgaatgaaaaaaacgtacagaagcaacgccgtcttttcagctcggatgtctgaaaactcctaaaaccccaaagcagccagaccagtacacacaccattttgcttgtcaatggccgccgccgccgccgatcccctcgtcgccggcgccaccgtctcctccgactccgactccgactccgacgatct

SEQ ID NO: 4614 - DNA, 15011 bp, Oryza sativa
tccctcaacgcgcccctcctcgacgcccgcggcggctccgtctccgtcgtcccgctcccgtggggcgacgccgccgcgatggaggccgtcgctgctccgccgccggcttctcggttcgacctcgtcgtggcgtcggacgtggtgtactacgaggcgttggttgaccccttgattgagacgatgcggttcttcgtcaagggggaggtggtgttcgtgatggcgcacatgagaaggtggaagcgcacggacaagaagtttttcgccaaggcgaggaagctgttcgacgtcgaggtggtacacgaggacccgccgctcgaagggtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacgaggaactgacctttttcttgttaacatgcaaagctatcaatatattgaaagcgagaaaatcagtacattacaaattaaccccaagagaatgcagatacacaggcttacaccatgacatttagctatgaaacaataattgaatcagggatgttcacagcatttagctagagtcaaatacacgtctgtttgcagttaaacttgagtgcctctcaaaaacagtcagcactgcacaaaggcaaacatgataacacaataggaatacacggcaaacctagtaaccaacctctggcaaccgaacagagggaggggcacaagaatcattggttgcactggacgagctcgtatttccataactgttcggcctttccagctccttcagtgtcccattagatgactgtgaaaatctgcagagagaaattggtggtgcaaagtacattgccactggcatctttggtggaaggtctggtaatggtgcttcaaacttcagtacgcttatgacctggcgaattgaaggccggatattataatctgggtgtgcacaccaaagtccaacaaccatcaaggaaataacttcccgctcttcaaattcaccatcaagccttccatcaattgcattaagtatctcatttcttccataaagatcccaaacccattgaaccaaactgatcctgtcattatcttcctttggcacaacgggcctccttccacaagctatctccagagcaagaatgccaaagctgtagacatcagtctctttgcttgctttcccagtagtgacacactctggagccatgtaacccatggtcccagctatcactgtagtttgtgagcctcggtcatggtctacaagccgtgcgagcccaaagtccccaagcttagcgttgaatccagaatcaagcatcacattgcttggcttgacatcacgatgcacgacacattgttcccactcctcgtggagatacaggagggcggatgcaacacctatggttatcttgaaccgcaatggccatgctaacaggtttccaccatcataaaggtgtttgtccaagctcctgtttggcataaactcgtagactaacaagaactctccatgctcatgacaccagcccacaagttgcacaagattccgatgccttagtctgctgatgatcttgacctcagagatgtactccttcctcccctgtgttgacccttttgcaactcgttttatggcaatttcaatgttttgatccttcaagaaaccctggtatactgcaccgaaacccccttctccaagctttctctctgcagcaaaattatccgtcgccactacgagttcattgtattggaatctccttggccccttgcctttctcaaactcactgtcaatggactcatcacagtctagtttctctttttccttctctcttgaccttgtagtccttctaatccttctaaaacataaaaagaagcaaaccaagccaattgagcagaccacaacactaccgctcgtagacaagcttatgaccaatataccttttgttttctcagtcttcatcaggtgcacatctgtagaatcaaattcccagtaaagaatctggtgcagctctacaaatttacctgtggaagcagagaatccgatggacactttgtcagggagatatttgctgagatcaaccgaataagataggctggagttgccactgaattgtgggttgtcctggtacgacaagaagacactcaagttccttgaatttgcctggtaagttacccaagcattggctatccggccatcgttgatactacttcgccatgtcacgttggctacagatacaattgagtggatgttgatgcctacatggttgccatctggatcccaagtgtttttgtggctgtcaaactcaacagccacaatctggttgagtggatcgctctgatcattactattgctgaagaggccaagataaccatccatggagttattggggaccacagaagggtatgatgagaggaagaaggctaggccctcaccgtacgaactgtcgttcgtgggtgcatatatcttgaacgtgaagcgggttgtgaagctggctaactgaccggtggtgctatcccagagaggcactggatcggtgtagattgctcggcctacgctttgagtgatctttccattcaactcatccttggtgagcttgaccgccttgttgtagaaggcatcctcctggagctgaattgtggctgatccattatgatttgattcagtgaagttcaacttgaaggacagaggattgacatgggcaattttcagggatagggaaaagtagagagccaagaggcaagtatatttggttcttgatcgcatggttggaatcctggaggctggagagagagcaggagggagagatggaaggaaggaaatgaaaagacactacttttgcagacctgataacctggataaccattaacttggtcaatctccttgattgactcagcaatacttggtgctattaaagggtagtatcatactgccggcctgtcaataggccctgaaaggacagatgtaagccacaggagaagcagctcaaatttggaacttaactaagctttccaaaaagctagatgaagcttggtttgtatcgtctttgccggccaagattattgaagtcaagtatgtcttgcccataatatgattatggtggttgccggcagaaaaggaggttatctcctcttagcaaatggaacatgtattttctaaggcagaattggactgagttcagacatgcacagaatctgccaaaaggaaagctcttatcgatcttatatgcttaacaaactgggtcatgatgtaatttttgtctttcatgcggcatacaacaatttcatgcagcacaggagagtttattaatacatatagcacaatgatttaccttgtccttagggatcagttcgatgacaacttgacaagcagtaaatatttcttgactgtaatctctattctggagttggcacaaatctattgagttatggcaaccaagatcagacggcagaagtgaagtatatggcactatgatatatcttgcttgtgcactgaaaaaagggttcaaacatggaaaattaacaaagcgaccacagcttatgtatttcgcatagtgtgtagtacacaaggatcagcatcataatctcagtaactagaagaaaatatacaccaactgttctttttactaggagaatatacatcgattgttctattcatgcagggctacttatatacacaaatgattaactcaaaacctgcaaggaatattcgtaaagtacattattgagtggatctgtcatactcaacatgagtttcaagtttgctgccatgaatcgatcgttcatttcgccgtgtcgctggtgtttgtgtcgtccgttggccacgctacagtttccattaacctctgacgcattatctccagattctcattcgaaatcttctcgtacatttttgcatggtcacatttctgcattgatgaagaggtaactaattaaataatttatgcatcaaagatgtctcaaattactctggaatatctcactcttttttattaccttgatccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgccggttcaaaaaaaaagaaaatcgaaatcagtagtgtacacgcaccgtgtgcacgtcttcgaacccctcctcgtactgcccggcgaactcgtccacgatgacgaggccgcggcggccgggccttctccccctccgccgggccggccgcgccaccgtgcgccgccgcctcaccccgacgacgacgccgcgggaccacggcaatggcgccgcgcggcacgcggaggaggatgaggacgaggagggaaggcagacgaccgcggcggccatccgcgcgacggcagccatcggcggcgccgcgaaggagagctagagatgttttttttcctcccgacggctcgacgccggctgcgacgatgcgagccgcgggcggggttctggataggcagcacagcggggattttttttgctgaggctttggctgattctgtccgcgaaaacagcgcgtttcatgggcttcctgagggcaaacgggagaccccacgttcgcgccgatatttcgtccggcagctcgctgattgggggcggaatggcgacgagagatgattctatttgcctctctgtattttcgcgattcccttgattctttttttttttggcttcagaagtacatttctctttcagccttttccttttttttttgagaatattcacttttagctttttgtgagaatgtaatttgtggaatgcatgactgccaccctaaaatatcttttctgatagtgaacaccaaagtaagggcacttgcgtatgtttatcatagtgaaagaattcaagttctacatttgatattaatgtttataagtacattatttgatattaatgtttataagtacattatttgatattaatgtttataagtacattttactacaagacatcgcaaattcgtgattttagttatgggacaccacatgaaatcacttttggggtaagacactatgtaatcttggttatttgctaacgggcacggctcccatttatttagcgttttagtgttgactatgcaagagctgtccactttttgatgcgctgtgaccaaattgcccctgcccatcctcaaattgactcacctatcggctggcgccgctcttcgtcgtgcagttcatccatctcgcttcaatcctcgagcttcgcctccactcactcctcacctcagacactgtcactccgccgtcaccgcatcctccccaccagcctgctctcctccctcccgacaccataggcgccacccgcacccacgttggtcgaggcgcttccttcccctccaccaccgcaaacctcagtattaggagcaggagaccagcctctaccatggtgttgctcgcacccacatcagtcatggcgcttcctcccctccactaccgccgttgcggcggtagaaccagcatgacgagaagggcctccaccacggcgccacatgcacccacattggtcgcgacacttcctcctcctctactgccacaagacaagcgccgtcgcgagcctagcaggagcccaacccaccgccgtcgcccaagcccccttccgcagaggagttgggctagggtccacctacctcgtggaggtcatgtcggcgtggctcgtcagcttctacctaggagcctagcaagggagctgaggggagccggaccaagccgccacagcggaggtggaggaggcgaggagggagggccagggtggttgctgatggcgagcagaggtggcactgtggctggagtgtgagaaggactgacctagggatatttttgacgtttcatgttgtttatctctcctatttagccggaaattaatattttaatgactatggtgtccataagaaaaaaaaccacattttgagagtgccttcccctaaagatcgacttttgacgtgccctagagttaaaaaccacgaagttacagtgtcctacagcaaaatttgccatgtttatatgagcatctcatttgtactatgttttgaaaaaaatcttgttctaactgagactttagcttagaccctgtcacgtagaatgttttgatactaatttagagtattaaacatagcttacttacaaaactaattgcataaacgagagctaatatgtgagacaaattttttaagcataattaatctataattaaagaatttttacggtagcatcatataggataatcatggattaattaggctcaataaatttgtctcgcgaaatagtccagagttatgaaataggttttatcattagtctatgtttaatacttctaattagtatcaaacatccgatgtgccagggactaaaattttttaaccccatccaaactcccccttaagaagcccaaatccgaacacaacgctttgtagctgactagcttagacctgagggcctgtttgatatagctccaactcctaaatataagtccaggagtttagtctggagtagagttgtggagctgcctaaacccacctccacaactctagtatattttgtgagagagctccacccaactccattcctaattttggtggagctgaaactgtttggctgagctccagcttcagaagggatggagctggagctgaagctgtaccaaacgggcctgactctgagaggaaaggcctgactccacggtccacgcgcaccgcatggcgtacgcgcgaaatggttcacggactcgcggtcatgcacacccgcgaaaacctgcgctaagcaaaagcaccggaaaagcaacggcacgagcccgtgccccgtgaggcaatgaaccaaattggcggccgcgtcaaccacgccaccgggacgcgcgcgacggcaagaaaaagaagtcgcgaagtcgcggattctgcaggcccccacgagaccacggtttcctacggccgatctcgcggggacgcagccggagacgacgcggtcggtcgcgtcgcaccccacgccccggccggttagtggaccgattcccgcaccggcacaccgcgcgcgcaccgcgtcttcttctctatcgcgacaagtctggcttggtcatcgcgtgagtcgatcgcctcgttgctttccgtggccgcgtccgtcgccgcctcgcgcaccagcgaatccggacgtcgaccgctgcctgcggatgttgtggacagctcacagttggtgttcctctgaatgcacaggcgccgtggttcctctcacttggtgtgcaatttaccgtgaaatcccagtgagatataacctacgtcttcgtaacggtctcccgtcttaactccgagtctctgactaaccgtgaacctgatgatgcagttgctagcctcatcgcgtgcgacgaaatatcaaatgatgtcgtccgtgtttagatgacttcttttgtactcctgcactgtctgtcgatgtcatggcagtaggtgcctcctttcaccgactccacctgctccagaacaaagcaggtaccaactgttacaaggaaaaaaaaatctgtattttccaatactgtctatttttattatcttgctttgaatactaaccgggtatttattttggattatagaaaagaagtacacaccattatgcacacacttcaaatattcgtaagccagtagaaaacggaattgtgcaggtggcaagcattctcttttctaaaaaaaaaatcaatatcataaatcacattcatttttctaaaatatttaatttattattaaaattaaatcaagtagataataatacatggtaataattcaatgaataacccatgccaaatagagtcaacaacattgttcacgttttcgacaaaaacaaaatgaaagccaccaaattataaggtttcgacgttgaacacaagcagattctaagtaacttttcaaatgattttcaagaatttaaatttgaaataataaatttgattggaatttatcaaggttcatgaaaaccgtcataagatcgggatccaatgctcaattgaaaatgtgagaccctgccaacaacggctgtgtttagatccaaagtttgaattcaaacttcagtcttttttcatcatatcaacatgtcatacatgtataacttttcagtcgcatcatttttaattttttaaaaaaatttaactttacgctgaactaaagacagccaacgaatcaaagagggttatagccatcccggccgttttcggcccgggtcaaaacgttatgtatgctactcgatttcgtgcccccacacccttgacgagcgagccttgccctcttctcttcccttctctcctaccggcggcaactaccgggaagccgccgccgaccgccggagcggagtcgtcgcggcggcgagggcgaatcggtaacccccccccctccggagttccgggatggggacgccggagttccccaacctgggcaagcactgcagcgtcggcgactgcaaccagatcgacttcctgcccttcacctgcgaccgctgcgaccacgtacgtctttcccgtctcctcccctggccgttttcgtgtctcggtgcctcgttgccgaaatcggatttgctgctgcggtagtttttaaggaaatttgttcttctgtagattgtggaaccaaagaactgattcttcctggaatttttgcttgatatacggtttcttgaagtagatcttggaaagcacctagtttagggaaaatctcgtctgggctttagcctttaggacagtgatccatcacaatcgaggagatggagaagggaaattcatgccaatgcctaggcagcacgaatggagatctttttttgaccgtttggtggatgagagttgatgtgtctatcgttgaccgagaacatgatgaccctttcggtgatgctcttgcagttttgcgcccttttggataattagtttcatctactaattgaatgctatgtagccaatcacataattggtcagaattgttgcttcaataagaatgaaattgatctcagacaaaatctgaaactgggcttaagaatgcaatgggtatggtttcaaatttggaacggggaaaaggaggatttagttgacaaggagtccttcattgttagcttgttgcctatggttgaatgcacataatgataggaaaaaaagaactgaaaaacagtagtggaagtgtggtatttattcacaatgccattcatatctgtattttgtgccagaaacatgccctctagtcattgtactgtttctttgttgccctctagtttctttcgttgacatcacagcatgcagctccactggaatcatgacactctggaattacacaccatataggagtatgcgttattgcagtgttcaagcataactcatcctgagtagcactccaaggtcttgagttcaaatctccataggagcaaatttcagattgggttatttgagggctaagttccctgtttgataggctaagttcctaatttaaaaggctgcatatatccggttggatgtagaggccggataaaaaatacccttctctaaaaaaaaaagcataactcatagacattttgggttcaaaatttttccataatttattatttttgaatcctttccacttcatggcttcccgaatgtaaagtaacattgcatcaacatccaattggcagcactgacatggttatttgatcattgtttaggtcttttgccttcagcaccgaagttatacatcgcatcagtgtccaaatgcaaatcagaaggatgtgactgtcctcatctgcccactctgtgctaaaggagttcgcctgaacccgaacgaagatccaaacatcacctgggacacccatgtcaatagtgactgtgatccatcaaattaccagaaagtaacaaagaaaaagaaatgcccagtgcctgggtgcagagagacactgacattttcaaacacaattagatgcaaagattgcaccaaagaacactgcctgaagcatagatttggacctgatcacaagtgtccagggccaagaaaaccggaatctacattccccttcggaaatatgcttaggagaagtcagaaagcagaatcatgttcaaattcaaacagcagtagcactagttcatcctggtggagctctagtcttcttaccgcagcaacgagtttcaaatcatctgctgaagctgggatgcagaaattgagcacagcaactacccaagccatccagaaggctaaggatgggatctcgacaagcagcagtaacagcggtgatctcgtggagcaatgtgttcagtgcccagcaagattttccaccgtgggggccttaatcgagcattgcgaaaagtcccatcagagcaactcgcaatcaagtcgtagcagagtgacggtcgatgtctgcccgaaatgcagcaaggcatttcgagatccagtgttgcttgtggagcatgttgagagggaccatggaggaacgtcaagagcgtagatctgcttatgtttactgtacctgtgtaacctgtaatttgcttctcattggtcaatggtcatcacactcaataggatttggttggattgtgctctattattacggttgggttcaaaatgtgcccatgaaagaaggtatagtttgttggctgtttcaaggcaagccattgtgaattgaacctcattctagacaccaggaaatcaaatttctgattagttaaaacaatgcgtcgtttagatggctatgctgttgcaagttacaaatattgccttctaccagtttgttaatggtgaaatggaattcataacctcaccgtgcatgcacaggaatccactgtagttacattacctgtcaccattgacaacccttgcaacagggaacatcatcctttggtctgctgaataaaggcgaaggattattttcacatggtttgcatcccagatgctaattgaacactgagagaaacgtgagtttcccaatggttaaaaccacgtaagaaatttcgaatttgtccctaaattggacgtcttttagccgtctaaaatcctttttgttcaacggatttggtcgagatataagccgaaaaacaaatagtgaaacgcgttcctgaagcccatcaaagcaaacctgcctcgaacaccttggatcctgtgacccggcatcgttacgacgctctaggaattgcgaagacgaatggccatgatgttgtggtgacgaacggctgctgttgctgtaaaatcaaattgttttttattcttattctgcgatgaacaattggcatctgagattattgattttgacatttgaagattattggcgaagtggttttggaaataattgattttcagatgatgaacaaggtttgttgttttgtcgtgtccggtcagaccggccaggtgctctgtgtcgactctgtgtcgacttcgggttgtttgtttagaaatccgtggatgtttcgtgtttatggcttctagatggatcctatgtgtatgtaatactgttgtttgctaacaatgagtcaagttgaaaatagcttggtcttggaatatggtttccttgtttgattcatgtgtaggtgacctgatgcctcagaagagtatagtcggtgatggatcgggagtcgacttggagataaggcgacgtccggacgatcggatatcatgcgggatacttaggctaaagatcaatgcacgtggttggtgaatattccatatgacatacgatggagatattgtgtgcgtatgggatgcggaggccattccagggctgtcgaaccgggcggatctataccggtcagaccggcggcacaagcacgatcaaactggcagatcaacctcgattagaccgatctatatcgaaattgagggtaacttttaattccgctaaaaattttggtttttgggtacaccaaccattcaccccctatggttgacttaattctttctacggagttgctagaaatatggcgtcatatgctacagtcgattttttttcagccacttacacagtagttacacctcatttacatcctacttacatatgtaattactatgtaatttttgaatttacatatgtaattttagtacttacacatgtaattttgagacttacattgtaaatacattaaaattagatatgtaatttagggacttacaatgtaaatacatgccgactatttttttttgatgaaaatatagtgccataaatatagctacacccttctttctattcgatcctacagttgtgagggtgacgcgcgccgatactggcggcaagctagcaaatcagaagtccggcgatggcatccaagcgggaaatcaatgtccaaaatccggcaacaaggacaatagaaaggtcttggttagtgtgcttgactaggttgccgttgatttgtgttttgacttttgaaaagactactgttactaggttattccccatagtgtgtgcagtcgcagcgaggaagattggccatttctttgcgtggctcagtcattagttagtggatctcaggaagaaaggggagtgttctgtacagggtgaaattacatcaactactgaaaaaaaaaatccacctctctgaatacgcccgccatcttccatctccttgatgtccccaaacatccgaagtggcgttcgcgctttctgattgaagatcatttcgttcctttcgttccacaccgctcaggttaccagcgtcaagttacatttgttttggacctctaattgtttcttgaattctcttctcctagtcagatatcgctgccgccattaatttgttcccccctttgggaaaaaaaaatattttgagcttgtgccaagttagtcatgggtgccaagaggagctcaatgatccccgcactcttgctcctcgcttccttgtccatcttcaagctaccttgcttctccagatcactctctttcagctacgatttctccaagcccaccactttcaatcgttccgacatcgcaatagatggatccgcgagtctcaatggtctcatcgagctcacgcagaacgctgacccgaaacgtgaaggcatatacgacacggtgggccgagggtcctacggccatccggtgccgctctgggacgaggccaccggcgaggtgacgagttttacgacgcgcttctcgttcgtcatcaagtttaactagtcagacaaggccaagtacgcacccagcgacgggcttgccttcttcctgtcaccctatccgtcaaagatgtctccactcgacggcggtggattgctcggcgtcttcaccaacagcactggcatgaatccgtccgccgccgccccgatcgtcgcggtggagttcgacacgttccaaaatgagtgggaccagagcagcgaccacatcggcatcgacgtcaactccatcaactcgaccgcggtgaagttgctgtctgaccgcagcctctccaacgtcaccgagccgatggttgcgtcggtgagctacaacaacagcacaaggatgctggccgtcatgctgcagatggccccccaagatggcggcaagaggtacgagctcaacagcacggttgacctcaagagcttgctccccgcgcaggtggccatcggattctcggcggcgagcgggtggtccgaggagcggcaccaagtactcacctggtctttcaattcgacattggtggcgtctgaagaacggagagaaaacgcaacgcgaggtaggccggccgctgcggtgcttgcaggtgtcgttgtagcatccgtcgtcgtcgtcggggcctcgatctgtttgtttgtaatgatcaggcggcgtaggatatctcgccggcggacgagagaagagtacgagatgggcggctccgacgacttcgacatgaacgatgagttcgagcaaggcaccggtccgaggcgatttctgtacagccaactggccaccgcgacgaacgacttctccgaggacgggaagctcggggagggtggcttcgggtcggtgtacaggggcgtcttgagcgaa

SEQ ID NO: 4615 - DNA, 17155 bp, Oryza sativa
  unsure (1)..(17155): unsure at all n locations
cccagcaacatcatgctcgactccgccttcgccgccaagctcggcgacttcgggctggcgaagctcgtcgaccacggcgacgcctcgcagacgacggcggtcctggcggggacgatggggtacatggacccggagtacgcggcctccggcaaggcgagcaccgcgtccgacgtctacagcttcggcatcgtgctgctggagatgtgctgcgggaggaggcccgtgctgctccaagaacaatccatcaggtcccgcctcctcgagtgggtctgggacctccacggccgcggcgccatcctcgaggcggccgacgagcggctgcgcggcggcgagctcgagctcgacgcgaagcaggtggagtgcgtgatggtcgtggggctctggtgcgcgcacccggaccgcggcgtgcggccgtccatcaagcaggcgctcgccgcgctccagttcgaggctccgctgccggctcttcctccgacgatgcccgtgccgacgtactcctccttgccgagccttgcattgtactgcgacgcggcggcagctagctcgtcgtcatccagtgcagggttttcttcttccacgagtggcgagcgttcgtcgacgagctcctctgcagcaaccgccgagtcgtcgtggctacttaagcacaacaacaggggcagtgaaaaaatagtattaggcaacaattgattagatcatatctttagtttgatgccaccttgatgttgcttagctcttcgttgtttatgtgtattgttcttccttgggccgccgtgtcatttgtgatatgtacctcaattcatatctccttttctatatatgcgttttcaactttcctagtatagcctgctatctttgatcttaattgaatgtcacaagccgagtcactgtttcgcgaaacgacatatttgcaaacgaaaagtaatttgtgaataaaacttttatatacgtgttctttgcgatctaaaagtaaaggctaaaaaataatttcgatgaaaaaaatttctcaaaatcagtttcaaatttaaggttgaaaattcaaattttgactaataattataagcataagcgaaaagacgaggagcataagcataagcaaaaattcaaattttggcgggacaaaggattgcgatctcgtgaaggtgagctaactccaaaaatccgtcctcggttnnnnnnnnnnnnnnnnnnnnnnnnnnnnnnnnnnnnnnnnnnnnnnnnnnaccggttagccatacgacggtgaatccgttcgacacaacgcccgtcacactatagaagttgactatgtttgaactcattaaccttaaccataagaaggaagatgcctaaggctaggcctttgactagagtgaagttgtaacaaggtagggcatgtctgggggagcttctggcagctgtagtttctctcagaatcagaagctctacctaacaattcagtttttttgtccaatttctgagaacctataattgtagaatctagaaaaataaactagaagctagaagctgaaaaactccagactctcagaagctggaaaacttcagactctaagaagctggctatgaaccagctgcttataattttaagctccccaaacaggctcatagtcgtactggaagttgcagctggatcacctcctttttcatgagctaatacttacgtattttggtttgacattaattgcttcatgcccaaaaggaaggcagctacgtttgagctaaatttggatatggaagtcttttttcgtttagggcaaagtacgaccaagctcatgagcttattatcctatatcggaacaattactagttgatattgataggatctcctttttaatggccccacaccctcctgtgtggtgtgtgcggtgtggcagatggggatatcaaaaggaaagggatagagtttttctcgtttttggtatagcataccttcttttgggaggcctgcagccccacacaatgagctccctcataattgcgtcgttgtgcctaggtaaggaattttgaattttttttctctgaattggacatctttaagcagtataaaatcttttctgttcaaaagagccgaaacaaaaactgttcgagatatgagccgaaaaccaaaagtgaacccgttcatgaagcccatcaaacgcatgcagcttaacctcgcctgattcagcagcccagttgaaggtcttcaaatcgtaggatttgaaccctcgtgatgaatccacaaggtgatctcccgtgtgtgttagactgttagtcacccttggtgccagcaaaaggaaaatgaaaaggtcattgtacaagggcccaaaaaatataagaacagttgaagcagagaagtatgaacatatatccacaaaaagttcctttaagaatgatatagatgatcgtgattagaacccacaaagtgatcgccaggagaattgaaaggtctaggcttgactagtgtatcgaaagaaaactgtggaaatatagatgtatcaacatatgcccacaataagaacgatcgaaattacgtgtaaagattattctttcgaaatttgcaagcataaaaaaaaaaaagacctatagcttcatctgaccaacacctcccttgaatgaaccgtataaaggtctcgacctcctgaagctgaatatatcggttatttgatacgagtgcggctgtggctcatcgtgaactatcttttcgtactcggaggaatggagaccgccgtaaacttgaatgctaagaattttcttttgtggtgcattaactttgacatgattattgaagaactcaatcaactcctctttattgagatccctcagtgcagcaacctgcagcaagagaactccaggtataaaaaaaaatgacaccatagggacaaaattacagaaatagagcatacctccgcctcttttctatcaaatttcagagttccttccgaaatttctttccagaagaacgctgattcctctcttatattcttgtatttctccagcttcatgtcaatgagagcattcacgttgctctgcaggtaacagaagtgactgtttactctgtataatgtcaagtatacaaccatacaatagagctacagcaaccttcggccgacccggcaaaagagctacagcaagctataacagaagccaacaaatactgacagcaatcatcttaccttgaactcttcatcaggcatttggtatagagtcccttcaaacatattaagaaaagcttccactctgtcatccaggtttgatggatcctgtttaagtaacttcttagaacaggagataaaaatgatccagcagttgaaattgcattggaaaatatatttaccttcacggttgactgaattatgaattgcaatccccgaacacctgaatcatttctgggtaaacaagatagtgtgaacaaagatttagaggagttgcatgagcatgactactaagtcccattaccacataccaatgcaaaaaagtgctgcacatccttttgcaataaagaacacaattaaaataaaggcaacatcgtacctttgtgtaagcactgttatgtagccaagttgctcaactgaacgcaattggtgaaaagctggttgcttagcaacaagagcaagcaattgaagtagaacattttgtttgagatcatcctgatgaatctgtgcagtggaaacattgttatagcattgaaatgtgtattgcaggtatcttccaggaaaaactagatatggttgatgagaggctagagtaagaaaaaaaactggatgttcaggtattcttctgtaaatgcaaaagaggtccacagagaaaacatcaaagaagtgcaaaggcatacctgaatataatgcaggatggaagaatttttttcatcctggtgatttaggcacaatgctggataataatacctccaacccctttcaagttttacaattcgctttgtaagatgctgtgatgggggtaatgctttgcagaaactgatgggtgcattgaataaggtgtcttcaacatgctgtataacactttttgcttcacccggttccatgttccctaatatagtaatatcgatcacatacagaattaagaacataaaataagtacacccttcttaatgagaaagaatcaaaataatgaagttagttattaaacaaaccagcaaaatagcattcaataaatgtcttgcccagaagacgaggcaaaaaaatctgtagatcgcttgcttcaatatgagaaactgcagcaagtttttcatcccatgcccaagtttgttcctctaatatcaatgaacaatagtaaaatgcctgctcatatggttgtcgaaatttgaaattctcgtagtcctttattatagtttcctgatgacagcaacaaaatatgaacacacgcagctcatgtaatgtaaaatgcatagaatgctaagttaatattgcataatcaggaagatagaaggtacgctagacatcctaggcagacactcttttgtccttcaagacatcctaggcagatagaaagtacgccatatttaatccaattagaattctatagatagaaatgcatatattaggaaatatcacaactgttgtttatagctttttagtcccgtttctgcactgttttttcctaaatgaaagtagctcatgcttctgacaaggaatctcctgactgttttatacatgtccaaatgacaaccaaaacaaaaattctagcaggtctgcagaagatattttaacaaagaaccacatgtaaactgagcatggccgttacctttataacagcaaaacggtcaaccttcacttcaaactcagcaatttttccaatgacagtatccagaagggttctcattttgtcattataaccgaccatagttatctgtaaggaaatcataaatattggacggttagaaaataagaagatttcataaggaaaagtctcataacacgccatgaattatgactcgtttagaaggaacagttgagtgatagatcgcaatttacaaacatacataacaaagttttacaaacatgcaacacaccaacagtgtcagccactcagcctgctaccacacagtatacatgaaaaagtaacagggattaggtaatattgaccatttaatctaatatagaatataatgccatttgtatatgcacatatgaaaaaagaaaacaaatggagaaaaagctgctgtaagactgtaacttatgaaagcacatagccatgtacatcttctaattacagtactaatgatgtctttattgcaaactagtccagttaagaaaatgtacatctgaaccaatatgtggaaaatagttccaagtgtcaagactgatgatagcctacttcttgcttctatatgcaacaggaatcaggattttaatattaaagattaaatgagaatcgaatggcaagcatctgcttattagtaacacatattaccatttttttcatacttgcgcaaatacagtatgtgtttaattaggagaaacaaaaaagtttgagtatagaagcgctatcggtattgatacatattgactgaagagcttggtgtcatggtgtgcatcatgcatgggttatgcgcatcagatggaacacattgtatgaatatatgatgcaggaaggcctgcaccatagtacgattgtcacatgacaaccatatcagcagcatgcaacaagtaccaacatagatgggtataagagtgttcgtactggtttaggtgaaaacatggctaaaggcaactaacatgatgaataaagtaggtggtataaaattattgtgtagttggcaatgggcatgtggtatgtgccacaccacacaagtttaatgtcagtggaaaaccttttatttggtaacttccaagctgcgatgcaataaccctcgggcatttgaccaagaatatttttcaaaaatatatgcactttgtgatccccaggcatatttccccaaaataccccttctgactgtacctatctccgtatgtttcagtgctctgttgattgtgagatattattaaagggtactttcattacattctaaataaattgttttttcgttttgagagggtaagccagtagattgtaattacttggatatatgcaatttagtcaaaagtaataaatattcaaagtggaggggagttaacttatatcaatgcaacagttcaatttccacaacaaccaggaattccttctgaacccgcaggaatatcatagaattttcacataaaacaggaatcggggaaaattccgtatcccaaacagagcctaagagaagtatgaacagcaggaccctctttactaaaaataaaaagaagattcagcaaggacaattattttcaataatccagtataattaatgctcacaaggagtcaagttattcaatcttttctgatataattagtgtgatgtttccatcaacactgcatcatctggattagcaatgaagataaacaatcaattatgtcatgcaaactgtacagctaacctgaaatccagtgtcacttggcctaataaagtagtaaagaccagcaatttgagcatcataagctgaaagcaaaacaaagttggtggattattgcaacagataaatgaaccaaaggcaaactaaccagaggatgaccatgtccttagtccctctattttctaggattgataactgtatgtggagaacgagttcttgtttcggccaacaaaaagaattttccaacttctccattagtatatgtcaattttatgatagaacattgtatgaagagaagtttgaaatatactaaacaatttcatgaacctgtgccataagaatcataaaatattgagatatctcatgtattactacataccaaaatcattcaaataatccattatcaacctcgtgaacatatcagtaagaactgtcgattcaggagagctattggacagtggacagtggaaatccatcttgacgtaggccttgggtgtgaagaacattgtatcaggcttataccatactcttgaaaacattgttttcctaagcatacaaggaaaacttccctggataaaccgaaaatatcaataaagtttcacaaaataaaattatgagcatttttttttaataaaaaataccttttcctcaacatttttcaatgaaagatcacttggaatgaagatattaggttttggaatgtgcaaatcttccatgggagccatatttacccatttctgtacaaattatgttagaaatgtgtacaattccaaatatattaaattggagaatatgataggaacagtaacatccaaatgtacacctgtatgatggaaggagtgactgcttcaactgaatatgatgtaccataccaaggctctgttaagtttgtttgcccttcaaacttttttgattcccagaatattctgaaggagatgaagaagataacccagaagtattaacacccgtaagtaaaagtcacaatgaaaataaaatctaaacaaacagatcaagtgtgtgaaaggaaaaaataaagcaaatggccataagaggatcaacgatgagtgaggagcctgttgctgctttttggaagttaacaataaaaaaaatgcaaagggacaagtaatgaaatttcttccgctttctctgagaaaaaaagctcaaatttatgaaaagtagtgaaagttctcttggctgtgccatccttctagaagagcactatagtgttttataattgattaggccaagaggagtgtgaagcgacagctaaatgcaaagaccgatcattttccaaactacatgcagtagttgaagagtcacaataataagcatatgcatacattatactgttattgctgaaatgaacaaccaactcaaattggctagtccccaattctgtatgataacattaaatgcatgagattactgtcgtgaatagaatacacattgttgtatctttgcagtctcatactgatccgaaattttccattcgaaattgtgggatacaagatgtgctggaagtgctcctgaaaaatcctaggaatcatgtctaacctaagtgtacgggaagaagcatatgaagattttacaatgtggtacatgaaccattcaaggcatcaaagatatgtagcacaaatgaattaatatagatatgagtttcctaagaaagtaacttttgaaatactccaaaaaagagagtataatacataaaatataacttttcaacaaacatgtgctgaatattaaaacataaaaaactatgactaaaccttaaaacagaacaggaaaacccaacaaggccatatggcctggatgtactcaaaacctacctaacattatctggagtcaagtcatttaatatattctgaatagcatctggagaaaactttgatggcacagatgatgcaatcagccaatcttccggcggaaagatctataatagagagagatcatgagatggtgatactgagcagaattaatttgcaatttatgaacaaacattttggcataatttattaggaggaactgatcatttcattgttcaatgaaatatcatgagctggccttcttgttaatttcattttgtgtaacgaaacaaagtagcctacaaacataagttaagaaaagctaaacagtttttagatatgccactccacttcctcccagtcatacgcatgtgaatctatggggaatgcagatccgctcatgtagaaagcttcaattttgtgaatttggcgatattctgttcaaatttgactaaaatttgttcaaaattttggtatatcagcaccctccaatagaaacgtccaaacctaaagattaaaccctggggggggggtgcatatgcaaaaatttcagtcttttgggcctctgaaaactcggatattttggtcaaactacaacaggaagcatgaaaggatcataacctacacagaagcctagagcctcattagtggaactatgccccactgcatccttgctgacaggatcacgttttctctcagggaagtgttatggtagatgtgactatcacctccaaatttatcgatatcattcactcataaattaagaggcaacccatataatatgtcacatttagtacacaagcccagcaaaaaacatttagtacacaaatacattgtaatatatctaatactctcacacccttcttgaaatttgtgtggaggttgcctcttgatttaggggtagctcatcatctctctcctcacttatctccaccatctcatcacttaatccaatgtggcactcttaggggcagcatatggagcattatagtacttgccctcagcgacttctccctcctcaccgtgatccaacttaccgctagtcgctagagagtacaagtatctaatggctatgactagagattgccaagctgatccaggcattaccacattggtctcttacccctagaagccacattaatcaccttgacacataagacagtcgtgcaacatggagtcagtgacaaattgcagaaagaagggagttatctggtggcatatagttcatattctcacttcatttgtgagggatcccacctaatcacatccctatgaattcaaccgagtcttatccaacaactcataggagtatcaagttacaaggttttaaagtagcacagcaatatagttttgcactagattctctcatacaaacatgtcactgacaaaatataataataaggtgcagattgatagtagaattaatgactggtcattcttgacttttgcatgagcactttcatgccttatcaaaagtcacatctgtctaatcagaaaatagttaggtagtaagattttaaaaagtcactttcttttataagcaaagagaagtctgctttctgccctcgattcaaacttttatgagaaacagagatggaatactgtttctcgtaaaaaaaaaagatggaatactgtgataccaccacctatcaggcccgacgagcggtccactgtataggaaaatgggcaacaatgggactcctaactctttcttgaacatgcaggaacagtcaattgcaattaaaacagatgctattattgctaacttccttttaaaatgatgacaagacatgataaagattattagttggcaattatggacatgcaatacagatgcccaaagcaatgactaaaatatacctgcatgtttgaggaaatattgacaacataatggataggaggactcttgtctcggtagtggaatcccatctcagaaatagctacaagcttgacaatcaaaacagagtgaggtagttagctgtgtgcaatgctaaatggacttcatgtgcatcattacaatttacaatgtcgcaaaaacacatagacactgtcattatcgttcaccagttagacaattatacaaattccaagcattactatagtagttggacaaaatagaatttgaaggaagcacgcaaaaacaatgtgaccctttgacaagcattactgtagtagttggacaaaatagaccctttgaaggaacctaatgcatgcagcgtacacaaaaacaatgtgagcaacttgatgatatggtcacatactcatgtttcatgattcatcttgaaaaggtaaagtataattaaatttaaatattaaatagtagctccctaaaatgccatttatagagggatattgggtgataagaaaaggtactggtcaaattacgacaaattagaccaaagatcttatgtacaatcctgaccaaaacaataatccaatttaatgacttcattaatggcctgattgtttaaatttcgaagtagcggtatcagcccaagaaaaatttgcaaagcttaaacggatgtcacgtacagcttacagttgattttggtcattataaaaaaaaaatctattcccaaaaggtacacaaatccaaaaccaaaattcacctcatcaaaaatccactgacgagttccagaggtctggagcaatgctatgtatcggaataacagtccaataatgtcctccatgtgctctatcatcaatgatatgaaataggtaaatattatatacactgtaaatcttcagtacttaaaagtaaaatttgatcttccatcaaaaaatagtaaagtttgatcatatactatccacttagattgaaattaaggatttaccctcctgactctcatgtgagtgaccttgattaccccacgtcttttttttatgcaagagattaccccacatgtcattggcacaggagggtaaatcctcaaaaaattgttgttaaaaaggcccttcttgaatgaaactcaccatagcctacatctgtgagctgtataacaacattgaagaatgaaaactcataactccagtcaccttcccatgcatacaaactcatagcccatcctgaggaatttaacaaagacaaagttaaaaacaacaagcactatgaaagatatatacacacacccatacatagagagaaagggaggtgatcaggtgaggatgatacgtgggttatgtccacccattaagcacagtcaagtcactatttatcttctttattttgttgttgtttattattgattgttatggtggcattatcactattttcctacgtagactccacataggtcaccgagagacaccacggtttaggcacagaggggacatgtggacactttcgaaagttgagggaccaaaatcagaccaaggccatagtttaagggactaaatgtggaccttttccttttctttattgtgtattgtttgcctgttccattgaaactttactttgatttttccttgacaaacctaatgtcatttttacataacaaagtcaatagcttcttgtatcagtagccaatttttttgaggtttggctgcacataatctaaaaatgaaacctatttgaggaaggaggtcgcagtgaattattagcacaccacctaaagaggatattgctgttatacctaaatatcctcgaatgaaacattaaataaaagcaaaggaataagatttcatctccagatttttcctatataacagtacggaagaaccatacagagataaaagagttgaaaacaccacacgaaagcatatacatagaaaacacaaaagcatctggatatgtgcactacaaaatggcatctcaattggaaaagcaaagtaagactaattatatgcatttggatagtaattatatcagaccaagaaccagctcaacacgtcacctcgaaagatggatataaactccaaatcagtgaatcacataacacaatctaaagtagcattcttgaattaaatggcgctatcatgtctaaatgcttcatcaaagtgcgagtacaatcctgtattaagctgacaataaggtcagatattcacattaacagaaatacgtaatatcttgaagcaagaagcatagaaccagaggattttgtattcatgttacaccaaatagcctatggactgaccaaacagccccaaacccgtccaccagaaaagaagctgaacttctcatatatagcttacctaaattttttagcacgtaaaatagagacccctctccttcatggccaactagacgactcacatacttgcaaggcccttccttatagtgctgaatatttggggtgattggccactgtattctcaaagtgtggccttcttttatgggacccgcttcacaatgatctgcaggtcattaactcccatattaaacatgttaaagtatccttacatttcaaaaaaagtgccagatccagtggtgcacttgacttatcaacctatttttagcaaatggaaaatataaacctggagatgttcacttgaacatggatgaccatgaaaggaaaaactttcccttccagtattcctgacatcagagaacttattttcaacaagattttgaaggttgtcaagactctctgcatacacaagttacacaacagataaaagaaaaaaaaataatttgaagaatttgtacacaaatgaaaaatataatggtgtaattcagtttgatgaaaacctttgccatacacaacaagttgcatcaaattagctgagtaatgtgaattataaaatttaataagctcttccagtgtgtccaatccttccttatttggattaaccagcaaagtgtccaggtttcctaaaataatagatgatcagaatattagtgaaaaaaatagtcgacctttctatcatgtaaaaaaatagcctcttatttggctcaagttaaaactcccacaggttttgattccagagaaataatatctaaaataattttaaggtgtaaatactccctgtcctgtatgtttgttagacttcaacaaagtaatctccaattcacatatttggccagtgacttttagtggtagtttaattttgactccactattctgaaacaacattattttttaagaacaagcacgatactgaccaacagaataaagtagaatcagagggcaggcatcaattattctcaaagtataagaaatgtcaaagtacttcatgtacaaacttgtgaattcagtgcttgttcgagcctatgtggtcctcgccaagagagggacttgatgggttagaaaaatagaggtgtatttgccagatctaagagttgcacaatctttgctcattcatcacaacctttgcccattcatataactaccatgcctcaccaccaaataaaaaaagggatacgataggtggtgctgagaaagatcagctagatgccgagtaatcttagttaggttgtgctggaaggcatgggccgacacaaggggagatgcaaaacatttgactgacaaaggcacaattttacgtgtttctatgtccttcatatgctattgtttcatttgtgaaatcagtgttttttcaaatgatcctcatggtccacatggatcaatatcaatacagaagaacttcaagaaaagatgtgtgtgagccttggatgacagaataaaccacaaatgaagagaatccatcatgaagattgagaataccataaaacaaatggaccatcaggtttacaaatgcagcctttttccttttggaatttggaaggatatatagtgagtttttttttccccatcatgagcaatataagggcattcaactagttaaaaacttaaactcagaagttcatatgacatggatattttctgcaacattacaaaacgaattcttgacttcagcatgcaatacttgtgagttgtggctataaaatgaagatagaaacatggtaccaagcatatagttgcaacatcagacactacaagaaaatgaaatgatgactaaaacacacaccagtgctaaacttgtgatatggatggctctccgagcaaaaatgtttctggagctgaaaccaaaagattatagacaacgaaattattatagcatgaaagagcatggtaacataaatgaatttgacagaaacaattgtaataaatcaaaaaaaaatcatattacaccgctcaagaagaaatgtataatataattaaattaggtagaaacatagatttagatgtcaaaaccactatcagagctgggttgcattgctctttaatttggggggacgggatatttttagtcggttttatacttttgttagttaaagtgtgatttttagataaaccctataaagtaaggggtgtaatatagatttatcccaaaatcaaaatagaatatgagtatgataccattcaactataacagaaaatattccactgcgttgatgtttttctaagataaaggtacctgactcattcgcaaaggatctgacaacaagtttttcttattttctgcaggtgaagaaaaaaaagacagaaattagaagttaattctctcagcagaaatgtcagttccagataagagagaagcaatatataccagagtcaacagcattaatttcccttagagttgcatcgggtgagatcaatggctttataaaaaattgtgcaaacctaaaacaacagacgagaagcaaaatgaatcagattctgcaaaataagaacaaaggtgaaaagaaagaaagcagtagaaggtacctatccaaagcatcatccaggcaactattgttcacatcaaaataaaagtttgtacgttcacgacatgtgaaggcgttggttgaaccaccatgctaaaagaaacatccatatcacacaattgatgatttcaaagtagagaagaaaacttaaataccatgatattctttatatgaatttatgaacaattatgccccctattctttaactatatcagaggccagccagacgatttggttttcccaattagtattgttaataatttaaaaggctaaacctctgcttgcaaatctccagtagcagcataacattggaggaacccatggttcaaggcttgaagcactgaaggtacagagcttcattggggccaaacttggcctacccaatgattgtacagtctatatgatacttcctccgtcccaaaatgtaggtattttttaggttggcacggtattaagaaagtaggtgagaatgattggaggaagtgtgtggttggttgaaaagagaaagtaggtgaagaagaatggttgtgattagttgagaggaggaggtaggtgaaaaaaatagcttcattttgggacaagatactgtgctagaaatagctacatcttgggacggaggaagtaagtacttgtatttggggcattttacttattaagcttcaaattggtcccatatggattaagccactcgtgcatcattagtgttgaaccactctcactctgccactgtaagcactggtgcaccaccgcaaactcgcagcagtaaatatatgagtttactcacaagtcacaagctggatactatagttacgtgtgcctattatactgttaccaactgacaactggtactctaggggcaaaagggcagtaaccatgattaaaaaaattaaactagattagctctacagatactgaatttctctaatcgcactctgcttaaagtactataaatataaaaccaaacaagtggcatctattggcataacaggaagcatccaagaacccccaaaatgtggtacaagtctctagtcattgccagtaaattgaacgtagactggacgttttgcaaagaatgcagtatgctgaagttcaattgtccttccaattgttctgaagcatttagattaagttttgagatcaattttagttcgatctaacaaattattgaccacgacaaatcaagatcacttacaaatgtcctcttcaaattaacagaacagataagaaattggccatacatacctctgcaatatactttgagtaatcgtcttccacagggtatttctcgctagcatagaaaagcatatgctctataaaagaagaaccaagcataagtgaatcaaacaatacagagacacatacatgttaattactgcaaaacacatgccatgaagctctctacatgcgatagtacaatccaaccaagataaaaaaacaattcaatgaggtttgaacagtgcctggtgatgcattaaaactctttaaaggtacacactagaaaatatataaaagagcaacatacaaaacaaggcaaattaaacatacactaagcacatcgatagcatgacacacagtgacacaagaaagttgtgcttactttatctgtccaaggaaaaatagttacaatgactagtgagtaaattaattttctaattgaataacagtgtctccttagatttttacaatcaccttaagtatccaaataatatgttcgaagcactctggtgtcgaaatgaacctcctattaatatatgccatccatttcaatacagaggcaatatagcatgtatatgtattacaatattagtataatagtttcaatcacgaataaaatttctgaaacatctgatccttcaatgaacccgtgagtttcagataagtaagccattttaaggcccaactgtatttttctcttaatgccctttcacatgtgggctttgacatctttgcagattaatcaagtaaatgattagctcatatacctttgaaggtatgggccattgtcgcttattagctggatattctgacagcacctatcaggagatattgatactgaattgatacattgagttgcacatgtgaatcaatcatctgtatattttcctggccatgctatacttgttttaatcttctcatccagagatactcagcatgatgctggaaattcattttcagatgttttgcatatatttgtgcacatattttacttatccaaaaaa

SEQ ID NO: 4616 - DNA, 2812 bp, Oryza sativa
catctttctgtttgaagtccggcgtgtaccgggacatcttactgtttgaagttcgaagtcaagtaaacgtctactcgaacgttcggaatttttacggaatgggaagaaaactactccctccgtttcataatataagccattctaacatttttcacattcatatggatgttatatgcgtagattcactaacatccatataaatgtgaaaaatgctaaaattacttatattatgaaacagagagagtagctaggtgtgccatagcagatgcagcatacaaaagaggcagcgagtagaaaactgaaacgcagcgaggaatgtgacacacatgcagagttttcaagcaaaatataagcgtcgcctgcttcggcagctttgctatactctccatgtgtagattgcagtgggagctgaatgtaactttctcgcggcacatggttccatttttcaggaagagataacgtccaaagaaacaacagcgagctcactgaaacggaaataaaatttggagctaaactaaggatctgtaggtggaaccgtggaactgtggaagcacctctgctctggtggttacgtcgtagggtctgagcccacgtaatgagaaaccacaaggtgatctccagtcgtcagtcacccttggtgccagcaaaaaggagaacgaaaggtcgtggcgatagaaaatggtggaatggaaatgcagaagtatcaacatctgtccacaaaaaagtttctttaataatgatcaaaattacacgtaaaaggattattcttttggaatttgcaagaatatcaaaagggttgacttatagcttcatctgaccaacacctcccttgtatgaaccatataaaggtctcgacctcctgaagttgaatatatctgttatttgataggaatttggtcgtggctcatcgtggactatcttttcgtactccgaggaatggagaccgccgtaaacttgaatactgagtatcttcttttgtggtgcattaactttgacatgattgttgaagaactctatcaactcctctttcttaagatccctcagtgcagcaacctgcagttacagaactccaggttttgaaaactgatactacatcagagggataatgtaaatatattgagcatacctccacttcttttcgatcaaatttcagagttccttccgaaatctctccccagaagaaagctgattcctctcttatattcttgtatttctccaacttcatgtcaatgagagcgttcacgttactctgcagataacagaagccactgtttagtccgcatgatgtttacaagtacaaaaccatgcaatttagctacggcaagctgtaatagaagccaatgattaacagtgagtcagtgacatcatctgtccaaccttgaattctgtatcaggcatttggtatagagttccttcaaacatcgtaaggaaagcttcaactctagcatccaagttggctggatcctgtcaaatcaatatattagaataggagaatgattgtttcagcgggtttgaaactgcattgagaaatatatctaccttcacggttgactggattataaattgcaaaccacggacacctgaatcatttctgggtaaacaggatcagtgtcaatgattttacaggaattgcatagtctacatatagaacaccattcttgccaaccaaggcaaaaagaccactgtacatcctatcaattacgtgaaggttgtacgtacttttgtctaagcagtgttatgtagccaagttgctcaactgaacgtaattggtgaaaagctggttgcttagcaacaagagcaagcaactggagtataacattttttttgagatcatcctgatgaatctgcgcaatggaaacattgttacaggatagtaatgtctattagatgtatctttccagggaaaaactataataattcaagctagaaaagaagctagagtaagagcaaggaaaaactgtaaatgcacagaaacaacacccaagaagtgaggcacacctgaatataatgcagaaggcaagaattttcatcctggtgatttaggcataatgctggataataatacctcaaacccctttcaagctttacaattcgctttgtaagatgctgtgatgagggtaatgctttgcacagactgacaggtgcattgaataagatgtcttcaacatgctgcataacaccttttaccgcacccggttccatgttccctaatatcgattatcaattacataatgaattaataacatcaacaatgcagagcattctctaaagaagagagtagtgtggctacaaaagtcattagcagcattacacggtaattttatgaaatgacacatattcatgttagttactccctccgcttcatattataagtcactttgggtttgtcctaagtcaaacctcaacaagtttgaccaagtttatagaaaaatatagcaatatttccaacacaataaatatgctataaaaatattatcgaatgatggatttaataagggagtattaaacaaaccagcaaagtagctctcaataaatgttttccccagcagatgaggcaaaaacttctcgagatcgctagcttcaatttgagatactgcagcaagttcttcatcccatgcccacgtttgctcctctaatatcaatgaacaatagtagaaagcttgctgatatggttgccgaaatttgaaattctcatactcctttgtaatagtttcctgatgacagcaataaaagattcacaccctcagttcatgtcgaatgcatagaaatatagcttaatattgcatcatcaggaaggaccacaaaatattgt

SEQ ID NO: 4617 - DNA, 21627 bp, Oryza sativa
  unsure (1)..(21627): unsure at all n locations
catagaaatatagcttaatattgcatcatcaggaaggaccacaaaatattgtagaacataatatatactccctatgtccacaaatacaagggattttagagtactagctgttaatcaatcacctctcattcaaatttcttcccatcttactcccacccaccccacccaaccctcattgaacatgagcatcctagtcttttatcttcatccttgatctctccaaaaacagagggagtatgctctttcacctctccaagatagcatagccatatagaaactatgatatgtttaatccaggtagaattatatagatgcttaaatatccatatgcacctggaaacagctctcctgctgtatatagctgttcagtcccatttttgcatgggaagatagtaatgacaaaaatgttgcatgtgtatgccactaaatgttttgcagatttgctcagattcctttgaattactttacctccagggaaaacaatttcagaagatagtgaggcaaatgtcttcttttataggtttttacctgtgtgccattaaaaaacatgacccctgcctctgtgccactaaaaagttcgagcctccctctatgccatcgtcgaactttatcgtgccctccacaccattccgtcgctattctgttagggtcttaaccgtttggcagcactgacatgtgggcccggacaggaaaaatgtcgctctggccctttcagtcgcgggccccacctctcatactctcacctctctctttcccctcttccccttttcctctttctctcttgagtagcgatggccggcagccggcggcgggcacggcgcccacccgcaggacgactcgcgcaacctcgtccaccttcctcgccggccaccaacctaccacgcgggtggggcccacatgtccgaggaggacgacgactagccgccgctgctgccggtgcagaagcggccgcgcgacgcgcgccggaccaggtgctcgacaacgtcctggagacggtgctgcaccctcgccgtcgcctttgcaccctcgccacgcccgccgcgcacccgccggcgagctcgcactcctcggccccgccggagaggccggcagtcgaggcgacgacgaggtggcgcggcgaggtcggcgagtaggggggtcgtcgtcggggatgtgccggctcctcgccgccgaggaggccgtggcgtccgcagccgccgccgccaccgtcgtcccggcgctcttcatcggtggcgccctccgtcctggctctctctctctctctcttttctctcaaccctaagggcagcaaagtcatttggctacgctgtttgacaccgttaggactaaaaacggacggaatggtgtggagggcgcaataaagttcgacgatggcatagaggaagtcttgaactttttagtggcacagaggcaggggccatcttttttaatggcacataggtaaaaacctccttcttttatctttgttagattcaaacagttcactggagacatcagggaaatgaaaaaatgtatagactgtacatgtatattttgatttctgatcaacaataagtattgtctacacaatacttactcccttcagtaaagaaaaaggtaaattgtgattctcggagtcaagacaatgcccactttgaccactagattataacatcatatgccctgagaaaagtacattgaccactgatatcatgcaagtacttttcatacaaattgaccaatcaaggcaagagatgtcattttacacgtttacgccaatcttaataagaatacacaccattatctaaagcagacatgcccaattgtccacccatgaatgcaaactaccgctttttcctaaacagaggtaacttgtggctaacaaggaacctcctgaatgtttatactcatccaaatagccaaatatcaggcctgaaaagatatttggtaacaacaaattacaagtaaactttagtgtggccattacctttatcacagaaaaacggtcagccttaacttcaaactcagcaattttcccaataacagtctccaaaagagttctcattttgtcattgtagccaaccatggttatctgtaaggcaatcataaatattggagtattagaaaagaagaggattttagtaagacacgtaacatgccatggggtctaacttctggagaaggaataatatcaacatcacaaaacatgcatgatgaaaaatcagggttatgcaatattgaccatttaatctaatagagagtatagtaccatttgtaatccacaaataagaaaaaaagaaaacaaatggagataaaaggccctgttctattcttcaactttctcgttttctgttagcacgtttttcaaattgttaaatggtatgttattttaaaaaattttctataaagaagttgtttaaaaaagcaaataaatccttttttcagatttataatagttaatacttaattaatcatgtgctaatgaggtttctcgttttgcgtgccataaaaatctatctccaaaactggagatcgaacggggccagatgtagcaacttatgaaaagattagatcatgtacatcttataaattaagatcatgtagtaatgaagtatttacaaaccactctcagtacttaactacatctagttaaaaaaatgcacatctattactatctccctacatattgcttccttgaacatgcatgagatattattgaagtgtaattccattgaattatatctaaattgggtttttgagcgtcaagccagtaaatactaatttgatgcacatcgtttggtcgaaaaatggcacgtattcaaaaaggagtagcttagtatcagtggaacaattcaatttccacattaaccagaaaattccttttttgaacccccaggaatttcataaaattttcacatggaacacttcaactccctcaggaatcagaaaaggaatgtgcttatcattatcaacagaagcccctccccccggcgggattaacaatgaagataaacaattgttatttcacgtgaactgcacagctgacctgaaaaccagtgtcatttggcctaacaccgtaataaagaccagcaacttgagcatcataagctgaaagcaaaacaaagctgttggattatggcaatgggtaaatcaatcaaaaggtaacttaacaaggagatgacaacgacaatgtgtttaacccctcgtttttctaggatgagtagtgtatgttcaggacggtgatttgttttaggcaaacagaaattaaggctctcaagcagaaaagaaccttttccaacttcatcattaatcttacctcctttaatatatcccctctagactatatgtctatcgtcagatcatcgtacaaagacaagtttaaaatacactcaaattttactacataccataatcatttaaataatccatgagcaaccttgtgaatacatcagtaagaactgatgattcaggagaactacgggacagtggacagtggaaatccatcttgatataggccttgggtgtgaagaacattgtatcaggtttataccacactctggaaaacagtgttttcctcaacatacaaggaaaacttgcctggataaaccaaaaggtatcaacaaacagtttataaaaacataattatgacttttttaaggtggtaaaaaccttctcctcggcatttttcaatgaaagatcacttggaaggaagatattaggttttggcatgtgcaaatcttccacgggagctttctctacccatttctgcacaaatttatacaaggaacttttatgtttccaaatatagaaattggataatataacaagaacagtaacatccaaatgtatacctgtataatggatggaggaactgcttccacagaatatgatgtaccataccacggctctgttaagtttgtttgcccttcaaattttttggactcccagaatatcctgaaatgagatgtggacgataagtatatgatgcccacagtaaaaaaaaaaaaaaaggtagagtgggaaaaaaatagctaatttaaggaatatatagagtgtgaaaggagaagagaaagcacatgaccattaaaaaaaaaactaatgaaaggaacagattggtttttgaaatttgacaaaaaaaaggggggggggcaatgtaagcaaagaaatttctttcaccttctttgacgaagaaataataaaatttctggcaagcaaaagttatcttcgttttttgacatgaaacagcaggagcatatatatatacacacacacacacatattaaatatatgaaagttctcttcgttagatcagttttctagaagtattacaaatttaagtcaacaagaacaatgaatctggtatcgcagagtgatcgaagagcaacactaaaagcatatacagtattctgttactgctgagataaccaatcaaatcacagtgactagtctgcattactgtatgagaacgttatatgcataagatcattatcattaaaagaatacacttttgttttgtaagttgaacggaaaatttctgtttgagattgtgtgcaatagatgtgctggcctgtgcactcgataagccctaagaaacatccttactgttcaggaagagaagaagtgaagattttgcaatgcagtaaatggaccgttcaaatcatcaaacatatgtggcacaatgaattacgataatgatgaatttcctaagaaaaataaattcagagtactcaagagaagaaaaataagtagattataactggatttaagtatggcaaatatgtgttcagataacatatgctgaacattaagtataatattcagtaactggtgttttgaatcttaaacataaccaggagaacctgatatgggcaatatggcatggtcgcactcagaacctacctaacattatcaggagtcaactcatttaatataccctgaatagcatctggggaaaattttgatggcacggacgatgcaatcagccaatcttccggcggatagatctgtaacagtgggagataacgggaaaaaacatgagatggcgatactgagcagaattcaattactgttttggaatgaaccatttggcagaatttattaggtgaagtggaaatgatctttcattgttcgatataaaatcacaatctgacattcttgtcagtttcattttgtgaaatgacacaaagtagccttcaaacaaacaaaacaaagttgtcacatttttagaaatgtccctcccaccgtcctgcccacttactctccccaaatccacatctcctccaaatcaaagatgcaagcatgtgaatctatagggcatttagacccatcagtgcaaaaagctccaatttttggtgcacatcgaaaaacttcggtttgctctggcagcaaagtgatccagtgatgaggaaaggccatggctgcataacaactactggcaagatgagttcttagcaactatgaagaggtagaattggaggaatcaaacaaagggaaagtggagatgtaataaagaggtacttgaaagaggataatggcaacaatgtgcgtgcctcgcctatgctggggtgggtgggggtgggggtgaaagtttacagaaaataatggaacatggtgactgtagagatgttaatactctgagatgatttctcactgacaaaataaatgaaagaatatcatcaatcttgatcttttgcatgagcatactcatgtcttatcaaaagccacccatccgcttagaaaataacccggtactaagattttgaataagtcactttcttctaagcaaagagatgcctactctctgccctcaatccagactttgaagagaaaaggcggaacagtgtacaggaaaacaggcaacaatgagaaattactattgatacacacacaataagaaacaatgatttaaaatagtgaaaatgcaaataaaaatagatgccattattgctaacatcctatagacatgcagatagaacatggtattatcaacatgcagtgctcaaagaaatggctggaatatacctgcatgtttgaggaaatattggcaacataatggataggaggacccttgtctcgatagtggaatcctgtctcacaaatagtttgaagcttgatgataaaacaagtgagatagttagttgtgagcattgcaaaatggactagcgcatcatcataatgtttcaaaaccaaattgactcagtcggtactgttttaacagtcagataaaatacaaattccaaccattactatactaatgacacaataaaccatttgaaggatgcacccatgctttatttgcacaatagaggaagcagttcaagtatagcctcaagcagaagacatatttgtctgtaatagaatgacaatcatgcaataattacttttccctccagttcttttttgtaaatactgtacattttccctctccaaaaccatatacagttcgtccaaaatgctaatggccaattaataaggacaatgaacctcataaatgcagagcgaacaaaaaaaaactgtacgagtcttctaggaagatatggcatgtttcatgattcctcttgaaagtgcagaacataataatttaattaattaacaaagatcactaaaatgccactatagagggatagtggaagcagaaaagtactaataatactaaaataaattactccctccgcccccaaaatatagcaacttctctaccagcacaaccttccccatctagttttacctactttcttaataaccatgcccaactctaaaaatccttatattttgtgacagagggagtactagatacaacaatagaagatattacatgtcagatcaaaacaagaatccagtttaatgaattcataaggtcatttgtaacaatttgattgtctagatttcaaaagatagcactaccaactcaggaagacatgtgcaaagctttaagctgatatcacataagataacaatcgattttggtcattataacacattctatttccaaatgaaacgcaaatccaagaccaaattcacctcatcaaaaatccacttcagagtgccagaggtctgaagtaatgttatgtatctgaacaacagtccaacaatatcctccatgtgctctatcgacaataatagtaaatggaaaatatcacttgcactgtaaagattcaatattaaaaaaggaccttcttgaacgaaaactaaccgtggcctacatcagtgagcttatgacaacactgaagaaagaaaactcataactccaatcaccttcccctgcttccaaactcatagcccaacctgaggaatttaatggaatacaattatacaatgttaaaaacagcaagcactatgaaagattataaattgaacttccctgaaaaatgagcaagtaaactatgtaagattaacataaaccaagaaattatataaccaaatctttggttttccttttagtgtttccatgtattgtttcaatgggggtgttcttgtacttttctttatcgtgtactctttcatttgtttcagtgaaactgtagttttattttccatgagaggtttaatataatttttgcatgacaaatgtttgcaccttttgcatattaatactcagtttgtacagtttggctgcatacatcccaaaatggcacctatttgataaaggaggtagtgaaatactaatgtgccacctaaacaggaaatcattccaatatgtaaatagttttgtacggaacattaactgaaagaaaagggacaaaacttgaagttgcctgtatataatactagtaaggaagcaccctacagagattcattaggtgaaacaaatatcacatgaaaacatatgcctaagaagaaaaacacaggaggcatcctgccatgtgcactgccaagaaatgaaccaattagaaatggcaactcgatgggaaacagggaaagccaagctaaggctggttagatgcattacaatgctacaaattagaacaagaccaagaaccagcttaaacatgtcacttggaaaatatggatagactgaatccattaatcacgtaacacaattgaaagtagtataattgaattaaataggattatcatgtctacacattgcatcaacataaacaatagaaaggttggactgccagtaagatcctgcggtaagttaacaataaggcctggtattcctattaacagaatcccttgaagcaagaggaacattacaagaggattgtatactcaagttccaatggaccaatcaaaaaccccacaactcactcatcacaaaataaattgaacttcttgtataaaacttacctaacttttttaggacataaaacagagacccctctccttcatggccaattagatgactcacatacttgcaaggaccttccttgtaatgtcgaatatttggggtgattggccatagtattctcaaagtatggccttgtttaatgggaactgctttaacaaggacctggaaatcatcaaatatcatattaaaacttgtaatatttcagaaaaatgcacctgattgaagcaatgcacttgatctctcagcccattattagcaaatgataaatgtaaacctgtaggtgttcacttgaacacggatgaccaggaaaggaaaatcgttcccttccagtattcctgacaccacaaaacttattttcaacaagagtttgaagattgtcaagactctctgcaaacacaataaatataagacaaaatataaattgaagaatatgtaaaagagatgagaaaaatagtgtaaagtagtttgctgaagaacctttcccatacacaacaagctgcatcaagttggctgagtagtgtgaatcataaaatttaataagctcaagccttgtgtccaatcctttctcctttggtttaacctccaaagtgtcccaatttcctagagcaataaatgatcagaaaaaaatgaaataaataacatttcaacctttctagcatgtaaaacataagtgtcttgtttggttcacattaaaactcccatggattttgatttcagagataaatctaaaatactattacggtgtaaatattcctgtctcataataagtttgctacaatttacaactttcaccagtaacctttcgtagtagtacataacttttactctgttagtaccttttttttgcgggaaggtaacttttagtacctactccctccataaaaaataaaatcgatttttttacacaaatctggacatagtgcatgtccagattcgtgtataaaaattgaattattttcggacagagtgagtaacttacaagtgtttcttaaaaaaacattgttattatcaaaagtttatgtttgactgcactattctgaaacaacattattttaagaacaagcacagtattaccatgctggcaacttaatgaagtacagtagaataagagggcagatatcagttattctcaaagtataagaggcaccaaagtaatccatgtaggatttgtgaactcaatggctgtccgagactatgctgttctcgccaatgataggaaattgatggtgtacaaatagaaatatattcgcctgatctaagagctgccgtagtgttctcccattccaatcacttccatgcctcaccacaaaatcgaagggagatgccaggtagtgttgcaacatgttaggtagatgctgagtcatattagtctggctccactgttgaaaggcatgggccagcacaaaatgtgaaggcgagcatgcaaaacattttactcacaaggacacaattctattcgtttctatgtccttcatggctattgtctaatttgtgaacacagtgcttttgcaaatgatcctcacagcccacatgtgtcaacagccaaacttcaagaaaagatgacctgatcctcagatgatagaatgaaccaccaacgaagggaatgcatctctttcaagaatacatgtagactggaaacataattatataaaagggctgtccagtttaccaattaaggcttattttctcagaagaacatacagtaagttctttttatatccatatcgatagaagagaattcagctagttaaaatcagaagttcatatggcacagacattttctgcaacaccacaggatcttatcactaagttaaatgggtgaagtctaacatgttcttgaaatatgtatgagttatgattataaaatgaagatagaaactaggtagcaagagttgcagcgtccactgctgacatataaatcagatactacaagaaaatgaaatgaggattaaaacacacaccagtgccaaacttgtgatatggatggctctccaaggaaatatggttttgaagctgaaaccaaaagagaatatagaatgaacagaaacatcataacattaaatgagatgagtaacatctatatctttcaatttaaggagcactacacactatcatataaatacattatcgcagcaatcacattaacatgagggtggcccgactatcaggaataggcaggtcaagcctctaagtggcgaattgcagcctcactatcctaatgagagatgcacaagtaggcaagaaagtaataggtatagtagttttctagtttctagcatctctcttagcatagaacaaagaaataaaaaactaaaagcaataatattttttgctggaagacagagtgacgagcagcagccaggcaccctagcatggcagaaacttcagaatgaatgacccacatattgttctttttcttgctatctgaacacctaaaaagttaaggacaaatggacaacttccatgaaggtaataagggaatgtttttgttcaaactttaaacctatgctcctggtgaggtaagtcatgagccaaacatatactgttacagtatgtcaagcgaagtcaagcacctcaggacaatggattgataactcaacacgcaagtttggaacagtcaaaggcggttctaagtttatctctgacgatatacaaattattttgttggcaaacctttcctagaatcacaacactcttgtcagtaagcaaaacttgtagattcaaccagagatgacaatcagtttcactaggcatatgtttctgatgaaagatcttctgaacaataatacgaaatgcagctatcaggatatccttgcttcatggcattcaaaacaagaacaagaacatcgaatctaacataagattgatagctacagcaatttagaatgaaaaaacatgtaggagtagatgaatttcccaaaaataattgcagtaaatgaaaatgacatatgaatacggtaccattcaactataacagaataagattccactataataatgttttttgcctttttaacagtaaggtacctggttcattcgccaaggatctgataataagtttttctgattttctgcagacagagaaagatcgaaattagaagttaattctctcagaagatctggtagatctagataagagggaaagcagtatataccagagtcaacagcttttatctccctaagagttgcatcggctgacagtaatggctttatgaagaattgtgcaaacctaaaacaagagatgataagcaaaatgaatcatattctgcaaaataagaataaaggtaaaagaaaagaaagcaacaggaggtacctgtccaaagcatcattgaggcaatcatggttcacatcaaaaaagaagtttgtatgttcacaagttgtgaaggcattggttgaaccaccatgctataaagaaaattcccatattacacaattgatgattcatagtagaggaaatacttatagatcatgatatttttgtacgattatatgaaacaactatgcctcccatcaactatgtgaaaggccaggcaggtggcttttccaactagagctgttaatggtttaaagggcccaatccctgcttaaaaattccaatagtaacataccctacaagaactatattgtagtgtgaccaactggcactaggggaaaaaggaagttatccattatcaaacataaactaaattaatcgtacaaatatagatatactctaatggcactctacttttaaagtactataaatgtaaaattaaacaagtggtatctgttaagcatacagaaagcagccaagtacctccataatgtgctacaagtctctaatctttcccaagtgattgagaatatttatacatagaatgagagattacactacattaactttcagctgccacagacccaacagtcatggaccttccagttgctctcaagcattccattaaaaattggattcaatttgtgttcagtcgaactatagaccaaactaagatcacttacaaaacatcgttttcagatgaacatgacaagtaaaaaaatggcctggtaaaatacatacctctgtaatatacttggagtaactgtcttctataggatatttctcactagcatagaaaagcatatgctctacaaaagaagaaacaggcataagggaatcaaacaatacagagctacacgcttatattacaatacatgccatgaaacttttcacatgtgatagttaaatccaaccaagataaaagaaaacaacgcaatgaggttaaaactatggctattaatgtgctaatactcttttaaaggtacatcctacaaactatactaaaatgcaatatgcaaaacaagccaatatgtaactgttcaaattaaacatagactaggctcagaaacagaatgacacataagaaagttgtgcacttgcacttactttacttgtccaaccaaaggtaaatacaatgactattaagtattaaggaaattaattttctaattggataacagtggcacaccagatttttataatggtagtatccaaataagatgttgaaaacaatctggtgctgaaatgaactttttattaatacgtatcatccctttcaatacaaatacaatatctcaaacccactttgacatatttatactgcattagtataacagtctccagtcccgaatgacactgttggtacctttgttctttaatgaatctcatgagtttcagataagtaggtcattttacgtttcatcttttttttttcttttttttttttttgctctctgacactttgcaaattcactaacaaaattttagttgcttattagctggatattctgacagcacctatcataagattctacaatctccgtcccaaaataacttcattttttacccatcagacacataccaatacaaaagcaaaaagacaaaaatgccctctactttatcaaatccgaatgcggttgttcccaaatttatctagtcccaatgcatttgttccccacttccataaactccaatgcaatgattgcttgaaagatgaagctattttgggacaaataagatgatgaaaaatgaagttattttggaacggagggagtagtgttgaatttgtacatttttttacatgcgagaatcatagttgaaaaaaccgaaccggatcagcagcttaaccgggaaagaggaaaaacagaaccagtttctaagctcgggtcagttatgcgctaggaccattcatgcatttcagaccactttaaaccatttcaaccatcaggtttcacggtaaagtagtgaaccgatgtcaaaccaggactggttgaaccagctgagtttgggctgcactgttgaaatgggtccagaaggaaggcccaagttctcatcaaggcctccaccaacttcatttattctaaatatttgtgataatagctcgagggcagggagtccaaccttggtctctgaactgaacaccacctcttgttgctatcctgccatctcataacttgtgtttgtaccagtagataaactacacagaacagtttgttgaaccgtgtaccactggactagtgaactagcttgggcagttcgctcaacaggtccaatatttttttgctatggtgagagtcaatcatccatgcattttcatggccatgctatacttgttttaatttctcatccagagatactggcaagaagctggaaatgtcttccagatgttttgatggatgtgatcccaaaatcgcaaaagtagcaagctgctgtctctagacctaaagtatttttttcttgcacattttcatatggtatgcctgtgataaaaaatatgcacaccaaatctcgattcttcatgttcatgatcaattcaacaacttaaagcaaacatgcttgttatgactgtgtcagtccacaacctgacaacctaaaacaatcttatgtaacaagccaaatgtagtggtacggtaagcaagcctagcattgaattatcatcactaacatcatgtgtagtgattaccacagcagccacgactaccatattctcaggtcttatgcaacagctcgaagcaggaaaaactcaccaaggaagtgcgcgagcccctcgagcccctcgggatcgcagaagtagcccaccgagacgttcatcgacgccgccgcctgcaagcaaaacaagtagtcgcgggattcaagccaagccaaaaccccccaggagataaccaaacccccttccccatcccgatcgaggtagagcgcggggcgagcgaagcgggaagaaccttgtcggtgtcggggtcgctgacgaggaggcactcgaggtcgttggggagcacgacgcggcggtacccgcgcttgtcgttgcgtggcctggtgatctccacatcgcccgccgccgccgccgccgccgccgccgccggtgggaccgcctcggcgggggcgtcggtctcggggggcctcgaatccatcgcgtccgccgccgctgactcgccgccgatggcgtggactggctgagtccgcgaggcctccgggcggttgcggttgggttgggtttggctttggctttggcacggcgagaccgcgagagaggtgggggcggtggatctgcggcgcgggtggtggacagtggactggtggttaggcacgtgaggggtggggggggagatgggctgggccggaatgccgccaggtcagcgtgcgtgcaccggggacatctttctgttcgaagttcgagtcaagtcgagtaaacgatttgtcagttttctccgaatttccagtggcgtgtctagaacgttggaatcaaaaggatagtcactggacagtatggttgtgtttagttcagcgcaaagtttaaattttggttgaaattggagatgatgtgactgaaaagttgtatgtgtatgacaggttcatgtgatggaaaatgactgaagtttggatccaaactttgaatctaaacacagcctatgtgaaaatatagaatatggtacacgattaaattcttctattcccttgaaaacctgaaaagtggctgaggacctctttcctatggcttataagccaacgctaaaatttatcagcttcaacttttaaaatgctaaggacacctatataaaagttttacttatattatttttaacattgataagctgttacggcttatagttagccataagcaactgatacgaatgatatgaacttgaagaaagccattcatcaaatcgctggaatgcaacgtgacaaacaaccaaatttggcacacatgcaagagtacatttttcccatagtaatgcatagaagctacgcagtgcttaactgttcattaataccatgtgtaagagagttgattgtcatcagatgtaaataaaacttatttcacaaatagacccctgaaaaaacttattctataaatggtcctttttggacgccagagtcactggcgttgtcctattgccaccatagcgggtcacattgacatggcaaggggagcgtgccaatgaggttggtgccgcccccctcctccccccacccacgccattttttttcctctcctctatagtgtagaggagatatgtgcaacttttttattttcttttattttttttatatatttttttcacattgaagagcacacaagaaccaaccatagaaaaattaaactcaaatggatgaaatatgtgacctatagaattttccaaagctcaactgaaaagcttctcgcctcgaaaacacaatcttgcaagcgaaatttggagtttctaattttgccaaacccaaaaagcgggggagaatcggatgtaattttttttacatatccatggatatataaattgtctgattccgagtccgtatgaatgcctattaaaataaaggacactcaaatgtaaaaaaaaaaaaaactcaacaaacccatttttttatagaatgtaaaaaaggcaatgtacaaacttttttttgtttttttactataggaaaaacaaaaacaaaaaacaacgagtgaattttaggagaggggagagaggggggggcgctcaaggggggagggggcggcgaggctagcacgctcctcctggcacgttagtatctgaccgccacggtggcaggggcgacgccagcgacgcgtctcaaaaagaaccatttcttggataagtttttttagtgatatatttgtgaaataagtttttcaaaaaactaaattgtgaaaaaatccagtcttcttctccccttccctctctccttttctcatgcaatggggtaggacttgggctgcgttcgagagcatgggttgagaaccctccctctcatgcacgcaaaataaagcgactgtttaatgcatgattaattaaagtgttagcttaaaaaaacttgaagactgaattaatatttttctaaagcaactttcgtatagaaaactattgtaaaaaccacaccgtttagcaatttaaaatgcatacacgtgaaaaacgagagaggtgagttgaaaaaatcggggaaagaactcagcctaaggagggacttgagtcccccacactcacgttggatcagcccctatttgcaagttgctacacttgtgaatcagttctactgggcaagctctggtgatgaatgtgaaacctcataattagaataaaaaaagaatgctgctcgtcaacgctacctttttttcctccttttcttttttttttttctcaccaagttggtataagatacttcctccgcctcgtaatataacagattttgacattttacttatactgtttgatcattcgtcttattaaaaaaattaaaattattatttattttatttgtgacttactttattttccaaagtattttaagcacaatttttcgtttttatatttacacaattttttttaataagatgagtagtcaaacagtgcaagcaaaaaatcaaaatcccttatattatgggacgaaggaagtacgatatatgtgcatacaactgatggtattttttctgctgaggtgcgaattgctttttttccctatgttttcacaatgaaatttgatacgttgaattctggtaatctcaccactcaaaaagaggtgattgaactcaaacccttttgcaaccaaccaaacaaaatatcttcaatacaagatcatttcatacattcatccaaacaacatctcgctacaaccaggatcaaccaatccagccaaccaaacaacctcgttaggatctactcagccaggctatagtcatcctgactcatacgagccaggctagcatgatgcgagcaaccaaaaacaccctaggtgatcactagtgtcacggtcaccctcggtgccagcaaaaaggagagtcgtggagaaagtgtcgaaagaaatacatgcaattttgtctaaaaaaaataagaacagatgaaattacatgccaaatttcgctgcatacacaaatggaaaccaactataaaatccccaaattatatatgctaaatcatccacactaacaatccaaccatctccccaacaggagatttcagtaaataaccaaatacaacgctggtgctaatcatttgattccttattaccgcagagattattctttcggaatttgtaaatatataaaaatgttgacctataacttcatctgaccaatacctcctttgaatgaaccatataaaggtctcgacctcctgaagctgaatatatcggttatttgataggaatgcggctgtggctcgtcgtgaactaccttttcgtactcgttggtgtggagacggccgtagacttgtatactgagtatcttctttcgtggtgcattaactttgacatgattatcgaagaactcaatcagctcctctttcttgagatccctcagtgcagcaacctgcagttgcagaactccaggaattgaaaaatggtacatcagaggggcgatgtaaagaaatagggcctacctccgcctcttttctatcaaatttcagagttccttcagagatctctcgccagaagaaagctgattcctctcttatattcttgtatttctccagcttcatattgatgagagcattcacgtcactctgcagattacgcaaatcactgtttattccatataatgtttacgagtacagaaactgccaatgaataataatgacagcatctgttgaaccttgaattctatatcgggcatttggtatagagttccttcaaacatcttaagaaaagcttccactctggcatctaggttggctggatcctgtcaaaccaacatattagaacagaagaaaattgtttcagcatttaaaatcgcattgagaactctatgtaccttcacagttgactggattgtaaattgcaagccacggacgcctgaatcatttctggataaacaggatagcgtggtcaaatttttaagagggattgcatgctacctggaaaacattattgcaaaacaacacaaacaaacaagatacatcttattatgtacctttgtttaagccatgttatgtagccaagttgttcaactgaacgtaattggtgaaaggctggttgcttagcaacaagggcaagcaactgaagtagaacattttgtttgaggtcatcctgatgaatctgcattgaggaaacattgttacaggattgtaatgtgtattgggtgtattaaggaaaaactataataatgtaaggtaataaaagaagctagactgcaatgtttgtcatatgtttgagagttggctatcatgtgtccccaaagagatgaggaatctgcttttgatgggtgcaacagctctgtgttgatccatttggctaagcaggaatggagtaatttttgataataagatggtgtcttctcctttgtaggttatcactttagttactcggtggctacatacctgggctatcctccaccaaccgggactgcgggatactattgccgtggtatcacaacagttggaccaggtggcgcatgagtttttttacccaagagcatgggtggcggtctagtctatggattgatagccactaagatatatgtttatgtcaaacttttgtgcttgggagatgttctgattgtttctttcttcttttttggctgtgtgcattttatgcagaggccgggggtgactcagtttgtttgtatcatcttgatgtaattaactgagtctaaataaagcttccattatctaaagaaactgctagagtacaaaaggaggggaaaactgtaaatgcacaagaaataaacggaaataacaccaatgaagtgaggcacacctgaatataatgcagaagggaagaattttcatcctgctgatttaggcataaagctggataataatacctcaaacctctttcaagctttacaattcgctttgtaagatgctgcgaggagggcaatgctttgcacaaactgactggtgcattgaataagatgtcttcaacatgctgtataacaccttttacctcacccggttccatgtttcctaatatcaattacataaaaaagaacatcaataatgcagagcattctctcaatgagtagtgggagaaaaagggtcattagcagcattacaaggtaatataaagagcagtactaaagggcctgttcactttgatgctattttcaaccttaccaaattttggtaatgttactaaaaaagtggctacatttagtaggttttttttggcatcaaagtgaacatgcccaaagatgagggaaagtagctgtgaattaacattcaagttattaaacaaaccagcaaagtagctctcaataaatgtcttccccagcagatgaggcaaaaatttctctagatcactagcttcagtatgagaaattgcagcaagtttttcatcccatgtccatttttgttcctctaatatcaatgaacaatagtacgatgcctgctgatgaggttgctgaaatttgaaattctcatacgcctttgttatagtttcctgatgatagcaacaaaagatagaacaccctcactttatgtcaaccgcatagaattctggtttaatattgcgtcatcaggaaggaccagaatgtttgtaaactgtagcaagtcattacctttatcacaacaaaacggtcaaccttcacttcaaatgcagcaatttttccaatgacagtctccagaagggttctcattttgtcattatagccaaccatagttatctgtaaaacaatcataaatattcaaggattagaaaagaagaggattttgtaaaaaatatggctcataacatgccatgagttctgagttctgactcctggagaagaaacatttgaatgatagatcacaatttacgacacgtccataataaagcttcaccacatacaacaatgtcaggttgctaccacacgctatacatgaaattaacagggattaggcaatattaaccatttaataattgagaatctaatgccatttgtatctgcaaataaggaaaaaaataaaataaatggagataaagctgctgtgatgtgagactgtgacttgtgaaagcgtaaaatcatgtatgtcttctatactccagtactactactaatgaggctttataagccagtgcctgtacctaaccacatccagttaaagatctgaagcagtatgtggaagtaagaaggaaaatagttcaagggtcaacactgacaatggtatattccatgcttctatatgcaacaggaatcaggattatgatattataatgatttaagtaagaatcaaatgacaagcatctgcttattagtaacatactatcatcttatcacatttatgcaaacacggtatgtgtttaggacaaaaaatgtttatgcatagaaacactgtcagtactgcatcatctggattaggaacgaagataaacaattgattatttcatgcaaactgcacagctgacctgaaacccagtgtcatttggcttaacagcatagtaaagaccagcaacttgagcatcataagctgaaagcaaaacaaacttggtcggttattgcaacatggaaataaacaaaggcaaactaaccaggggatggcaatgtccttaatcgctcgattttctagcataagcagtgtacgtagaggatgagttttttttccgccaataaaaagtacccaggctctaaacagaaaagaattgtctccaacttctatattaatctcactcttgcatatgtcctttctaaaatgaattatatgtgttagactattgtatcaagagaagttgggaatacattgtaactgtttatgaaactatgccataagaatcataaaaaaattaagacatctctgtattactgcataccataatcatttaaataatccattagcaaccttgtgaacatatcagtaagaactattgnnnnnnnnnnnnnnnnnnnnnnnnnnnnnnnnnnnnnnnnnnnnnnnnnnnnnnn

SEQ ID NO: 4618 - DNA, 2237 bp, Oryza sativa
  unsure (1)..(2237): unsure at all n locations
ggaaataaacaaaggcaaactaaccaggggatggcaatgtccttaatcgctcgattttctagcataagcagtgtacgtagaggatgagttttttttccgccaataaaaagtacccaggctctaaacagaaaagaattgtctccaacttctatattaatctcactcttgcatatgtcctttctaaaatgaattatatgtgttagactattgtatcaagagaagttgggaatacattgtaactgtttatgaaactatgccataagaatcataaaaaaattaagacatctctgtattactgcataccataatcatttaaataatccattagcaaccttgtgaacatatcagtaagaactattgattctggagagctacgggacagtggacagtggaaatacatcttgatgtaggctttgggtgtgaagaacatcgtatcaggcttataccacactatggaaaacagtgttttccgcagcatacaaggaaaacttccctggataaaacaaaagatatcaataaaaagtttcccaaaataaaattatcaatacgttttaagaaaaaataccttctcctcaacattcttcaatgaaagatcacttggaatgaagatgttaggttttggtatgtgcaaatcttccatgggagctctatttacccagttctgtacaaattatgttaggaacgtgtccacctccaaacacatagattggaaaatatgataggaagagtaacatccaaattacatgtacacctgtatgatggaaggagggactgcttcaactgaatacgatgtaccataccatggctctgttaagttcgtctgcccttcaaacttttttgactcccagaatattctgaaagtaaatgtagaagacaatcgatactacgtaagtattaatgcctttaagtaaaagcacaatgaaataaaactaaacaaatacatacatcaagtgcgtgaaaggaaaaaaggagatggttgtgataggatcaacttcgtgaggagcctcttgctgttttttggaattataacagtaaaaaatgcaaatggactagtgatgaaatttcctccactttttcgtaggaaaaaacttgaaatttatgtaaagcgaaagttctctttgttgtgtcatccttctagaagagttatatagtgtcttacaataggttaagtcgaagaatctgaagcaacagctaagtgcaaagcctgaataattattttccagacactacatgcggtaattgaagagcaacaataatagcatgcattatactgttactgctgaaatgaacaatcaactcacagtagctagtccccagttctgtttgataacattaaatgcataagattactgtcaaatagaatacattttaagtatgttcatggtttcatactgatctgaaatgaaaacaaaaaacagagtataacttactaaaatacatataatatacctgtgtaactaacatatgctgaacactaaaaacaaataaaaaaaaacatgactggtatctcaaactgtaaacatagcagaaaaaaaccttatatgggccatacttacttaaaacctacctaactttatctggagtcaagtcatttaatatactctgaatagcatctggtgaaaactttgatggcacagacgatgcaatcagccaatcttccggcggaaagatctgtaatagagggagattaggaaaagtcatgagacgatgatactgagcagaactcattttgtaatttatgaatgaacattctggcagaatttattaggtggaactggccatttcattgttcaataaaatttgatgtctaaccttcttgttaatttcattttgtgcaacgaataaaagtatcctccaaagatcactcaagacggttgtcacatttttcaaaaatgcccctaccttcttccctcccacctgctcactctccccaggaccatctctctttcagttcacatatattttcaaacttttttgagggcatatgcaaatttaaactttgggggtcttccaaagctcagatttttttttgtcacaccataacaagaatcatgaaggaatcataagctacacagaagcctagacctagagccttctcattacccaagaaccatgcaccactgcatcgtcactgccaggatcacctttttcctcagttacttctctggttctcccttctcgtccctgatnnnnnnnnnnnnnnnnnnnnnnnnnnnnnnnnnnnnnnnnnnnnnnnn

SEQ ID NO: 4619 - DNA, 826 bp, Oryza sativa
caagaatcatgaaggaatcataagctacccagaagcctagacctagagctttctcattacccaagaaccatgcaccactgcatcgtcactgccaggatcacctttttcctcagttacttctctggttctcccttctcgtccctgatcccactaatgctagagaatacaagtatccaaaggctatgactagagattgccaagctggggcccaggcattcaccacattggtctcttactcttagaagccacatcaaccaccttgaaacatactgcagtcatgcgatatggacttattcagtgacaaattgtagagagaagggagttatctggtggaatacagtgcatattctcaaatcccacccacacatccctaggaattctccccgcaaaaaaaaaaaaacatccctagggattcaaccaagtcttatccaacaattcataggagtcatcaagcaatagggccttaaagtatcacaagaagatagttttgcacaagattcttcctcgtacaaacttgtcactgacaaaatataatataaggtgcagattgatggcagaatgaaagacaatgtccattcttgatttttgcatgagcactcacatgactaatcaaaagtcatatccgtcaaatatctaggtagtaagattttgaacaagtcaatttcttatataagcacagagatgccttctctctgccctcaattcaaacttctaagagaaataaaggtggaatactgtacaggaaatattgacaacatatacctgcatgtttgaggaaatattgacaacatattggctaggaggactcttgtctcggtagtggaat

SEQ ID NO: 4620 - DNA, 631 bp, Oryza sativa
tggtttgtaaaacttcattactacatgatcttaatttataagatgtacatgatctaatcttttcataagttgctacatctggccccgttcgatctccagttttggagatagatttttatggcacgcaaaacgagaaacctcattagcacatgattaattaagtattaactattataaatctgaaaaaaggatttatttgcttttttaaacaacttctttatagaaaattttttaaaataacataccatttaacaatttgaaaaacgtgctaacagaaaacgagaaagttgaagaatagaacagggccttttatctccatttgttttctttttttcttatttgtggattacaaatggtactatactctctattagattaaatggtcaatattgcataaccctgatttttcatcatgcatgttttgtgatgttgatattattccttctccagaagttagaccccatggcatgttacgtgtcttactaaaatcctcttcttttctaatactccaatatttatgattgccttacagataaccatggttggctacaatgacaaaatgagaactcttttggagactgttattgggaaaattgctgagtttgaagttaaggctgtccgtttttctgtg

SEQ ID NO: 4621 - DNA, 670 bp, Oryza sativa
cagtaatgcagactagtcactgtgatttgattggttatctcagcagtaacagaatactgtatatgcttttagtgttgctcttcgatcactctgcgataccagattcattgttcttgttgacttaaatttgtaatacttctagaaaactgatctaacgaagagaactttcatatatttaatatgtgtgtgtgtgtgtatatatatatgctcctgctgtttcatgtcaaaaaacgaagataacttttgcttgccagaaattttattatttcttcgtcaaagaaggtgaaagaaatttctttgcttacattgccccccccccttttttttgtcaaatttcaaaaaccaatctgttcctttcattagttttttttttaatggtcatgtgctttctcttctcctttcacactctatatattccttaaattagctatttttttcccactctacctttttttttttttttactgtgggcatcatatacttatcgtccacatctcatttcaggatattctgggagtccaaaaaatttgaagggcaaacaaacttaacagagccgtggtatggtacatcatattctgtggaagcagttcctccatccattatacaggtatacatttggatgttactgttcttgttatattatccaatttctatatttggaaacataaaa

SEQ ID NO: 4622 - DNA, 444 bp, Oryza sativa
aagcttttcttaatatgtttgaagggactctataccaaatgcctgatgaagagttcaaggtaagatgattgctgtcagtatttgttggcttctgttatagcttgctgtagctcttttgccgggtcggccgaaggttgctgtagctctattgtatggttgtatacttgacattatacagagtaaacagtcacttctgttacctgcagagcaacgtgaatgctctcattgacatgaagctggagaaatacaagaatataagagaggaatcagcgttcttctggaaagaaatttcggaaggaactctgaaatttgatagaaaagaggcggaggtatgctctatttctgtaattttgtccctatggtgtcatttttttttatacctggagttctcttgctgcaggttgctgcactgagggatctcaataaagaggagttgattgagtt

SEQ ID NO: 4623 - DNA, 1219 bp, Oryza sativa
  unsure (1)..(1219): unsure at all n locations
nnnnnnnnnnnnnnnnnnnnnnnnnnnnnnnnnnnnnnnnnnnnnnnnnnnnnnnnnnnnnnnnnnnnnnnnnnnaaatttttggtattgttaaagaacaaaagaaataccaatggttggaaagtttctgtatcagtcaagaacagaagaaaaaaatacaatatattaaaccagtgtgcaaattgattattaccaagcacttgttgagcatttagccgccgcctagggtctggattgagcattcccttgacaagatcctttgcattatctgagacccttggccatgggtctctcttgaagtcaatgacagaacggataattgcctgagcaacaccctgttcagtttctgcattataacatggaaacaaaagaaggatcaggaatagcattcaacattacaacattgccaggtctacaacagacacagacaaaagtaaagattgacagtttctaatgtcgcagactgcattagtgcagaaatgtgatcagaagaggtcaacttctatacactaaatacgtagtatttaatttagtttatacatttggttatcagaattgaagaattcatgtacaaaactaacctgcccaaaatggagggactccacaaagaagaatgtaaaggatcactcctgcactccaaacatcaacctcagggccataatttctctttagcacctcaggagccatgtaataagggcttccgacaatctcagtgaaccgttcacctgcacataatcaataatcacttaattagcccatcggaaaaatatatacacgcacgtatacaatgtgaatagacaacctaaggtaagcccttctagaggcactgtgaagtcatcatttgacaactgagaactgactgacaaattaaaacagcacgcttgagatataggaaataaggacattgcgactgttagactgtacctggggtgaaaaaaacagacaggccaaaatcaattgccttcagagctgcagtttccttcttgtttgcaaacaagaaattctctggtttgaggtcccggtgcatcactccatgcttatggcacatctgatgttttacagacagacaaaaatacacgttattcatcacactatggaagaaaaaagaagttgcaacaatctagttaccaattcaaagaggcaggcatggataactaactaaaaccgaaactgatcagagtctaattaatcagacaaatagacaacagaatcatctggc

SEQ ID NO: 4624 - DNA, 4775 bp, Oryza sativa
aacatgaactttccagttgttgtcatctagtaacaattctaccataaatctccaccagtgaactcgatttcttttcattatactgtcagactacctcttcgataacgacgacaagaaatcaaacaggatcatttcagaaaatacagtagaaagcaacgaaggaatagagaaatcaccgaagctaccaatctcacctgcacgacctcgacgatggtgcgggtgaccagcgcggcggcgcgctcggtgtagtggccccgggcgacgatccggtcgaagagctccccgccctcgcagagctccatgacgaggtggacggcattgtcgtcctcgtaggtgtcccggagcgtgacgatgttggggtgcttggggaggtggcccatgatgtccacctcccggcgcacgtcctcgatgtccacggcggtgcggagcttcttcttggagatggacttgcacgcgtaggcgtcccccgtctcccgctccgtgcagaggtaggtgaccccgaactcgccgcgcccgagctccccgcccagctcgtaccgcgcggcgatgtcccgccccgtcggctcgcgcagcaccaccagcctgtgccccgacggcgccgacgaccggttgtactcgatcgagaacgggttcggcttcttccccttcttctgctgctgctgctgctgcttcggctccttctgcttctgcttctgctcctgctgctgtttcttcctcccgcggccgctgccctccggcgtcacgcagcagttgcccatctcgcttcagccaagatccgcgcgacgcaagaaccccccgcgaatcaaagatctgcggcgagtgggaggccaagaaatggcggcgtgacgcgttgggggagggaggagaaggaggcgagaggggggaggaggaggaggagggggttaaattgggaggtggggtggattcggtggggagacggggtcacccgtggcggcggctggggggcgtgtgggaatccgccagtggtaaagccaacgacgaggccgcggaggaggggaggaggaaggtaggagaagacgggggtgctggtcaaagatctccctctctcactcggctctctcggctctcctttttgcatcctttgccctcttctcttctccctagtttttttctttttctttactttttttttccttttcctctcatttttttaagggacatttaacttattgcaacttttaagctgtagcaattaattatttgtcactcgttttatatgacatgtgaaccgtcgtgtctctatgacatttgggtccagtgataaataatttaacaccacttgtaagtggcaaatatttaattaattctttttttaagctcttccttttcctctcgtgtttattttcccctctgttccccttgcttgtgctatggtgtgtgtaccaatggttttatgttaaagtagttgtttagggcattggtaatgtgtgtgttgattattgttttttattaataaagattattaaaatgtatgtaagaaaagcttttaagaaattattaatgacatttttgcgtaccaaagctttgggatgagtctatattataccttttataactgtcggatttatctaaaaacaccactcaactataaaaatggacactttatgtcactctactatgaaattagacaatttacacttacgccactcaagtattaagatatgagaaaataccctctaagagtaatacaattcggttttggaggtgattttttaaaaacattttgacatccaaataattttttttcttatttgtatcgcacccaattagtaagatatgtaaaaaaatcaatataaataaaaacatgtattttgtttttctcttatcatgaaaccaccatcaaaatcaagttgtattgtccttgggagaggtattttgccctttttattagttaggagtgtacaatatccggttgcatagtttttaaacaaacccgataactgagtgatgtaatataggcttatccctacattttaatatattttcatgcattaattggttaagattttgatgtttacctaaaaagtcttaaattgataactgtttaagaagggactatgttgattgtgttgcttctctcgttttcctctttatctcgtctgatgatcttgttttctggtttccccccatccccccccccccccccccacatctgatatttttgtttttttgtggtcctggtgtggcgttgtttatgaggaaaatgactttgaacaaagttttcatgaagtgattgaataggactaaaagataaggagagggttaggtgggtgattaaagtgacattaagcagcatttgtccaggtttgctgcctaatcataagggggcaacttgacgctttgatgggtacgggaaggtagtttaatcagattgtggaaaaatctagctgatggttaatgctaatcggtttagctattggtactaagatggtgtaatttcaacgataaatcaagaaaaagttggtcgtactcttgttgtaacaccaggatattctttttcacttcctgatagaattgtgaatttatttttcgaaatagaccctcgttgtaaattgtaaccacttgtgttctgacaactcctgttacagaaaacaaatctagcgtcacagttttactgatatggtggttagtcgtgaattatccgaatatacatttccttctgctttgcaacatcagtgtatcagtattcagtcaaggttttgaggggcgactaattctcgcctaatttgggattggttctttctttttggctactgcatgcctgctgtatcaactcctgcttgtcaaatacatctatatgtcaacttccaaaaagaaagcatccttgtgttcagctaaaatttcttctgaaacatttgcagattcaacagaaagtcaatcgaagccaattcaacacaaagtccatgggcaatgttacacacgagggaattgacagctgaaatgtgaaagtgcgtaattcctcagttgttcaaccgcctcctttttttttgcgcaactgcatgcgttgcgtacgttttcacaagctgaatttgttctttagcttgtcgagaagaacgtccactcaaaagttttagcttcaactgtggaactagtattagtatttgttctttaactgtagagtagttgctatcctgaacattttgtagagtttaaaaattttggtcaaatctttgtactacttccgccggttccacagtacttaatgtgtcagggttatggatatcacatacctaatagtagtcgactaaatctcggcaggacccaacacataccatgtcttatacggaaacaacctccggatataggaggagttccacataagaaaagatgaatagagtttctacatggaaacgataaggactactcggattgtatccatattggtctctctgttctatttggacaaggggacacctatgggtataaatacaagaccccctaggaggagagaggacacggaacaatagatcaagacacaagatcaacatacaagccaacatgcgccaagataagacgccggatatcgacttcagagataagcatagctagtcccctacgatgtctacgaatactgttaggagagacatcgcgttgtctctgatctcgccgggcacgaactcgatgaggaagactaccctattttcgactacgggatggtttcatggccgccatatcgacaacagttagataggctaccccaaatattgcactggtgtgattatggtgaataagagcaacgaccggcttcggccaacatgatgtagggctattacctgacaattcaagggtccgaacctgtataaaaatcctcatctctgtctcttttacctaagtctcgcatatatcctggtaccaacgatccccatactatgcaaataccggaatcgtgacattaaacgtcgacataatgttttggataaaattaagatcaaaattttataactttaaacttcacacatatttaactttaagacactataacatataaagtactataataaaagtaaaaatatataccatccctccataaaaaaattcaaacatagctataaatttgaacacacatgtgtttctttctatctagaattaggtttctttaaaacagagagagtatacctattatatatatatatatatatatatatatatatcataatagaaaaatatagttcaagatatattttaaagaccgtgttattgtttaaaacgttaagaattatatagctagagaggatatgtactgtacgacggaattctggtggtgttcttttctcctgaagatgaagataaagattaagttttttacgtaaaacaaggtggtattaatgtatgatttattgaggtttaattattacaaacttaaaaaacatattaatatgatattttagaggaactttcatatagaaagttttcgcacgaaacataccgtttagcagtttgaaaagcatgccatgaaaatcttaatcttcatccaactcttatcggagagaagaacttgggcatgtttagatcccttggtaaaattttatatcatgtcacatcgaatatttggacacatgtatggagtattaaatataaacgaaaaaaataactaattacacagattgcgtgtaaattatgagacgaatcttttgagcctaattgcgtcatgatttgacaatgtagtgctatagtaaacatttactaatgacagattaattaggctaaataaattcatctcgcggtttacatatggattctgtaatttgttttgt

SEQ ID NO: 4625 - DNA, 1608 bp, Oryza sativa
tgtcacaggctcacagctcacatcgtcatggtttttcatccactactcgtagagatccacttctcatgaattcatggccgggggtcgctgtctgcacgaaccgggcatttatgtttccgtgttgtctcgccttgcatccggtggatgctaaaagcgccccagccgaagagcgtgccaagagaacagcaagggaaagggacacggtcaggtgttcacaccctctgcggtggtgttatttatttatttatttattttgttaagatacatattttacctttattttgttagcaatttttttcaatcggtttaacagtatgtttttttccagataattttctatataaaaactgttttaaatatcaaacaaatctatttttcaagtttacaataattataactaatcatatgttaattgttttttcattttacgtgatcttactacaacatcattgtttcacctattcttatacttatttgtatcgcttattgtaaataaaaaataatctatagcatgttcttaacggtaaaaggcaaatgttataaaatactatttataagtgtgttaatcttcgtcttcatctgaccaagttcaaatgggacctgtgtctcgcggtttcgtggtactagttaagatcctacacggagcattcggtgcatatatagtgacttggtagtcatatcatgtgggtgagatttctccgtggaattacgtgatctaccacaggactttaagtgagtagttgtgtgtgtggggtatgagattgcgttgcaccgtccatgagctcaaggctgcaccataggtcaagagtttgaattctgttcctacctgaatgtgaaatagaaggataaaaagagcaggtttgtacattttctcaaagaaattgtcaggttttcgatcacttggaaaataccataaaattaatggctaggattactcgagattcgtggatacaataactttatcccctcatattcttccccgcaagctcgtccgctcgttctcatttcatttgacgccttacagattgaagcgcttgccgtcgtctcccctgcccgactgcaacgcccctccccggtctcaccgactaaccgaaaagcgtgaaagttattagtaaggcccaacgcaccagtcggcctcctccctttcctcctctctccttctcgtcctccctaagttgggtggcgacactattccccacccctgccttgcctcacctcctttgagctggatacatcgtcaaccccacccaccgctatccttcatccatgtgacttcagtgacaccccccgtccactgccgtcacccaaagccatccctctaaaccccagggaatcccctcccacctctgcccccaccccagcgctaaactctaacctcatagccatctcattattgtcatcgaagaagagcacatcatcgccgggaagtcaccatcacaagtgggtcgtattttttctccccaccctaccccagcacacaaatcaactcttgaagacaactccctatcggtcagggagcatgtgaggtctcaccttataactagcaaatcgctttgtcaaattacatcttacattttacattttatatagaagaaatgcacatacctg

SEQ ID NO: 4626 - DNA, 588 bp, Oryza sativa
  unsure (1)..(588): unsure at all n locations
nnnnnnnnnnnnnnnnnnnnnnnnnnnnnnnnnnnnnnnnnnnnnnnnnnnnnnnttcaccgttctaatttggttctaccacagtctaatggcttggaatttattcttcgattaatgtgataatttatatcttttagaataaatatggcacattcttttcgagttgtcttaataataaagatttctacgttttttttatgtctctgatgatttttctaaagctatcttaataatatatatatagataaatgtacatatttggcaaagaatatttacatatttattattggtattatatttttattccaaattttatttttaagtttattttggaacctatattttcaaaggaaaactttttaattgtatcgcttaaggtgtgcacctggctagctgctgtgcacatgccatcgttccttctgtttgttgacgtgcatcgtccaattcttgctcatcgtgcagccgcgcggctcgacctgctgctgtggatttccgttgctactatacattatagcctaactattctagaacctaacttaagtttagaaaatcggacaaaactattttgagtccgtttgcatgtaaaga

SEQ ID NO: 4627 - DNA, 676 bp, Oryza sativa
cacaagctgaatttgttctttagcttgtcgagaagaacgtccactcaaaagttttagcttcaactgtggaactagtattagtatttgttctttaactgtagagagttgctatcctgaacattttgtagagtttaaaaattttggtcaaatctttgtactacttccgccggttccacagtacttaatgtgtcagggttatggatatcacatacctaatagtagtcgactaaatctcggcaggacccaacacataccatgtcttatacggaaacaacctccggatataggaggagttccacataagaaaagatgaatagagtttctacatggaaacgataaggactactcggattgtatccatattggtctctctgttctatttggacaaggggacacctatgggtataaatacaagaccccctaggaggagagaggacacggaacaatagatcaagacacaagatcaacatacaagccaacatgcgccaagataagacgccggatatcgacttcagagataagcatagctagtcccctacgatgtctacgaatactgttaggagagacatcgcgttgtctctgatctcgccgggcacgaactcgatgaggaagactaccctattttcgactacgggatggtttcatggccgccatatcgacaacagttagataggct

SEQ ID NO: 4628 - DNA, 581 bp, Oryza sativa
tccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgcc

SEQ ID NO: 4629 - DNA, 1552 bp, Oryza sativa
  unsure (1)..(1552): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacaggaaagctgacacaagccatcagggagtttggtgcagcaaggcaggccatccaacttaagactcgtcaatctatcaagcctcacagatgcttttgatgtcatccactttgggagctgccaaccaaaatatcctctgatgtaaagttgttctaagcagtatgaagggcacaactcatcaaaaacctccttgattcgtcgctgctcgtctatagaaatgattccttcctctttcaagaatccatcatctctctgcctatcagtgcactctaaccaccatatggcaagatgtttcttggcaccaagcatggcctttgcagcggaagagctggcagatacattctccaaaccctttatatggagatccctgagctgagaaagaggtcccagctcctccaaactacaccactcatcttttgatgaactgctacccatctgagctggaaacgagtataatgttctcaaacttgtaaggcgaccaaaacccctaggtatactttttatgtttgtgcccataaggttaagagatcttagccgctctagttttataatgctaccaggaagttgttgtatttgttcacagcatgtaatcccaatgtactccaagaatttcatcttgccgatgccatctggcaggctacgtatgtcagtacgggaaaagtacaagtgcctcaagttcttcaattggcatagagaatcaaaagtagcaagttgtgcatatactatactcagaacccttaagtttgagaatttgctgcataaatcattggccttcaacttgatatgagtacttccataaaaaaataacgttctaactgagttttgttcttgccatgcactccaatctaattcattctgtatgcacaaccaacgatatctatttgaatcgaggtcagtgactctaagatgttccatatgaaagggtagtgcttcatctttagccacatgtcgacaaaatgagcgaaccacatcatgcatggtccaattattattgtcgccggcattgtctgtaaaaggttccttatgattaactcattgtaatactcctttcctagttcttccggttcatttgattttccattaacaaaaccttcactaatccatacttcaacaatcaaatgtttattgggtttaccatatttagggaagagtgagcaatacaaaaggcattgcttcaaatgagggtctaggtcatcgtagcttaaatatattgcatggtttatctcttcaggcattccatccactaaccatgaaggacttcttagtacctttccccactcaatttcatttatctctttgtggttcaaaagccctgcaatcgctttgatagctagcggtaaaccaccacatctttctaaaattctaaagccagtactctttagcttctcaatcgcatactcatctttcaaagttgaagcaatctgcaagcggttgaagcccatgatgttaatacatat

SEQ ID NO: 4630 - DNA, 4983 bp, Oryza sativa
gggtctaggtcatcgtagcttaaatatattgcatggtttatctcttcaggcattccatccactaaccatgaaggacttcttagtacctttccccactcaatttcatttatctctttgtggttcaaaagccctgcaatcgctttgatagctagcggtaaaccaccacatctttctaaaattctaaagccagtactctttagcttctcaatcgcatactcatctttcaaagttgaagcaatctgcaagcggttgaagcccatgatgttaatacatataggctagatttgcgattgatcgagaagggtaatttgtgcatttgccaaacatagaattcttagctattatttaagttagcatttctattacttcccggtctaaatttaattagagtaaccttacagttggttgtttacttcatactccctccatttcaaaatgtcactgactctaagttgtcccatttgagatgatagtgcttcatctttagccaaatgttgacaaaatgagcgaccgacatcatgcatgctccattcactattgggcattgcctgtataaggttccttataattaactcattgtaatactcctttcctagctcttccggttcatttgattttccattaacaaaaccttcacttatccaaatttcaacaatcaaatggttattgaggcattgcttcaaatgaggggctagctaggtcatcatagcttaaatatattgcatggtttatcttttcgggcattccatctactgaccatgaaggacttggtactttccccactcaattttatttatctctttatggttcaaaagccctgcaatcgctttgatagctacaagtaaaccaccgcatctttctaaaattccaaagccagtactctttagcttctcaatcgcatactcatatttcaaagttgagacaacctgcaagcggttgaatcccataacgttaatagatataggatgcatttgcttacctacttttttttttactttctttagtaacgaagatgatcattctctttgttttttgatctagaagggtaatttgtgcatttgacacacacagaattcttagctattatttaatttagcatttctattacttcctggtctaaatatatttagagtaaccttacagttggtttgtttacttcataatctgcaaaaactctccaaccctttgcgtactttccaatatgtctgcttcactacagtataacacatcatatatatcttgcaatctctatttacattcattaaacctataaacctatataattcatcccctcttagtgtacttaatagctatttcctgatattccgtgcttccacatcatcaagaaatgcattgcccgttcgatcgaatctggatacccctaataaatactttgtctctctattcacaagcttactattgtaattggacccatctcaatccatattttcctctccttctccacacccagcatgagccaccggcctcatactctgccatgacgagcgcaaatggcatctcctactctcccacatgacctcccgatcgcttcacactccccttaccctccaactccctcccccacttctaaggcccagcgctccaccacaatgtgtttttatacaggcacggccttatcactattggcttctataggacaattttatatgtatgctttgtgtgatttgataattttgttgtgtttatttaattttaggagcaagtggcttatagtatgctcaagcttttccctaagcaggtatttatttggctggatcacgttgaggggtggataaaaatctgacacaatcaatgcgtgctgtatggattctcaaatccttccctgtttatgtgttatgatgctaggcatactcctgttaatgcttccatataatgactgcaagagtataatgtttccttcaaatataagatagcatattgataggttggtattccgttctccttatcttaagctttgtatactcctacaaatttatttgcagaagcatggcatttttgtgcctcgtatgtttatgtgccattatgttcacataactaggcctcactatattgttgtccatgtctactcttatatctccatcttacccttttcacttagaattagtcactttttttaactagctgacctaagttggttctgtagaatacgtcaaacttgctcagagttttgccattcactaactgatgatatgcttattttctcttttgctccaatcagataaaaaaaagtaattatcacccagctcctatattttcttgatttgcacaaatgattctgaacattcccctagagtttccctataaaataccttggattgccactacttcttggaaggatgcgcaagacggatattcaaccaatcttcgataagatcgcagcacgggtcaccggctggaggggaaaaacatgggaccagtagggagatcaactctggtcaagtcaatgatgacagcgcagcccatctacctactcaccaccctcaaggtcaccaaagaagccgtaggcctcctcgaagtgaagagaaagaggttcctatggaaatgcaaaataaactagaaaaagatgtgcctcccaaccttgaaccgggaaaaaccggaaccagctcctcagccggttcgatttgctgcaaggactggacatgcaatcgaaccggtcacaaccagatgaaccgggcagtttttggtgaaaaccggtgaatccgacgcctctgaaccggcggttctggcgagcacgtggagcaggctacaaaggcccactaggcccaagtcatgcatgtgtcatttttactgaataaatgaaaaaagggtgggaagatgggattcaaaccctggttgcctcattacaaactcaataactaaaccaactagaccacttatgcatgttgttcaagggagaatatacatataatatgaatgctccggttctgcagtcgaaccggacgacccagcggtcagacctgtgagccggtgaacaagaagcttgaccggttcgatggccggtccggctttttgcactatgctcccaaccgtgcaaagaggactgggagttcttaacatggagaagttcacgagggccctgcgcctgagatggctctggcacgaatggaaagaccccaccaagccgtgggtgggcctcaagacaccatgtgatgaaacatataaattgctcttcaccacgaccactacaataacgattggggataataaaacgattcgcttctgggactcatcctggctagatgggcaaaggcattatgccactaccctatgcagtctccaaaaataaaaagagaaaaaaatactacgtgaaggaataaaaaacgacgtttggattgatgatctggacttaaatggcagcacccatttcacagtggatctgatcaacaaactcgtgtccctgtgagacacaacccagagcatccttctagatcaaaacaagcctgaccatactgcctagaagctttcaagccatggagaatacttgggagcgtcggctgatagagcgatgcatgggaaccataggtaccaattttaacggcttaatatggaaatcatgggctcctacaaagtgcaaatttatgcatggcttgtgatccaaaatagagtttggacttctgatcaactcgtagccagaggttggccaaatagcgggacatgccccctctaacgtacgtcaactgaaacagcaagccacctggttgcccaatgtagatacaccaaaagaatttggagcctaactaccgcatgggtagcatatcaacaactagacccgagtcactaggacccatgccaaagcgttaacgactggtgggaaatgttagccaactcaaaggaagtacccaagaaaggcatgcggaccctaatcctactcgtcgtctgggaaagctcgaaagaaagaaattagcgggttttcgagcacaaggagatggcaaaattaaaggaggcaagaacttgggctatgggaggagcaaggcagcttcgggattttgtttcgaaccaaccataggtgccatgtagctctgtacattttttttccttacccctagccctaggggttgtattttttacctctatatttaatgaaatagcacaatctcgtgctgattccttcaaaaaaaaatgaaactagttaaatagcacccattccacatggttttattattaggtggtggtgattgtgcatgcataactgacataacatttgatccacaagattagagacaaaaaatggttggcatacctagtatatctattactccttaaaaaacatctagtggaggtgacagtgaatctgccaccccactattgctttggctgttttcagaaattacctacagatattttctaatattgtggaatcatcgaaaatttggtttaaacaagtgaatagcatataatcaaataaacaaacaagtgatactaagatatctattatatattaaaagtcccatgaaacttcctacaaatgctcctaagccaccatgtgtcgctcctacaaacgcttataaaccgccaagtggcactacaaaatctaatcgttcatttttctttaaattagtgggtccaatattttcaaccattagatctaataaaaaacaaaactcccctatctccatgtatccccatctcccctcctcctgttggtacgtacatacttcactcctctcctcatctctttttaatttcttaatctctaatttaagccacatatcttatttttattgttaattaaataaataatttaatatctatgctgttctatgcgccatatgctttctatggcaaccaaatataacaaggaaaaaaaatttcactataaaaaagttaataacatattttatgttactttaaataattctacaaacatgtgtcgctaaattgtatcgacgatatccaatctatctattatatagtgaaagcccatcaaatttcccataaatgctcctaaacgccatgtgacgg

SEQ ID NO: 4631 - DNA, 12587 bp, Oryza sativa
ttttgctatataattatagcatttgggtgcaatccaccggtgcagtttgcgcgccatctaaataccttataatctaacaacaaatattatattactatgaatcattctacattctacaaacatgcatagctaaattaaatatatagtatcgaaataaaaatttaaaaaatacatattcaatttgctaaaagaaaaagaaataattcaacaatataggtcgcagcatgatatgtttgaaaacatgtatagctaaacacactacataagcaagagtaactaactgaaatataaatagtctgagccactatataaaaaatcgagtgccttttagtagagaaaatattaagttttttttctaaatgtgctcaaataatccaaacaagctaaatgatcttctatttaatattccacctttataagtttctcaaacacggtctacgattcatgcccgcgcgaatgcgtgggctaccttccttgtttgataaaaagtatattttgctgtgacatattatgatattattttcttctgcccaaagcaaagcttgggtattttgctagtgtgtacagtgtgttacttttaatgaaactgcaaatacatgttaatgttggaaagtgctttcatggatattaattaagaatatattttatgagtaatcaagtcaaaggttaatcttgaagactttaccaatacataataggattttctacagagggaataattaccaaaataaatactctgaggcaggagtaagaaataaatacgaacctgtttcttgagtaacaaccaggcatcttgccgagataatatgtccacgcggtggtacggctgtatggccttcatctctcgggcaactctttcgtctctggtggtgatgagaacccagctgccttgagcagccgagttaactaaagggattcttaatgaattgttccaagcatggacgctccacatatcatccatcaccaaaaagattttctttccagatattgcttctcgaaggattggctgaagcagggacagttcttgatgcccactgtgctcaccaccggcaccagtgatggccgtcctcaccagctcaggatcactgaattcctggttaatgctcagccatattattttgtcgaacttctccttgatgtcctggtggttgaagatgttctgtgcgagggtagttttaccaatacctccaacaccgacgatggcaacgaccctgacgttgctgctgatactcgccgcacttgcctcttcctcctccctcgttagcaactccaccagtctccttgtatcttgctcgatcttattcccgacaacgcctgaccgatcaagctctggtgttgtccggcgtaagccatggccttgagctgtcctgctgcagtcaccgtagcgatcgagcttgatgaagctgaattgctcggcacgctgcttgatgccatcaagccgctggttcagcgccatgatgcggcttccaatgtggtgggcgttcaagggattccgcagggagagtagcgacgggttgttgctgcgcctactgtcctgatccatggctttgagctgacacagctccaggatgtccgtggcatcgtacatggcatccttgagctccttcacccaaccctgcacgtgcagatcggtgatgcgcctccgctccgcgtcggcgaggaactccttgagcccatcaagcctgacgcggaggctgtcgatcttgtcagagataccaagcagcatgcccacctccttcctcgccatcttggcaagcacattgctcaggttggatgccaaggcctccagaaccacagccatcaaggctgaacgagtagtgcttctgcatctcagatttaaccagcttgtcagtttttacatacatatatagcaataaaacagaaaaggtgctctaaaggattgtgtacctggctttaattagtatgcaacttctccgatcctgttcagaaccaagtagattgatgaaatggaatggtggcacagagctcaatatatacacatattgagccatttttaattaatacaatctattttctaaccctactcaatggctttcctaatcctgacagcaatgtggatgcaggacacctcacgcgagcagccacgtattagattatcaagaatcttagtcaacaacgaaaaggggatcaaatttcaagcgaactgattgttgtctccatccatattgtggagatatctaagaatatgccatctcctaacaactaaacaaaactgatttcaaacaaaactgttgacgcaagttaaattgtactgaaataaaccatctctgcactgcactaggaagttgccgcgtcactttccacttccaacaaaataatctcagatgttctgctgtaaacatatctgtttctttaatagaaatgggagggggtaacatctatagttaaaaaaactaaataatctcaggtggctgcatcagcatcaaccttcacttttagattagcttatcacaatgtgttgactcgggacttctcaatatttttggtcacagtttgttggaacattgcaatcagtgttctgctcttctagcccatgaatctcggccacaactacgccataaaattatcatacatgctgtgaagtttgtacatgacacagaaattccaatgtacctatgtcaaataaatctatcaagaaactaatggggtcgctgctctcccttggagaatcagtagatggaaaaactcttctttttttttctttgaacgaaacatacaaactgttatgtggcaagaatatttcctggtattggatttttttttcttcaatatttcctgctattggatttgtctgacagaacatttgatggttgatataagtatcaaatacatgtgcttcattctttgcccaactaaaggtgccttctctgactggtgcgaattattagtgctaagctattaccaacaaaatttcaatcagagaatcacaatggttttgtttcgataatgggaataaaagctcaatgaacaatgatgtttccatgtttcatatattgcttcagtagttcaaatgtgtcaagataggaaatatcgtagatccaacaaaaaaaaaaggtgcagatttcctaggaaataaaaaaatgaaacaaaattgaaaaaaaatacattaccctgccatgacgtcaccgatggagctgctgccgcttcagctacccttggtgcagagcaaggcaacgcggacgcagctcacccccactatccagcacacgctgggatccccaatccaggcctcaggctgctcatctgcattgccccacggccgcagccgttcctgcagtgttgggagagagatggggaataaccccgcacgagttcaccatggagagcaccacactgcggaaatacgaccacctgctgagggatgactatcttatcggcgccgatggccatctccggctgcctctcctgccgaagtggtttttgctgctgcggatctggaggtggaagaagacccaggggcgaaaatgacattctgggcttgttcactttattgctaaaatcgaccttacctaaattcgacatctttctaaattttgatagtgttttaatgagaggaaacttttgaaactatcaaattttggtagaattccattggtaagatcatgtgtagtttgtaaccttaacgaaatttggtaacacaaaaatttggtaggattgaacataacaataaaatgaacatgcctttcatattagtgttccacgttgatgcgtcttatacgtaggtggaacaaaattaaaagagtcttgtctctctagcgacaatttccttaaaaaaatgagcaattctacggtccttgaggaggtaccatgaggtaccaaaaaaattagtgtaaattatgaggtaccatgaggtaccaaatttacaatagaaaaattggtacctcctcaaggaccgtaaaattgctctaaaaaaattattagggacaaatcttataatggcatttggagattggccacttgagttgcaaatagttaaatttcccctcaaatgcaatatatgtcatgaaaaatcatgaagaaaaaaaaaagaagaccatatagcgtagtgacatatatcatctcaccaaatttctattgtataatcaattgagcaatgagaagaaaaattcggatgcatataatatttgtattgcttatatctcggatttgtctctcatattttttagatgttacgttcgagttgagtttagacttgaacatttgaacatttaagatggtatacatttcctagctaaatgatatcaaatgttttaaaagttgtatctaattagttactatgtatttagaggtacaagggagatctgtcaagttctccgggaatggaaacttatacttctattcatacaatatgtgacggtatcacatactatagtatttcttctaggaatcacatattatagtatttcttctaggagtacttcatatgtctttggttcaaagttcaaactagacaattgttcatacgggtgaaaacagatcggacattcgcttcgttcctaatccgtctgaaacaaggatatggtggggcttgtagaaattcggcgaatacgaacccggatacggatatataatatcctgttatgatccaagtagattgacaaaatggtttggtggcatcgagcaaaatatatagacgtatgagaactttctcaattcatacaatgcgcatgaaggacacatcgcgcgaccaggcacgtattatattatcacgagtcttggtcaacaaacaaaaaggatcaaatttcaagcagaactgattttcagttgtctccgtccatattgtagagatatctaacaatatgccatctcctagcaactaaacaaaacagatttcaaacaaaactgttgacgcaagtgaaattgtatagaaataaaccatctccgcactgtactaggaagttgccacatcaatttccacttccgactaaataatatcaggtgttctgctataaacttatttgtatccttaatagaaacgtacgggacggcaacctctctggtcaaaaaaataatctcaggtggctgcatcagcaaacttcactgttagaatagcttatcaacaatgtattgactcaggacatctcaatattttggatcacgggttgttggaacattgcaatcagtgtttttgttcttctaacccatgaagcttggccacaaactatgccatgaaattatcatacatgctgtgaagttcatacatgacaccggaattccaatgtacctatgtcaagtaaatctgtcaagacactagtgttctgaaactatcaaattttggtagaattccattggtaaagatcatggttaatttgttaccttaacgaaatttggtaacacaaaaaattggtaggattgaacgtggcaataaagtgaacatgcccttcatttccgtacgtgttccacattggtgcgtctacgtatcatgccatatatacgtatgttgaacaaagttaaagagccttatctctcttgtggcaaattacagggacaaatttaagaatggcatttggagagtggccacttgagttgcaaaaagttaaattttccctcaaatgcaatacgtgtcaagaaaaattgtaaagaaaaaaaatgaagagcatagagtgtacgtagtgacatatatcatcaaatttctatttcataatcaatttggatgtgaataatacttgtattgcttatatctcggatttgtctctccaatgttttgacattgcattcaagttgaattaagacttgaacatttaggatggtataccgtatacgtttcctagctaaatcaaactaaatgttataaaaattgtatatattgtttctatgtatttagaggaacgagggaagtacctcaagttctctagagatcaaaagttgtacttccgtccatgcagtatgtaacagtatcacatactatagattttcgcctaggagtacttcatagtatgtctttggttcaaaccagacaatttttcatataggtttaaatagatcagatattgtgtcctatccgctccactccgaatctgttcgaaatgaggatatggtggggcctgtagaaatctggtaaatatacaaatgctgatacggatagtttccagtttagatcgaagtaggttgatgaaatggtatggtggcaaagagctaaatacatacacatatgaaagcattttcaatttataaaatcacttttctatgcctactcaatgactagcaatgtgcatgtaggacagctcgtgcaagcaggtacgtattagattatcatgagtcttggacaacaaacaaaaggggatcaaatttcaagaactgattttcagttgtctccatccatattgtggagatatctaccaatataccatctcctagcaactaaacaaaactgatttcaaacaaaaattttgacgcaaatgaaattgtacagaaaaaaaccatctctgcactgcatgcactaggaagttgccacatcacttttcacttccaactaaataatctcaggtgttctgctgtaaaaatatatgtttctttaatagaaacggaagggggcaacctctctagttaataaaaactaaataatctcaggtggctgcatcagcatcaatttttcagttttagattagcttatcaccaatgtattgactctgaacatgtcgatatttagggtcacaggttgttggaacattgtaatcagtgttatgttcttctagcccacgaatcttggccccaaccctatgccatgaaattttcatacaggggttgtgaaatttgtacatgacgcagtaattgcaatgtacctatgtctaaatctatcaagacactaatggggtcgctgagctccctaggagaatcggtagatgtaaaagctattctctctctaacgagcgtaagagctgttctgttgttgcaacgagctttcctgctattggatttatctgatagaatatttgatggttgatatcagtaccatatagatgtacttcctttctttgacaaattaaatgtgcttgagtattgtaatatgctggcttaaacaaatgtaaacatgtctctggctggtgcaaatatttagagctaagctatatatggcctggcgcaacctcaatcacaatggtttcgttccgataatgggaatagctcaatcccaaagatgtttccttgtttcacatggtacaacaatttggcgggggtgggtgcgatacagtgcaataactcgagaattgaacgttcgagtgcaacaacttgataagtaggtgcgttttagtataagaacttgacaatttagtatttgatacataaacttagctaagcatatgctaggtacttaaaatatacaaatccacgctagtatattgtcaaaataagtacttaaaaattaaatatgtataaaaaagtgctccaaataattaagttgccgcataacttgttaacttattgtatcgaaatcgtacatatcttgcaagttgttgcatttatgtgatcacttataaagttctggtactaaattacacctatctgccaagttgttacgttaaaacgctcatttctcaaattcttgcaccaaattacacccatctgctaagttgatgcaccgtaggtgtaatttactctttcagtagtttaaatgtgtcgagagagaaattagcagatccatcagaataggatataaatttcgcagaaaataaacaaaaaagggaataaaggagggagactggccggagcgccgctcccgccgttcgccacgtggcagcgggccatggagtcactcacccctatccagcacacactagaatgctcttggagcgccctaaggccggcctcaggtttgctcatcttcatcgccctccgtggccacggctgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcatccctagccggggtcggcgtgttagctcctggaggtggcacgttggacccggtcagatatataccagccttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaaaaaaaaaagagaagacgatcccagaacgatcgggggctggaggggggatgatctggagagggtttttagaataagagctctctggctctccagctctttgtagcttcttcatacacagatccaccagaacacaggagtagggtattacgcttctcagcggcccgaacctgtatacatcgcccgtgtcttgtgctttttccactctcgcgaactttccacagactaggagcttagaatcttacccagggcccccggccgaactggcaaaggggggcctgcgcggtctcccggtgaggagccccacgctccgtcatctggcgcgccaggtagggggctctgcgagtgatcttctgagctctcgcactctttcgtgtgcgcccagcttttcctgttcagcccaatggccgaacaagcaaaggcgcacaacctctctccgagcgttagcggtgacgatggggagccaaacccacgccgtcgagctcgtactccaccgccccctccacgccaaagtcctaggagggaggaggtgctcgagagggtcgaaggatccgcgacttcgacatccacgggtgatggagaagggcgcccagatggggagcgtcgcctcctcgtctacggcgacggcagcgcgccccagggcgcgctccaagctgcgggcgcgctcttgcgtcacccgcctgtcgtccctgacctggagtctccagcccaacgatgactggacgacgtggccaacttggtcatgacggcacagcggcgcctaggtgctggtggttggtcctccgccaccaagacctctggcgctgctaccaccggctccgtgtcgtcaaggcggagggcgcgacgagcggcggctgttgctcgccattcggctgccactccctcgtcagcgcctccgacccgggaagatcagcgtggggggccagatgcccgcatcgatatcgagcgccggcgtaatggtcggcgtgctccccacgcaacggagggcgcctcctcgtccggagagtcacctcaacacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccataaactttcaaggtacatatccgcgcccaggtgaagaagcggacttacatgcagtccagcgaagggatgatgagtcacttcgctcatatattcagcggttctgtcaagtccgcaacaccataccatgcatccctgcacacgcggtgatctacgcgttcaggaggggtgtgcggcacaaccgcatgcttgaaaagatcgcctccaaagagccccagactaccgcggagctttttcagctcgcggaccgagtggctcgcaaggaggaggcctggacttggaacccctccggttccggtgtggcagcttcggccgcccccgggtccgctgctcggacagggcggcgtgacaggaggaggaagaaaaggtcggcccattccgacgacgagggtcatgtcctcgccgtcgaaggcgtttcgctggccacccgaaaggggaggcctacgagcgacaaaaagaaggaagccgacgctccctgacctcggctacttggaagagcgaaggtggcgcgcggcccttacagccgcgcgctaccagcagagcctgcggcgctaccatcagcgccacgtccgggcccgatcactctgcgtcgatgacctcgtcctacgccgggtccaagcgcgtgctggattgagcaagctctcaccaatgtgggagggtccgtatcgagtgatcggcgtccccaggccgggctccgttcggctggccacgggcgacggcacagagctgcctaacccgtggaacatggaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccctgggacatggtgaactccgggggggaatcggcaaaaacccacaatcgggtcacccataaccctcggtcaccatgctcccggcctggccagtctcgacatgtggatctccccaggcactagccttgacccgcgtcgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcgtataacaagaagggggcccgaaggcctcggaagaagaaggaaaagctattaagattggcggaggcctaggggctcactccgacgcgcccgggtagccggcctcgccgtcgctgtcgtccgcaccgtcgtcaccgcactcctcgtcggagttgaaggcaaacgcgagccaaggggccgctcattattgtcggtcggttttcccttgctgatgcgcgcgatttgcgatcgccgggattctgcccgaagagagagagagcagggaggagaggcccccgagccgaacggcggcccaaggcccccgacggccggagctggccctctgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctgaagatgtggcccctgacgaagaagatcggccccgccgaaaggtgcagcggcccgtctacttcgttagcgaggccctccgggacgctgagacccgataccttcaggcccagaagatgctttacgctatcctgatagcttcgaggaagttgcgccattatttccaggcgcatcgggtcacggtggttacgtcttatcccctcggccaaatcttgtataaccgagagggtactggacgggtggtgaaatgggcaatcgaactcgctgaattcgatttgcgctttgaaccacgccacgcgatcaagagccaggccctcgccgactttgtggcggagtggaccccagctcccgagctcgtctccgcccccgaggccagctcgggcccatcgcagctgcctcacaccgccctctgggtgatgtagttcgacggcacctgtaggaaccggccccacctatcaccaggccttagaagtggcgtcacgcccgaccgcttccctcggggagggcgatcgccctggcataacgccaggggctactgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattggggtttgga

SEQ ID NO: 4632 - DNA, 9765 bp, Oryza sativa
cgtccattaatgaagagaaatcaagttgaagggaagagagaatgagtccccacacaaaagaaagagagggagagatggtgcatgtggtatccccttgagatataaaaagaggaccttgtctacttaaagaaaaaaaaagagaagacgatcccagaacgatcgggggctggaaggggggatgatctggagagggtttttagaataagagctctctggctctccagctctttgtaacttcttcatacacagattcaccagaacacaggagtagggtattacgcttctcagcggcccgaacctgtatacatcgcccgtgtcttgtgctttttccactctcgcgaactttccacagactaggagcttagaatctcacccagggcccccggccgaactggcaaaggggggcctgcgcggtctcccggtgaggagccccacgctccgtcagcgcggctgccacacttgggtgccagtggtagccacccttcatggacatgatgccgtggtgaaagaggcgagcggatgagactaaaacagcggtggcgggcggttgcctgtagcctgcagcgtagatgtgtttaaactagaatgctctcagcccatagctagcgcagatgtaaaattgattgtcgcaggtggatatttggctccgagggtcatacccgcctagaaaaataaaagtccaatgtcgctaaaaaatatttttctagtagagtgtgacgccacgtcggctgaatagaaaagcaggcttggactccagtggtggcttacccctatccaaacaatcacgcaggatgttgtagcttttcagcggccacatttcgatggtgatttcccttcctagacacagggattgagaaggtcaagcgctttctagtttagcaggcgacccatcaagtttgtggtattttttgataggggagattctttattggtatgaaatcattgttctatatatggaattttccgggagataaataatctggccgacaaagaataaaatgaggaggaaaaaaagaaatagagaaaaattggggagaatggcatgaaatcaaacgattcacagtcctggtggcatattttgacatgtcttgcgaattgagtgacaaatgcgcaaagcatatcatattatcaaatttgttaagaggagtgtgagataggactggaaatggggaatagtcggaggattagtagtatgatccattagtatatggtagtatggtagtcacacatggatcatatcgtggcagtcatcaaattccgcgcgagaggaaatgagcgcggtggcacagcgagcagcaggccttaacgagcaacaggaatacaggatagcgtgaccgatatccccttcaccaagacaccgaggctgagcctgtcagcgtgcaggcctagaagagcatctcactacaacaagcagggctataattatctgaaatttaatactcctccgtcctacgatacaagtgattacatcattttttataagaaaaagatgaagaaaaaaaaatgatatgtgatggtacaaaagatgatgggtgaaacaataaaataatacaaaagttggtaggtagaggaataaaatggtataaaagttgataggtgtggataataaagtactatcttgaaatcctaaaatctcttatattttagaacataataaaggtgaaaatatcttattctatgagatggaaggagtattctgcttctctgattctccaaacaaacctccggttgttgtgttctgtctctggctaatctctgatcttgaattttgctgtctatatttggcatgagggtcaacaatgcgatgaactagtaaaatggcaggatccatgtgtgtataactgaatatacatgacaatttaaccggtgagaggatggtgagttgtggtttgctggtctatggttctatatatgcgtctatcatggtgttctccgccatcaaggatccatgtgcaagtacatggagcggtggcacgaattggtaacgcgatctcgacgggatgggcagcatcgagctcaggacggtaagagggtggcaaagcgctcgcgacgggaagagaggtggcacagcgaaggaggtggataggaaaaaggaagattcgatgataggggctagagtaaaaggcattagcgatgcacggacttgttaagtgggtataatttagtgtatgaacttgtaaaatgctcattttggtgcatgagcttgtctggtacttgcaaattgaggttaaaatggtatgacaagaccgatttttttatgttgaacattataaattataaattaatatatcacgtatgtgcaccatagtagaaaggtatatttgtaaacttagttttcactttatctttctttttgtcttttttttctatctcttgcatcattacttgtttttttatgcaatcattatgtcttattatatgtttatccatcttagacacatgtttacatggagtttaaatcaaggacaaaatcagcaagattaatcttgccgtgcaattctgaccttgtttgcacacaccaaacaagttcgtgcatcaaaatgagcgtaatacaagttcatgtactatattgcatccacctctcacaagttcgtgtaccgctgatgcaatttactctaaggaataaattgccctcactgatgtggtgggtaattttctaaagtagtataacattgacaaaatacccatataaatgaacggttagattacatacatactacctatacccctactcctattactagaatgatgcactcttaaagaactctctagttaatgttgttgtgaatgttcaccatctaaagatagcaagagcacaagctagaaaaaggaagcatttagaatgaagaacttaattttaactaaaccactatctatctatctttatatactaaaagtccattaaacttcctacaaacgcttctaagccgccacgtgttattcctataaacactcctcaatcgccacgtggcattctaatatatcagtggacccactatttttaattatactagattatctttaaaaaaataccacagcccacctccctccctctcccaccggcccacactgcaactacatacgtacgtacgtacacgtagtatatgtacgtttcctcctctaatacttcctctctcctattctctaaaaaaaaacctccctcactccttcctatttaatcctattatattctatagctaacaattttttaatatagaaaaaatataaaagaaatgaaatatcttactgtgcattttcacttaagttggtgaaacctactattttaaacattagatttaaagatgtacataattcaaatcaatgaatccattaaatctatatttaatgaaataaacaattttgaacatagatcgttattgtttgcatggccaccaaagaagaaggaaacataaaaaaaataacaatatctattaattatgccatcttgaatcatttttacataataaagattgattaaatgtcctctataacgctcttaagtcaccatgtctcatgtctcatgttttaagtttagacattcaaagaaaaaaaataaaacatgtaactatgggttttcagttaaatcggtaaatccactgttgttaaccattatatcttgcagctgcaaaaggtcgggtcttgaagataaaaaaaaatggcatttcagaaaataaaaaaaatcaccagtttccacttggatcgtttagaaagactagaaaaacgaagtccctccaccatcaccttccatcacatgagtataataatgctcgcctatttccatgtctcgctcgagctctacgctattcattcctcttcagactcccctccctattatcagctatatactaaatgtgcaacaaccaataattgcagatattgacaagacaataattttaagctatacttataattaaaccgatccatatgcctatattttggcatttaagaaatattgtcaatatctatttttgtcattatacatcagtctagaaacaggagtagagagcaaaataaaaacataaaaaaaatataaattcatgtttcaatcagtgttcttaatgatggacaatgcaacttttgtatggcacccgaatcgccattaaatactttaaaataattaaaaaaacaaaactataaacatgaataactaaaaatatacatttcactcagtacataagaaaaaaaacagctcaaatgtgagtaggccaagccactacataaaaaaatggactaatttgctaggcatgtgttctaaacaaaataagtctactttattgttagatgatgaagatgactataaataattgacggggagattagtaaaattgcaatgctaatgaaaagattatggagtaattgtacttttgaagtgcgataaatgttcttttgtttatataccacccttattgtgtatgaaacgctttgttttacaaccagaaacaccgttagtaattgcaatgcatggcaacataagttacgctttgtttgtaagggtagaaaattaactggattatttatatcataatttaagactaagatatctccaaaattcctacaaacgctcctaaaccacagtgtggcaacctacaaacgcttctaagccaccacgtggcactacagtaaattagaggcattcctaaaaattttgacaaaaaaacaaaacaagtaatcattgattttcattaaatttggtggtaatcccccctcctctccccgccacgtggcctactcaactacttcctctgtttttcctcttttccacctatttcatctcttatttttatgctttattagttagaaaatcaaaaaaaaaattgtgtcgaagaactaagcaaccataacatctaaatcatacaactaatttttatctgcttatatctttaaattatgcatgactaagtttaaagtttaagaccaaatttcattataatgtaatttgggttatattttttgattttttgcgtgtcgttcaagcaactataataataataataataataataataataataataataataataataataataataataataataataataataataataataatatatactggattttatcatcctacataacttcataatgatcaaattatatataaagtcataaaagtaaaatgaaaactatgagtaatattcccaaaatatattagttaggaagcaaaagttattctaaaatgtaagaaaaagcatactaatatttgattcgttgtaacccataaaataatattataatcatctcctatcattcaattcctccatcttctaatttttaactaattaataaaaatgattaataattggaaagaaaaataattataattcttaatttatatctgatttttagtttattttagttattgttttatttatagttaaataaatatataagatccatattagccatattttactgtataaaaataaaaatttgtcatttgatcatagacaccaatcctttgtgtggtaaccaaatagcaaaaacaagataacattataaaaaaatgacaaatgtataatatcacaagtacatcctctgtagcgcacttaagacatcacgtgttacgtcttaaataaaaataaaatcttagaaattgtaagaaaaagattaaaccatcagtttttacttaaataggtggatccattatttttaactaatagatatactttaaaaaaaatctgaaaccgcgccatgtgttacgtcttaaaaattagaaaaaaaaatagaaattctgagagaagtattggattattgtttttcacttaaatcatttagaaaagaaataaaccaccactacacttcaccctcccccgcacatgcacacaacacaatactaccggtccccttttctctcagcttgagctctccccttgaatgttctttatagcgagaaataataaaaaaattaaaatatacatactgctttctaatctagctatttttgtattcataattgaaccaacaatttgaagatccataatacctatatttcgaaatgatataaaataaaacaagaaaaataaaatgtcaataaattgaactatttggttccaaccagaaggactaacttgatggtgcaattaggacatatttattaacaataatagttatttaggattagttgaaaaagccactaaactttcaattaaacaagacaaaacaccttacttttaatttacacttaatttgttagacacgtttttccaacaaaccaaatctaactccataatgaagagatagataattgtttatatggatgtattaaatattatatattttagaagctaacagatagattgaaaaaattatctaagcaatgtcgatgaaaaaaattatggagaaacaatacttttgaaatatggcaggtgtcattcaattgatattccacgtatataagtttttcaaacacaatttataatacatgcccgcgcgaatgcgcaggctacctccctagttgttttaaagggagtaatttactatttaactattcagacacactcaaactctaatttaactctcgcactcaaattaacaacttaatacatatagctatatcacaaccctgatattgtccacatgctaactcacacacacgaacaggcaaactaacacaaccatactaggcacacgttctaccgaggagaaggacttcaatatgagtcatacttagagagacatctcttcatcctctgtttcacccaattccacaactgaatggctcatctgaagctaagcgtcctcttgcctatttggaatcttcttcttcatcaccaacaattaatgttgtgcataaatggggaaatgatcctaagtggaacattattgttattcaacacgcaggtcttgatgcaatgatgccagctgtaagcatggaggaagatgaacccttcctatccgtggtgcggatcctagctagctcctctaggggatgcttctacctacagttgtgccagctcctccttcaagtgatctatctggttttgtcctctgcagatcttgatacacttgtcattaattctcctattcatgagccgctatcagcctatcattacatcagtccattgtccattgcactcaacatcctcacaaagtattgcatactccgtccgtcccaaaatatagcaaccgagaactagattggacatcacctagtacgatgtactggacatgtagattgctatattctgggacggaggaagtagtagagcatgtccagatacggtactaggtgatgtcccatctagttctatattgctatattctgggacggaggaagtagtagaattgttctccgtctctggttccagtaattgttgtactcatcattgtgggccatagatggatcgtaacaataataggtgtccctcaagagctcactatacctatgacaaagttctcggatggccaccaatgccacctcttgatacatatgggcaaaagttccttcctccagtttcgaagatcatgaacaagatgccttaacgatcacttaattgtcgccgtcagacgaacataacagttattgacgatgaatatgacccctctcatttatgtcaggggcaggggtgatgcgtttctacttggggttagcttgaatcctatgtgcagctccgtaactataccaccaacttcgaacaaatggatagtctcattgattgagttaggttaactgaaaatacagaaataactgaaaactagtgaaaataaaaactaaaaccagaaagcgaaagtaaatcaaacaaaattcagaaatatcttttaaagttttcttattttttgaaataaattatttttcagattttaaataatcaatttccggaataaaataaatccttttccagaataaaacattttcagattaaagaaattaaatcttgtccttttcaaactggttgattttttgaaacgatgggtcttactgtacgtacaaaaccaaaaaaaaagttcttttttcaagaacgtgataatactaaaagcaaattaaggatcgtacggtaccaatttctaattaattttttaagaaagcataaacaggacagtaagaagtacattactatttagaaggaaagagtatgcgcggcaccagatttataaaagaaaaatgcaaaattttatttctttagaatattttctcagaaaaagaagaaatcaaagaaatgatgtatatatactattaaagaggaatggagaaaagcggtcctaatttttcaaatctttttggaaaggcttctatatattttcatttggcttaggctaaagccaaggagcctctcatatcaacttttcactcccgaaatttttatgtataatttcaaacacttatatgtatatttaactctcgttcaggaattagtcgagataagtaataaacaatattaacaacaggtataagtgtttaattatgatagatgtggataacctctcaatcgtaagagttctaagcagtggaaggaaaaaactagcataagcgacgactccactatatggacagcttaaccaggaacagcatatggtagcttattataagaggagcatattgtatactcaacaagccacataacaaatataacaaatatccaaatatgcaagtgtatatcatataacaaacgagagtatactagggctaatttgaacaaatagcatttgataatcaattgataatacaaaaatagttgaataattaaggaaaattaaaccagcactacataatctaacctggttgcacgggcccaccgtaaaaccttaccctgttgcacaaacccaaaacgctccataggcggagatatcaattaccagtggcggcgaatctaggatagaaattgaggataggctcaacctcaaagtactaagttcatgaaaactaccgttacactagtttttcaacacatacatgattaaaaaaatgatgaaatagaagtaccttgccaacgggaaatgagtgattgcatatttgcatcaaagcatcaaccatctaaagtgagcagccacctatgcatataataatagcaaaattagtgacaataggaaagtaaaaaaattaactaaaagatttggccaaccactagtctacaaatacctgcaattgaattacgaggcaatgatattctgcgggttttcaatgcttgaaatctattcatgattgcatcatcatcaatttttttgaatatttgaggcctttttggttgatttttactctcatcagttgaaagtttaacaatgttgttttcttctccatcgctaatctatcaataaatcaaactatcaaatagtgaggctcaattctttaaaatcccatcatctagctgctgatgctgcttaaatcaaaagaaataaaagatggaatgacagtgattgactcaccgcgctggcgcgctcggcacttggatttggatcggctggatcgctagcgcttgctgctctgctagttgctgccttgctgctgctttcctatggcctacccagtgcgggagtgcccacgccgcatcggtgccgccgcttgcggccggccttcggccgttcggcggctgcgcccttgctgctcgcttttgccgccgcccgtcgcaactcgcaactcagccgccgccgccgcccggtctcgtcgtcacctggtagggttggggaattggcttgccgaattgggggcgtcaccgcatcaggcgttgcttctgccttcgtctatgggctgggccatagttgagcatttgggcctaatctttttccagcgctgcgctgcgtgccgcttcgtct

SEQ ID NO: 4633 - DNA, 7068 bp, Oryza sativa
aaaatcagagggtaggctagagcctgatggagcctaccccttaaaatcgccactgtcaattaccgattttctgctgttctgtcggtgattttgtttccaacatgagatgcactacgatagtgcagtgatactgagtacgtggttttggtctcatgtttaatcctcaaatcgctcatgattttttttcaaagaaatatttagagaaatgtatttcccttgatcaaatcttctttttttttcaaacgtgcacggcgcgtgagacgagagaatattaggtactaccaaatagtgctatgctaccggtgctgtcaacccttaaaatacatttaaaagtcacaaaaaatatgaaaaatttctgagacgtgcaacaccataacttatagtatcacacaagaaatcaactcaaaattcgctgtaatcgtgaagaaacaaaaaagataaactcgttccgtaaatagtgctcaaacagttcacatcactattcacaacagatttgtcttttttcttcttcacgattacaacgaattttgagtttattttttatgtgatactacaagtcatggtgttgcacatctcagaattttttttcatattttttgtgacttttaaatgtatttttaaaagttggtaacaccggtagcatggtactgtttggtagcacctgatattctctccgcgtgagacagagagaaggggaagaaaaggaggactccgtgcttttaaggtaggaataatcacaaaataaatattatttagcatgcccatttaaacaaggaaaatcaaattaaatacagaaacacatttttaagctttttattttcgaaataaattagttttcagattttaaataatcagtttttggaataaagtaaatccttttccagaataaaacattttcagaataaagaaattaaatatttctttttcaaacttgatgatttttgaaaacaaaggacagtacagtaccaatctttttcatgaacggtataatactaaaggagaggatcgtacagtaccagtttttaatcagttttttagaaagcataaacagcacagtaatagaagtacagtactcctccttttattcgttttagcgttgaaattctgtgccaaaaatatttgccttcttaagttacaaagcaattttaatcactacctaaaaaaccatttttgcatatgctcaagacctatatattttttcaaatggttcaaccgtccgtctattcggaggggcttgtaaaaattgctatttccatgcagttggtgcaccccaagattgaattttcacatgtgggtggttatctcgtcttcatgcgaaaatgaaaatcaaggaaaaaataaatatcccaaaaattccatccactgccgctcgtcatcgccgtcgccgaagcgctgctcctcgtcgtcattgttacagtccgccgccgctcgtcgtcaccgaggcccggcagctcctcgttgccgtcgccgcgcgggaggaggagctggggatccgccgccaccgagctccctaccatcggatccattgccactgcgtttcccaaccgccctttccattgccgtggagctccccacctctcctgctttgcttggccagccgctccctcctagcggtggaggaggacaagctgaggagcctcccgttgctgcccctccccacacctccaccacctcagtcccaccttggatctgtcccgactagatccatggtcgacggatcgatatctgccgcctcccggtcacccccactccttcaccggctgctccgctcttgcgccctgcactcactgccgtcgctcccaccgttgtctgagccggccgtcgccaccaccaacccaagtccgccgtcagggtccaggaggaagtgggagaggagggttggagtggaagagaaaaataagtaggcagagaggacttgaaatgagtggggagagaggccgtggaaaaacgagaggagctcatctggtcaaaataccttatattttgggacagatagagtatgtgtgtgcggaggatatacgatgaagggtattgtagactaatttaaataaagcattttcttaatatttgagaattgtaaaataattgaatatataagcaatagtaaaccaatacttaacaacctaacgcggttgcacaagcccaccgtacaaccagagaaaatatgtattgcaaatgtagtatatagacatgtgagatttgtccatattactacaagtaaaagttttactctaatatttaatcatgagtaaaaattttatggaactaaagttttaatctggtgatgtggacaaatcttaaacaaagtgtccatttttagatcattcgttagtttctgggtttgcgatatatttttcagcacaaccttacctgattgcacaaacccaaaccactccacacccggagtctactccatacccagagatatcacaaaaaataatgtttagctctctcataacactcaccttattaattcgaatagttttactctaaaatcagatatgtgcaaatttacacacaagatacaacttcacgacctgttaccatatgccttacaatatacctccgaaatgaattgtcacaaacctgttagcattacacaacctaacatgagcacacctacgtcagcttatcttgccacttcttagtctagggcctcacatttgatcatgttatatataccacaaagtcaatttccttttctacgtacgctaactcgtgattagtttggtaaatgttttacaacagtagctcgtgaatcggtctttaatttttatgagctagatcatcgaaaccgtcaaaaccgtgtgctcataacccaataattaagcatagatgaagcattaattatctttatgtgaatctagtgtttttaagcatgactaattaagtaaagttaaaataatctagccaaaacattataaagttctaagctagtccaattataataccggttagaaagaataggtgatcaacaatcaaaggggtacgtcacacgcgtgaacttagatatcgtgagtattggtagaagatatcgttagttccaaactaaatcttgtaaactttatgtacacactgttgtctggaacttcaggattgttaacaatggaaaagaattgcacttttgtcaccattattattaggagaggacacacgagaaagagacagggatcgctcccattaccatctactactaggcatcaaacacaactaatacacacagaaatattgaacgattgttaattagagctagccatggacaacgctcgagagagtgaggatgagcattgcctgtacgcgcaggagctcgtgttcgcctacaaccgctccatggtgctgcgagcggcgatccagctgggcctcctcgacgcgctcgccgccggcggcgacgcgctgaccaccgacgagctcgccgggaaaatccaggccacggacggcgtcgcggtggatcggattctccggttcctcgcgtccttcgacgtggtgaggtgctcaacagagacgagccccgacggtggcgcggctctgatccggcgctacacgccggcgccggtgtgccggtggctcaccaagaacaacggcgaggggtcgctggctccattctccatgtttattatcgacgaagaccacctattgccctggtatatacacattattcctataatcctatttacgattgtcaattgaaccaaatggtacatcatatgcgcgaagtgaatttataatttaactggttaggttccctatggtgtaacatctcatcggagtttaagattttgacatgagtgattgtatttacgctaattattttctagtggtaggcagtaacctaccttcatattttctagtagtagacggcaacctaccatcatagaaagagatttgctccggtctaacaaaaagtaccatgaggtactggtacctcgagatactttttgctggatcgaaccaaatctcttataatacatcataagcatatgcatatccatgtaggcaacacatagcggaggcggtggcgagcggcgggccggcgccgtccgagaggacccacgggatgccctaccacgagtacatagggaagaacaagaggctgggcgggctgttcgaccacgccatggcgcagcactcggcgatccgggcccgcaagatgctcgaacgcttcgaaggtttcgatggcatccagcggctcgtcgatgccggtggaggcgacggatccaccctggggatgatcacctagcggtataagcatattaggggcatcaactatgacctgcctcacgtcatctctcaggccccatctcttccaggtatgtgtgatcgagattttgtgttgactacaagcattgatcagtttgcacgacgaactgatctctactattataaaaattgaatatgtttttaccggtattttggtacgtcatctgtgtatgagctgatttttaagtttgtttgcttttggaaatatatatccgtaattgagtcggtttttaatatcgcttacttttgataatacataaggaatcatgtaagaaatctgttttcaaatctaaagaacttttaactagaaaaaaaaaatcaaacgatttacaatatgaaacggaaggagtaactaaataagtgtgcgcaatatgccctggatgttgatcttatattacaggcgtggaacatatagctggagatatgtatgagagtgtgcccaatggagatgcaattcttttgcaggtatgatagtgtacccactctatatataccgcttcttttgatgacctaagtttatgactagcagaatcatttgggttgttatatatagcagggtttgaaatttcggttcaaaatttacaaaatttcgacccccaccggcatgctcaaatctcacttgaaattttcggttttttgcaattttttgtgaatttggtcaaattttattcaaattcattcaaattcagtcaaattttcaaataattttggctcaaaatttcggtaacccctgtcataaaatccaatttcaaaatttcaaacctgatatatagtcatatggaaagaaaatgtttaaccaaatacaatttgtgacgcatgaaattttgagagtacaaatacaataaaacaattgattctagcgttgtacgatgtctcctatatatggctgtgaaattgggacatttggctagtagaaagaaagaacgttccataaagatggaaataatgcagaattaattcatacatgcatatacatatgcagtggatgctccttatgttcagtgacgaggactgcatcaagatactgaagaactgccaccaagctctccctgaaggcgggaaagtgatcattgtggaaggtcttctgccagagaccccaaatactactccagctgcgcaggattcattcaccatggatatgatcttgtttgtcctcttcaaggtagggaagcacaggacagagcaagagtttgcaaagcttgccaaggagtctggctttaccggtaccttccggtcgacctacatattcttgaacttctacgcccttgagttcaataagtagctacacctataaaacagtatggtcttgaataagagttgctagctcgcgtgtgtacttatgtctctctatgatatgtttatattccaatgtatgtccctattgtgtcactatagctaatctaaatgttaatcttcgatataccatctatatctaggtttccggtggactttcgtccgtcaccccctgtccgcttcgtgatcgtgacatcggtttagatcaggattcaccgctggcctcaatgttggtatggactctgaatcaaacacaataaaatcagctagaaggagtccaaggattaaaagttcgagcaaatcacaaagcaatacacaatatccgaccttgattttcgtcttgcccatgacggtggtgcctctgtatggtggcggcagaatcgatagagaagatgatcacatcggtgaaaagaacgtgatggcgttcactgctccgccgccaacgtgtgccgccgttgtcgaggttgttgccacatgtgcctgcctgccaccccacctcaatgcccgtcttctcgtcaccggccgggagaggaagagagtaggggcgccggcaagggaggaggagagaagggcccctgcgcctggacgacatggaggaagcagaggatccaacgacaaagttaaagacgacattggagggaggcgatgccagtggagatggagagagctagagggaaagaggtgtggtccaccttctacctccaagccgggcccgggccccgattcacgcatgcggtaaggattcgttttttcagtcgctaggctgatgatccctagcgcgccaccatgtcgatctgcctccccatgcgtttcctactccaatctataccttcttaaaaattacgtaaggcttccgatagtccgctttgtccgtcatcatcgtttgagtctgagttcgtctttaacaaaaatccccgagcagatcaaccgattgctcccaatccatttgcccccaatttccaaaatacatgaatcacaaaatcactcaattgcaatcccaaaccaaaatcaagaatcctccacaaaatcaacatcccaaatcaaaaataaaatccaaaacctaaccctagccgcctcctgcagtcaccctcctcgtggtcactgtcgccgtcgtcgtcgtcgtctgccgccgtcgttgtcgtcgccatcgtcgtcgtccgctgccgtcgtcgtcatcgccgttggcgtcgtctgccaccgccgtcgtcgttgccgttgccgtcgttgtcatcgccgccttccgccacgaccggctcccgagccagccttccgccgctctcggcagcgtctccgcgccggggatggggccgacgccgccaccgccatcagatccgctgcgggagggaggcgagaggggtcagagggagttgccgccgccggatgcgtccttagccgccaccaccgccgccggatccacccgcggtcgccgtcgccggacccatcgcgcgagggaggcgagagagagggtgagggaaaggacggtcgggaggaagagggggatatggagcggccccgctg

SEQ ID NO: 4634 - DNA, 587 bp, Oryza sativa
tcaaaagattaccatagggtgagcctaatcacggtatatctggttgaccgcatatacccgcgggcacgactacccgaatagttttactctgataaaaggtgtacacctgtacccacaagacacagccccacgacacgtttccgtgcgccgacatgccaccacgacataccggaaagagcccgtaacaggacccttcgcataaccccctctaaccaagcacaccacacctcaggtttcacccccactcctcgcaaggcagcggccagtcccctctcgtgcctacgtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaatagg

SEQ ID NO: 4635 - DNA, 777 bp, Oryza sativa
  unsure (1)..(777): unsure at all n locations
aagattagctccttcatgctcttatacggcgataaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaa

SEQ ID NO: 4636 - DNA, 15710 bp, Oryza sativa
  unsure (1)..(15710): unsure at all n locations
ttttatcatgctaggtaagaaactgagttttcttgttgaaatgatgaatagttgctctgttttatatctcttttatatgggttcacgctagagtactctctcaaagattgaaaaaaagtagccacatattatccgggaacctgaggtaagtgggctgcacttgctgaactaagtctaggttgttacaagatatgagagagtaataagagctgctatgatcccgttctaagtttgacttaaactccggatgttttattttccaaaataataaactttgaagttcctcatttaatataaattcctaccagagccaaaaatattcacattgacaaacattatacattttggttacttgcaattccattgaactttgtcaaattcttgtgacttgtgtagatacttttcatgctctatgattaagatcatacacccacatatatgtacatgctaaactcctacactaggagctagcatttattgattccatttatccacaccaccatcaaaataaattctccatgcttttatgtgctttcttctcctaaaaagaaaatcctttccgagaaaaaagagagaaaagggagggaaagtcatggttatgaaaataataaagttatgctccctcaattatgagcatgatgatggaaaaaaaagagaaaataatgtgtagccatgccctctccttacttataaaagaaggatttttggagaaggaagtaagcacaacggagaagcattttctttatttttccacatttcatttccaccatatatcacacacacacacacactttgcacgatcttgatcttgagtatgtctagtcatctactctagtataagcttttgacttagtaataaatgtgaatacaactatgtcatgtttgatacctaccaagctccacatattaaaccttagagcagaaatcaaaaaggccactttggtgaggaattcatatttttacacttgagtgatcgagagaatcatttgaggaacttgattttcttttgaaaaatcattttaaaacttccggaataaaagttgaataaagattgagtgcttagtgctcaatttactattctatcttttaaccgctcaagacaagataaagtagtgtttcgcaggaatcaggtgtaaaggtaagccacagtgataaaattattcgatctaagagagaatacacataccttgcactggtacatttgaggatatacaatatagtagtagctcctgatcaacaaccaggtctttgttcccttttgtcctttactctgttgacggtcgttatagatcagtttcacccgtcaatattacccaaaataaaggagaactagttatgcttacaatgcatattgtgttagaataaaataaaatccattagtatatggtttacttaccccttgcagagaataagtacaaaatggcggagaatcgacatcaaaatagatgatcaatcaatcggacgatgtcgagaatcagatttatcaatgaatggcccaagaactaaaaaatgacacgaccaattgggccaaaatttacaagtttgaagtaagctataggggaggaggccacctgccaggaactgggctggttgggccaacccaggattcggccgaacaagctgcagcgccgatggatgcagggtttggctggacggctgtgattgatccccaatgacggttggtgggtattactgacctttccaaccgtcattaccaacctatataaacccctcactctctccatttcaagacacacctcaagcaagctctctcatactctctcaagcttagtttagtattctcaagctagtggagtaggaatagaatagaagtctgagttcggaagtcttcggaagagtttgggtatggttctagtagctctcatttcttctttcgtaagacttgtactttatttagccccagttgtatggtcatgacggactatcgtaaagaacttggtagtcaggggtggcttctcgaagtaccaggagggcatcggaaagagggcattagctagttaatcttatagctaggatgtatgtataatatgtatactagaagtataggaatagattcttttctattttctttccacttagctcagataatttaatatgagagtgagtagtcttatccttgtgtgtcactctaccctatgcttatcttaacccctgcttagacataattattacaagtaacatataaatattagcttggttctctctattataatcttcctatgggattaaacaaatacgatacccttggaatactctcgggtgaaatgctacaatagtacatcgtgctcttgcggatgaactctatgaccataatataccagaagtatttttgtgccattgctgagaattatatttctagtaatgtcgttaagaaataccaacagacatcccatataattacaacgccatcttcggccgtgctaccttgaacaaattcgaagctatcgcccaccacaacttcctcgagttcaagatgcctggcccgaccggagtgattgtggtcgaggggatacagccttcggtcgcagaagagggcgaagcggtggcaatatgtagagaagtgtacaatggtcaagtgcaagagggcgaaagagcaacacttgtgctgaagcagtcaccgtatgttaaggtgagcaaggtccaaattgacgaaactgatccaagcaagatgatctccctaaggggtgaccttggtgaagccgaagcaaaaaacatcctggccgtcatcaagagcaacattgatatcttcacatgggggccagatgaagttggaggcgtttcgccatatctcataatgaaccatttggcggtcaagccggacgccaagctaagaaagcagaagctacggaaaatgtcggctgatcgctagggggctgtaaaagcagaagtgtagaagttactcaaggccggcgtaatctaagagattaaccaccctgagtggctggcaaaccctgtgccggtcaggaagtcgaacggcaaatggcaaatgtgcattgacttcactgacctcaacaaggcatgtcccaaggatgatttctcgctctcaagaattgaccagctggttgattcgacagccggctgcgaacacatgagttttttgtatgcatactctgggtaccatcaaatactcatgaatccggacgacagagccaggaccgcattcataactcccaacggcaccttcttccacctcaggatgcctttcggcctgaggaatgagggggcaactttcgcaaggttgatttgcaaagtcctttgctcgcagctggggtgaaatgttgaagcttatgttgacgacattgttgtaaaaagccgaaaagctttcgaccatgtgtccgatctgcaagaaaccttcagcaacttgcgtttggcagggattaagctgaacccggagaaatgtgtttttggtgttagagctggtaagctgttcggatttcttgtgtccgaaagaggcatagaaaccaaccctaaaaaaatcggtactattcagcaaatgcagccaccaaagcgtgtacgaaaaatacaaaagctcccagggcaaattgcggctctcagccgattcctatcaagagcagcccaaagaggtttgccatttttcaaaaccctccaaggggctggcaagttcagttgtacacctgagtgtcaagccaccttcgatgagctcaagtagtatcttcagtgtccacctgcattggttagcccaacggcgggtagcgagcttctgctctatctagcagctttgcccgtcgccgtaagtgcagccctagtgcaagaaaccaaagttggccagaaaccagtgtactttgtgtccgaagccctggaaggggcgaagacaagatatatgaaaatggagaagttagcatatggtttggtaatggcctcaataaagctgaaacattatttccatgcccataaaatcatagtgccttcgcaatacccaataggcgaagtgcttaggggcaaagaaatcactgggcgattgagcaagtgggcatttgagctatctcccttcgacctacactttcttgcaagtctcaagttctggctgacttcttagccgaatggactctagccttcttccccgaacctgagccgatcaaccaaccatgggtaatgtactctgacggcttatggtctcacaaggggtgggagttgccatgatcctaacttcgctaggaggcatgccgatccgctatgctgcccaactgcagttcgacacaacgaacaataccatagagtatgaagctgtgttgatgggcctgaggaaggcgaaagctctaggcgtttggcatttgctgattcgcacgaattccaagctagtggcaagccaggttgataaatcttttgaggtgaaagacgacactatgaaaaaatatttggaggcagttcgctccatggaaaaatacttcactggaataacgttcgaacatttacctagagggcataataaagaggcagatgctctggtggtccacattcacctagggtcttttttgcaccaagtgtgccaaacctcattgaggacatcatggcaatcgaccatgctgagttgggcgaagacccaaaagactggcgaactccgtttgtcaagtacctaaaaaccggttggctacgggatgatgaagccgaagtaaattgcttgcagctccgagcagccaaatacatgctggtctccgaacagttgtattgatctggggttctacacctttgcttcaatgcctctctgctgtcgaaggtgaagatgtagcgaaagagatacaccaaggattgtgcggggcacatcaagtggcgagaactattgcgtccaaagtctttcggcagggcgtatactggccaaccgtcctcaaagtatgtgatgagcagatcaagaagtgcgaaagctatcagcggcatggccgaagtcagtccattccccagtataagctacaaccaatcgcaccagtatggcctttcgctagatgggggcttgatataatcggcctgtttcccactgtccgaaatgggtatcgcttcaccattgtggcagtagagtacttctctagatggatagaagcagaaccgcttagctcaatctcttcaacagcagtacataagtttatttggaaaaatattgtctgtcgattcggtgtacccaaagaattcatcactgacaatggcaagtagttcgattcttaaaaattcagagaaatgtgcgaggggctaaaccttgaaattaagttcgcctcggttacgcacccgtaggcaaacttggcagccgaaagggcgaacggcaaaatccttgacgcactaaagaaaagattggagggggcaccgtagggtatatggccagacaaagtgttatcggttcactaggcccttcggataacgcctacgagacctaccaagattagctccttcatgctcttatacggcgatgaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggacatgacaccggtcgtaattttcgaaagatcggccaggatgtcttcgcatccagttcgccactttgacaaccacatagttatttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttcggctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcgttaccactcgacatactgtgtccacattattaatttggtatctctataccatgatccatgagacatgatcatcaattaatacatgtgctgatcattaaacatatttgttccacatatgatatttgatcagggatcctttagaaatagtaacatacaacataaagagtctcatgaaaaaatcacatattcattaaccaataatgagttatctatttcaagaaacaatatcggataaatatgtaaacatagtatgtgatacaatcatctatatgattgcctctagggcatatcactaacagtctcccacttgcatatctaatacccattgccctagtgtgcgcctcatgcttagcctaagggagtggctttgtcaacggatctgcaacgttcaaatccatatgtattttgcatatcttcacatctcctctacccactatctcgtgaatgaggtgataccgccgtaaaatgtgtttggacttttgatgcgatctaggctccttagcttgcgcaatggcaccactattatcgcaatagaggtccatagggctggaagcactagccatcacacccaattgagaaacaaatttgtttatccaaacagcctcctttgctgcttcagaagcggcaatgtattcgggttttgttgtagagtcagcgactatatcttgcttggaactcttccaactcacagcgccaccatttaggcagaacacaaatccagactgcgatctaaaatcatctttgtcggtttggaagcttgcgtccgtgtaaccatttacaacgagctcttcctgtcctccataaactaggaacataaccttagttcttctcaagtactttaggatattctttacagcaatccagtgactcttacctggatctgattggtatcattttgttgcactaagtgcatatgaaacatctggacgtgtacataacatggcatacatgatggatccaattgccgaagcatatggaatcacactcatcttgtttcgctcatcagtcgtttaaggacactgattcttgccaagattaatgccatgtgacatcggtaagaatcatttcttagagtcttacatgttgagcctcttcaacaccttgtcaatgtatgtactctggcttaatccaattagcctatttgatctatctctatagatccttatgcccagaatatatactgcttcccctaagtccttcattgaaaaactatttttcaacgatgtcttaacggattcaagcataggaatatcattcccaatcaacaatatgtcatctacatataggattaaaaaccacctctgccagttgagctcattggtccacatacattagtatgtactagtgccaatagttcacttgccctttcactttgacccgtgaaaggtgcctttgtcattttgccaagtaaacaagattcacatgtctcaaatgattcaaaatcaaaagagtgtagaagtccatctctatgaagcttctccatgcgtttctcatttataagacccaagcgacagtgccaaataaaagtgggattcaaatcattaggacgttgccttttcgcattaatgttatagactgaacatccatcaagattcacaatgtataagccattcatcattggtgcatggaaatagaaaatatcattataatagattgaacaaccattgtccactgatctaaaaccataaccctctgcttgcaaacaagaagcagagataacgttcttacacaaagctggaatgcaataacaattatttaactccaaaactaatcctgacgataaagataatggcatagtgccaaccgcaacaacaacaactcttgctccattgcccacgcgaatgtccacttcgcttcttgctaagctcctacttctttttagcccctgcaacgatttttatatgtgagcaactgacctgctatcaaatacccaagaatcagtagaggaagtagcaagattaatttctataacattaatacctaaggtggaactctttccatcctgctgcatctgcttgaggtgctctaggtatttcctacagttcctcttccagtgacctgtctccttgcaaaagaagcactctgtatccttagcgggccctgtcttttgaaccttggtcttagagttgccagtactcgtgatctcatcagagtttagctttctcttttgaccagtcttcttgttattgggcttgcgcttatgcataaccatcacatggttagagtttttcttaatgctttcctcggcagtctttagcatcccatacaattcggccaaggtcctgtccatgttgttcatgttgaaattcaatatgaatggctcaaagctgggagggagcgactggagaaccaagcttttctagactctcggtgtacccaatcattttgatcacatggggactcactggtttaccttctgcaagcctgcacgcaaacaaggactttgaggtattaaacctctcagctcttgcttggtcctcaaacatgttatgtagtcccatgattatcgtatgagcatccaatgtttcatattgcttctgaagctcaagggacatagtagcaagtatgagacagcttatatcaagataatcattgcatcgcttttcatgatccctacgctgagcagtactagcattgttgggcaagttagctggaaaaggctctttaagcacaaactctttgtgctcttacctgagaacaattatatatatatatatatatatgcaaaattagcaccatgtctacatttaatcttttattaaacaatttaaaaaaagatactcccactatgtgttgtgaaacaaaattccctctagcaagatcctcattttattagtgtctagtgagctttggcatcacagctagacaattatcaaaataggtaagcaacaccttgctaattacatcatatgtgactcttgtgctgttggggtgacatctccatatagcaacccaacctatgccccaaggtccaaaaccgttttgataaccttgttaagtaaaccaataatctccccatatagatgtccgacatctatcctattttatcatgataaaaagtgacactctgctatggcaaacccatcacttataatcacaaccgtaataggtgcaactattagaaaagcataaattataattaatttttccgagggaatctatcctaccatgtcatataaaatatacaacagtaataaagtaagatagataaacatcatatgctagatatagaatcaaattctatttattaatataaaaaccaagcgaaatctaagggcaacgcacatgggggttgaggggggagccgtcccccgcgggtttcagggcagcgtcctgaaaaggtcacggggtacatagatctcatctacgattcgccatatgaaaaccttaatagggtaatcaaattatgctaaaaactaagtcaatctcattggttcatttttctcattggcgtgcagttcgagtggatatcgaactatccgatgaacacaatcttgcttggccgtggtgagtactagacattccagtaaagtcaccaacacatataccgattgatctcatcaacccatgtgcctattggtccattacatgttccgatcatccaagaactcaactactacataatagatctcatctactacgcccgcatatcaactatatgcaatgacctagatcataaactatacaaggcggctctgatagcactgtagggatacgcgcaggctacgatagcataaatcaaaattttctagcgcataaaccaggaaccatgtaagtattagatcatagatcgttaccactcgacgcactgcgcagcggaagaaagcgctaaggaggcgaagcaacccttgcgaagtagcgcgcgtcgatgtagaggaagtagtcgatcgcaccggctcgaccttctcctcctcgagcgttctcctcgccatactcccacgccgatcaacaccgcaaagcagcggcgcctctaccggtatccatacgtatagggacggaatgccacgcgcagatgtgctaccaaccgcgcgcggctagggttttgctcggggaggggagtggcggctacggtttctcacgtgatgcaatacgaccgccagtcacacccctcacgaatatataggatgcatgactcgggactccaaggcccgtaggactcctatttggatccctatccgaattaagctcatattggatctccatccaatccccatattctggcccattaagcgtgcaaccctgtaggttcatgtacaatcggttgtaacccgaaaactccttttcggtccacgtgtcaacagcggcccctagcagaatgtattgacccaccgggcatacataaagatcatatcgactgaatctctagtgtatacaagtatgaacccctttgcctcatgatttcgattaagctcaaggctagatatgtgccatcctctaatagctcaatcattcactcgaacctgtgatagattatataacttgtgattgactcctcaatcacctttggcatggccatgcacttccataatctataacatcgaggggcccagagatatctctccataggaaggacaaatcccatcttgattattcatatcccactacatgtttcatagcatacctgaaaactacttttataactacccaattacggagtagtgtttagcagtccctaagtaagttactacatatgttgggaaccatgacaatctcaggtctaacgattcaacaccaacactaaatgagatcactgatgacataacacatatggctcttgcagtgtcttatgttgggtctatccaacaacatgttccctaacatgtgttcacattattaatttggtatctctataccatgattcatgagacatgatcatcaattaatacatgtgctgatcattaaacatatttgttccacatatgatatttgatcagggatcctttagaaatagtaacatacaacataaagagtctcatgaaacaatcacatattcattaaccaataatgagttatctatttcaaggaacaatgtcggataaatatgtaaatatagtatgtgatacaatcatctctatgattgcctctagggcatatcactaaaactcatgttccaggtctttccgcccaagctcctccattgcctgaaggcggttcttgtaaccatccaggcgagccccgacagattgttcgatgctactttacgccgaaagagcctgcgagcaaaaagggggaaggtggcgaaaatatttagtgcaaaaagaacacttagtaaaaaagcgtgagaatgaaagaatgtgtactcgaagaagtgtgctcttgaccgacgtgcagccctcgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctcttgttgtagtggtttaatgtggtaacataaattctcgttttttaatttttttgctatcatatccaccacctagttctagatctagatctagatcttgtcatgtatagagagagaaaaaaaatttaaatgtctattcattcggtgtaatcaaaaaatagttatagtattttgtaatatgccgatgatttgattttgttagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttagtaactcgcggatttatggacaagtacgaaatatggacacgtcatggcgaagaacatgtggacgagcctgaaaatgtagttccgaaacaagttgaagacatggtgcatgacgatggttctgttgaggacaaaatcgacctagaggaaatgttacgtcatgcagaacccgaggtgctgatggggtcggcaagagggctaaataactttgaagctttacagaaggcagcaaaggaagttttgtacgatgagtcgaagggctgtgacagtgatttcacaacactccggtcagttcttgaacttatgaggttaaaggcgagacatggatggtctgataccagtttcgatagtcttttagaactcctgtagaaaatgctaccgaggcctaactcactaccatccaacacatatcaagcaaagaaactcatatgccccctttcacttggtgtggaaaagattcatgcgtgcgtaaatcactgcatactgtacaggaaagagtacgcttctttggatgaatgtccaacatgcggtgcaagccggtacaagtcgaatagcaatactagcctagaaccctctgaagcaactgagggacgacagagaaaaatcccacagcttgtgatgtggtaccttcctgtgaaagaccgcattacacggatatactcaaacccgcgagatgcggaactaatgcgctggcatgaagaagggcgcaagaaggatgggatgattcgacacccggcagatgctcgtcaatggataaactttgatgcgtagtatagagagtttgctaaagacccacagaacattagatttgccctgagtactgatggagttaatccttttggagacatgagcagttcacatagtacttggccagtgcttctcaccatgtataatcttcctacctggctttgtcaaaagcgaaaatacgtactactctgtatcctcatacagggaccccgtcagcctggtattgatatagacgtatttcttgaaccattgttggaagatatggccgatttatggaaagagggattgaaagtgtgggacgagtacttaagggaatacttcacagtgaaggcaatcatcttcgtgaccattaacgattatccaacaatgttttcagtttcaggtcaaattaaaggtaaaacaggatgtgtgatatgcttgaatggaacgcactataggtatctcccgggttccaacaagcttgtgtacatgcggcaccggcggttcctacgcacaaatcacaagtaccgtaagatgaaggcggagtctgatggtactgaagagactgatcctgcaccaaaacctacatcgggagaaaatgtgtgtgcaatgatagagaaaattgtttgcgagtttggaaaaatgactaagaaaccatcaaaggggataaagcgcaagaaacccgagaagaatacgaagggaggggatagtaagaagcaagatgacagttcgaagccagatgataaactccctcccccattcaagaagcattccatattttttaagtacctcctgtactggaaagatctggaggttcggcatgccatagacgtcatgcatctagagaagaatgtgtttgacaacatagttggaacattgttggacatgccgaagaagactaaagatggtatgcaatcaaggatagacctagtcgcgatgggaatcagggaagagttacaccctcaagaaggagaaaagaatggcaaagtatatcttccaccagcctgtttcacactaacacctgaggagaagaagtcattttgcaactcactccgtaatgtcagagtgcccataggtttctcatcaaacatcagtcgactagtttcaatgaaagatttgtcggtatctggttataattcacacgactgccatgtcttgctcaccgtgtttcttgcaattgcaataagagccataaaaccggagcatttaaaggttgctatcacaaggttgtgctactttttcaannnnnnnnnnnnnnnnnnnnnnnnnnnnnnnnnnnnnnnnnnnnnnnnnnnnnn

SEQ ID NO: 4637 - DNA, 1326 bp, Oryza sativa
  unsure (1)..(1326): unsure at all n locations
nnnnnnnnnnnnnnnnnnnnnnnnnnnnnnnnccatcaactatagtaaattcttggcaaggatatgacattaatggatattcgtttagcacatcgatcaacatattgaactaatacgagctaacaataagggtcgctccaccgagtggataatgaaagaacacaagcgtctcttcatagattggttgcgagacctagacttacctgagggagaaactaccgatgaaataactatgaagcggttggcttgtggtccatcaactacagtaaattcttggcagggatatgacattaatggatattcgtttagcacaagagcccgagataataagacctgtacgcaaaacagcggtgtccgtgtggaggcaattgatgaagccggggaaaaacaatcatacttcgggtttattgaagaaatatgggaaattgactatgggcacacaatgcaattccccatatttaagtgccagtgggtaaaatacccgaacggggtaaatgttgataagttcagtcttactgttgttgaccttgcgagagtgggtcacaaggatgatccttgggtactcgccaatcgcgtggcacaagtgttttatgtgaaaaacccttcaaatttgaacaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccgtgaagccttacatgcgcacggacggtgtgggcaaaaatgttaaagggtaatgattgttgagtggcatataagcatctaagaagttagtagttatgtaatggtcgtatgtaaggtgatgtgtgatcgtatcgcaaattgacgaacaattgtactcaacattttgcatataatttctaagtactaatttttatgtgcaattaccatttgaattgtgaaaatttagttaaaaaaatttaaagttagtaatatccgaaaagtgtaaatatttttatgtgcaactaccagtttgttaaaaagatcttcgcaggcggaccggccgcatgcgaagatagtaaaagagatcttcgcagcggaccgacccgcttgcgaagataggaaaagagatcttcgcaggcggaccgaccgcgtgcgaagatgatcatcgcaggcggaccgcccacctgccaagatctttgccctatataagggcaagcctgcggcgccaaaatttctaagtccaggcggtaaccctagaaaatttggcgccgtcaggcgaacgaaatttttcaccgccgcacgcttc

SEQ ID NO: 4638 - DNA, 12337 bp, Oryza sativa
atttagcataatagtaagtgctagtgaaatttggaaatctcttcgcatttatatttgttcatacgacatattgttaatacacggtttatttttgtactaattagtttgcactaatttgagtaatttaaaatgtgacgatacactttttttttatattagaggtttgaaacgatggccgatagtactaaagggacttaagagaagggtttaggggagcaggagcagtcccttgctgttatggttgctccggaaccaacggtcccaccggatggtagttccgacagcgacgtaggtgacgaagacgaggagtactcgttgccaagcgatccttgtcaaagcccaagcccgaaaaaaaggaaaaagggcgacggtgaagaaggcgacaaggactacattccccctaaagaaggggtaagtaaacttaatatgtaaaatgttcacagtgatagctattagcccgagctaattcgaaactttcatgcataccttctagtaggaaacggcgccacgacgatcaaaacggcagccgaagaaaaaagttccttcgaaagacaaggacgtaccggcaaacacaaccggcacacagaaaagcgaacggtcagcaaaggcgaagagaaggaagggcgagagaagcgtaaatagaaaggatgaagggttccatgttgttacccatgtttcgcctaaaggagagccgctcgcccctaagacggcacgtgcgaaattcagttcacagtgtggcataatagtaagggagaagatctccatcacggtcaaggactgggatcatgtaacggatggggataaggaagtcctatggaaagagttgaagaaaatcttccagttcccggaaggatcagaggcagcggtgagaaattgtgcactgcaaacaatggccaagtcttggcatggttggaaaaccaccttgaacaagaaatttgtgaagacgggacgcacaccgttttcgacgtatgccaacataacccccaatcagtgggacgactttctgaccttgaagaactccccggaagaaattaaaaggagccaaaagtactcagagttggccaagaagaacaaatttcctcatcgcttaggctccgcgggctacgcaccaaaggtggaacagtggacaaaagaggaggaggaaatgaggaagaaggggcaaccggtaccaatggaggagtggacacagagatcaaggaactgggtaagaggtagaactccgaagatcacggatgagggaaaagtatcgtttgaaaatccggagctgcagagcgtttccgataaaatagaaaatttatccagttcacaaaagaaaggatattttaagcctaaaagggagaaagatgtgctaagtacggcgctgggtactcctgagcatgggggaagggttcgaggtgtgtcgagcaagataagttggaaggaagggttcaaaaatgacccccacaagaaacgtgaagcgtacaaggataaacttagagacgaaggggctgcggagtttgaaaggaaaatgatggatttctgcatcaagcacatgattttgcctcgccccgaaaccaaagaaactgagccagattaccccttcgataacctcaaggagaatacaccctgcagattgcacgttcccattggacgctccggtaaaactcttgaggccgctacagccattgctatccctggtagaacatacaatgaacagttcatacccgatgcgtatgccaaggtgtagccacaagtggtccacgaagggtttgagtcctacgacattgactacccgactgcagatggtatatctgtacttggggatgcgatcgatcttgtaattctctggcacaagaatgacatattctttggattgggcaccgatgccggggaaaaacctgtgttgcctaaaccgggtttgggaaaacctccgaggcctcctaagaggatggtgactgataaggcggatgatccagaactggataaggaaaatccagtgccggaagtgccaccagagattgcattgccggagacagccaaggagattgcaccgccaaagacagccaatggagattgcaccgccggagacagccatggagattcaagtgccggatgtgcccatagagattacagtggcagaaccagaggtggaatttgtggcaccagtcgggtcagacaaagatgaagtaccaggattggaatgggatggtacagagccagagatatttgaagacccttctcctgcgaaagaacccgaggtgccatgagtgattaggagccacgaatccaagtccaaatatgcgaacaaggagaagttcatgctaaccgtcttcagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccgccagattgtttcggcgaagaaggttacgtatggctagatttctcagatctccacgccatatatcgtcaggataagatggacgtcaactatgtcagtgtttggtgcatgtgagtacgagttttaattaattagatgaaaaatatgtacaatacaactccatgtgattgttactaacaaacttcttctgtaggatgcaatacatggatgctaagaagaaaaaagaacccatcggcttcttggatccaactcggatctgccaaacacagcataccgttacgctagcaccagggtcagaccagctgaagggcaagaatccgaaagagatagcagaatacaagaagggcttgcacaaggagaaattgattactgtcgcacagtacattggacgagccttcttgtacttttaaaataagagagtcgtcatggccgcttataattttaagtaagtccggtacagttatcttgtatacatatgtcttattttagctgttactaactaataataatgttgttaatatgtagcgatcattatatctgtttactcatccaccctaaagacggaaccgtggtagtcttggatcctctcgattacaatcacaagcaatacaaagaatttctaaccatcttacagtagtaagttattatgactcttgcatttgtatatggatgtattacaaataaatatcctccttactctgaaacggtatgacatccatacagttcataccaatactacaagttcaagggtggagaacagacccgaacacgggagaagctgctagtacgtacctattggccggtaatactccactcactttatatattccaatagtttcactaattgcaaattataactacttttttctatgatatgttcttcagtgtcacaagcaaccgcgaggaacggtcctttgcgggtattatgcgtgcgaattccttaaggttaatggacggtacaggactaacgcggaggatgtaagtctctatactatgtactagacagctcttgatatttttgatactaatatattgattaatttcaatacatgcagttgccaagattagaatgtcgaacaagctttgacgatacaggtatcacaaatgtgcagcgtgatctgtgccacttcatccaccatgagtgctgtcatgtcaaaggagatttcttcgacccagagggtgccctagcggcaagtgacgaattcaaggatcttcaggagtggaacactactatgccataatgtaactagatgacgttatttaaagtgacaatgtaaaacaatattgtaatatatatattttggcaacacttttgatttatgcaatataagtagatttctcagtaccaaatgcttgataatcttccaatatatgtacctgcaagaatttctaataaataatttaaaagtaatttacggccaaattatatttaaatttcaatattttctacatatcttcgcaggcggaagttttcttttttgcaagcggacgattcctattttcgcaggcggaccggactagccaatgtccacctgcgaaaattatcttcgcagacggacggccgccccgcctgcgaagatcgcgatcttcacagtcgttggcttacaggcggacggccgccccgcctgcgaagacccttttcggccgcttgcgataatgcttttcctagtagtgggtattcgtcttttggtgcagatctttgcatcaacaactataccgatggctgggctcgaatcagatgcacctgaaaccaagtatggcctgttgatttggtcttttgcaggttcatgtcgatgaaaacgggctgactcaattcacatgcacggcggggtttgggtgggtggggctatgaaagaaattgggtttttttttgggaaatttcaaaacaagggtgatgattggggggaatttgaaacaagagcattaattggggatggtttatgcaattattttgatgactagatgcaagttatgtatatttctcaacatgtataaactttcaattagaaacttttttctacacctaaacatatactattaaaaacagagccatcagtactttccaaatccaaaacaaagtcgtcaaatctttccgaatcaaacccatccatcggtactttctaaaacaaaaccgttaaattattattcgtagaaagttatttagcacggcaacactatttgcatctgtgtaaaaatcaattcgacacacaaagtttgatcggaacagtgcaaaaattatttattaaaatagataaccttctacggtaacaatatttgtacatatgtataaaattgcaagtagaaagaaatataaaatttctatacacaaacttattttttaatgaagtgaaaaatgtttaaccataaattcagaaacactttatggcaccaatactgtacatgcataaactttcaataaaaagttattaaactttgtaaaaacaatctattatctatgaagtgaaaatattttatccgtaaattaatttatgaacttcctaggataaactttgtttacccacctctcaactttgcgtatcaccagaacaatttactcaagtaactaaaatagtatcggaaaaatgggaagggaggtattctcatgctgcatgaaacggaaaagaaaagaaaatacgtaccgcaaattcttgcgtagcctaaaattctgcatcaccacccgtaaaataacaagcagaccaggagacagtgactaaaaagaaaaatgagaacatagcgtgacactaccttcgcccataaatataaaagttttttttctatggatctacacgacagatttttccgtgcggtcgaatcagattttctcgtgcggaacttcggcccgtctagagcaaatcgtctgcgaaaatcactatttttgcgtgtgggtgcttatgccgcccgcacgggaaaataaaaatccaaaaaaaattcaaaaaatggaaactctaaccctagatccgggcaccccaccgccaccgccgccagatctgggtggggggcagctaccaccgccggtccccgtcgtcgtcgttggcagtggcccccgtttgcccgccgccgcctccccaccgtccacccgccgtgcgcacgccgctcccggtcaccctctgccgcgagcttgctgtcgtgcgcacaccgctcctggtcggcgagccacgccgctcccacccaccgccactcccgccactcgccgtcgagcctgccgctgagagccgcccagaggaggaggagaaggaagcacgcgccactcccggtccgcccaccgccatcgcgagcccgccgccgagagccgcccggaggaggagaaggaggcacacggcgccacggcacaggagaaggagaaggtgagagggagaggaaagtgagaggaggagaggataagtaggaatgagagaggagagaaggggccgggggagagaaagaaggaatttaaaattttttgaataggataggagggaactattatttttatgtgctgatagattaagaggcccgcacacgaaaataggcttattttcgcgtgtgggcctgttacgtgacccgcacacgaaaattgatttttctatgcgggcgacgacctggctccggtccctctatttttccgtgcagtctaacttacgggctgcatggaaataaaataggttggtgtccagaaaaatcaatcatgtatgtagtagtgatctaaattaaacaacggtcggaaaaaatgcataaatatttgtggacgaaagtagtagcaaacaagcgtgctctgaaagattaatcggtgcatctatcacatgggttggcgttcgctcgttaagatttcatgtttgacccgttgtagctcctccgctagcgagccaacacaaagattagtccacaggtaaaacttgactgaggtataggcttggtcgtctagtttcgtcttcagcactaaaacactaaacttatgaaaatagaaaactctagcaaggctcattatcaaccatcgtactcagcaagccacaccaataatacagtcatataagaaaagacaaagaggggtttctggctagttgcataaaggcagttgtaagcatctatagttgaatacagtaaaacaattaattaattatgttaacattaatctccgttgaataacgctacaccatattgaacaggtccaaccaaaccatctaaactacaccaatttattatgttaagttaattaatagtgagactaattacgactaacctcctcgatcgcccgtaactacatacatggctattcaaatagttttacactgaccagaggtgtacaactatacccatagaacacaatgccccatcatatcaccgtgccatgcctaacacgttgccatgcgagtgattatgataagatccttcgcataactcactccaaaccatccacatcacgatgagatttcacccccacccctaaaacaggggggggaggcccccaaatctagaagccgcttagccattaatccgtttctctataagtgaaggttaaatcccaaagcatcacctgataggtccatgtaagccaaaaaaacaggaccatccgatgatgaaaaaaaaaaattaaagagagccgtaggatcatatcagtaaaacaacctgacagagcgttctctcgagctttccaggcttccagcataccaataccacaccagaacctcccttggcttgctcacacatgggacatacagagcaaataaaagaagggaaaatcacatggcagaatactaactttggtatatcagcgaaaaaataatactataacaaataggtagttaaatgtcagattgttctttataaatcattaggtttgtacgattctaatataaatatacataataaaattggaaaatagtaaatttacacatgctataaaacttatgcactaatggaaaatgagtgaaggataagggtaatgctgtagcggagatggcaagaaggcaacgacttatgctacgatgaaggtgatgaaaaatattaataaaattatgtaaacttcattttagatattaatataaggtttggataaaatagcaacaaaagttcgttgtcgtactaatatagttgtcgaaactagatttcggcaataataaaagggggtggctatcaagctgaaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacaatagtttattacatatcaaaataaaaataagtatttttacattccaagtagacctcctaacgattttattctctaaaacattcagaaaattatatataagatgaaaaattcaatatgttcccaatattttttttaattatgtacaatttattggcgactgcaccttttatgttggagtccatgtatttattaataatagtataaaccaataaataatctttctagaaacacagtataaattggtacgtcatctagcagtaaaagaataattagccataaatataagcatccgtaccaagtctagaacttaaatctgggtgtaggttctactataaggaacctaacctattaagatatgctcacatcgcgaccaataaataatattgtaaatgaacactcaaatcatttaataaaatctatttaatttataaatatactctaatcatttaattacaatttgattatttgaagaaaaagtacaaacaaacacttaaaaacatgtaaaggcactcaatatagaggaggttaatatcgcgcgaatgcacatctatatacacttggtttagttgaatgattaggaccaataaaacatggcctggtgtctcgagctcgcagctcgtcaatatgctaatagtaaataatgtgattatcccattagatgagctagtggtaattaagcatggctaagtatatctagctaggtcaacataactaacccaagccagtcaaattattatcgaatgtttcacaaaggatggatatcaagtaggcatggccacaagcaagcaaataggtattgcatattcccatgtaattagcaaaacatgtacaataatcattttaaaaagtaggctcaacatgcacaagggagaatatgtgacttgccttgcttcttcgattaattttctgaacgcttttcattgcggtggtgatcctccgaaatggcggattctacatgctagcacacaaactgaggaaaaaaccaagtaaacagtacatgaaaagtaaacaaacatgtagagctcaatttttgatgaatttcgcaagttgaatggcttaatttggagttcgtatgaattagttatgaattttacaacatttgagccatttaaatcaatttatggtattaaaatgatttatgatgtcatttattaattattcttcaacaggaaaaactaggattatgacgtcacccgggggagtggcgcccacaagtgggccccagctatcgatgactcaagggggaagggcacacgttggaccgagtcctcgcatggccccggacagtgtcccccacgtgttcagcgcagattggccggccacagccaggccaaggcatggcgcataatggaccgggtggccagcgccggcttgactgaaagtggcggttcacgtgaccagatggccgctggcagcaaccatctggcatgccggcgtgcgtaggatacggtggatgaagccggaaaggaagagtgggacctcaccgaacaatcgcgcgggcaacacgacttaggaggcatgacggtggcgagtgcttcccggcggcgcttcgtgggtcgacggcagaaaggggcttccggtggcggttcacgaaggcggaggggaggacaggctccaccatgacatagcgaacaaggtgatagagtttggaagaagaggtgtggcacggtgccacaagagaagatggcccgagatcggtggaaggaggaatctcacaggattgtgacgaagatggcaatccggtggcctttggcaccgatggggaggtaaccgagataggccttgatgaagcgaaaccaacagcacaagatgtgcagcgtttcggcagctagagcggcgttgtgtggcagttggaagaggtggtggctttgggaagatggtgaaagcgttgttccagtggtgttcggggacgatagaagggtggccgagcttcttcttgtcccggaaatgctggcggtggtggagtcatgacatggccaagactggagcggtggcaagcagcggctggaaggcgaagaacggcggcgtagcttgggtgccatggtgagggagtggtgagcaattgagctcggcgacatggaaaaatgagagggggaggttcgacggttctttcaatgggctcagggaggtgggtcatggccatggaggacggcaaccggtgcgaagtagggcgatgatgtgtgtgggaggtggcttaaatgggcagagatttttggggaaagtgggatggagatagggtgggggagtgacggcgacctagtccacgccattggaacagggtgctgggaaacggcgaaaaaggcggcggcgtgtttaacattatggttcggtggttgtaggtcagacataggggatagagctaacaggtgggcccccggccccacctgctggcgagcgagagagggggctggtgatccgactaggctatgggaactagtcgagcggggcggatgggccatgtggaagtgtgcggcctggttgagaggacgggagcgacgcggccgacgggacaggccgagcgagctagtccagtgcaagtgctaacagaggaggaggccagggccgacctagggagaggaagggaggaaggattggttggaaaaaacccaaagctgagggagaggatttttattcgtttttctatttaactgatctctgaaatgaactttgagctttaaaattcgatattgagcaatttaggtcacggagaagattgcaaaaatattcccagccatgattttgaaaggaaattttaagatatcgatcgtgccgcgtgcttgacaagcgtgctgccttagtttggttggacaaaactaatgccacaacttttttttatttgcatgtgcaaccgaactgattgaaaacaaatctgttaggcactgcgactggggcgacgataatgggcgtcagcgatcaccccccatccccctataccggcctctccccctttctcctcccccttcttctcttactactatacaataaattttaaaataataaaaaaacaaagttagaaaattttatgtataaaaatactatataaaaaaatatttgaatttaaatttaaatttgaatcgggtatataaaactttctacttataaactttgggtctataaactttaggtgtataaactttaggtgtatagaaatgctatatataaaaaaattgaatttaaattcaaattcaaatttgaatcgggtatataaacttttgacttataaactttgggtctataaactttaggtgtatagaaatactatatataaaaaattgaattcaaattcaaattaatatttgaattcaaattcaaatttgaatcgggtatatataaacttttgacttgtaaactttgggtctataaactttaggtgtataaactttagatgtatagaaatactatatataaaaaaatatttgaattcaaatttaaatttgaatcggatatataaacttttgacttataaactttgggcctgtaatctttaagtgtataaactttagatgtgtaaacttgaggtgtataaactttaggtgcataaattttctaaaataggaaagtaatgcggtgccaataaataaaagtggagggagaggggattgatcgccgggagcaattgatcgctcgttaggattctcgctgcgactgtatctacaagccaaacagatatgtctcaaaataaatcgatttctaatatctcaaaaaaaaactttaatagtaagggtaaaatatcaaaatacatctcttattaataggaaagtggtatttgtaggtggataaggtaaggggtgtattgaagacaaaaataaaacatctcaatatgtttctgtagagagggtagctcacacaactagaaaaagtgtttttccatgcggcccaatcacattttcacaggcgggcaagccatccgcctgcaactcaacacttacgaaaatacttgattttcgcaggcaagcaactggtccgcctgcgaaaatagcttcgagcgctaaaaaaaatgggcagccaccgccgttttcggcggtagcttcctattcacaatccagttcccacccattccctatccattcccaatccagttctcacccattctccatccaatccagtgaatccaaattcaatagagaaatcaccagttcatccggttcatccaaaatcaccagaatcaattctagcaaagaaaccaaataaaatcattcctaaaatcacggccgccgccttgccgtagttcgccgccaccgccgcacgtccgcgccgcgctgtcgtccgccggcgccgcacggccgtg

SEQ ID NO: 4639 - DNA, 14581 bp, Oryza sativa
  unsure (1)..(14581): unsure at all n locations
tgccgccatccgccaccaccgcctgccgccaccgccggtagccgccgccgcctccggccggcggccggggagaggaggagaggtcaggggagggtagaggccgacgagagaggagaggtgtggaggggaggagaggtgtgaagtggagggacgctggagacttagaaaaaatgtagctatcgcaagtctatttatattccaagtctattttcgcagtttcgcaagcggacagtaaatttcaccccgatttatatttttgtagacggtcatttggttctaaggatcatgtccgcctgtgaaaaaaagaccccccacgtcgggaaaaatgctttttatagtagtgtcacaggctaaacatgaatttattttagacaaatcttaaactttagagatcaacttgtttgaagtctaaaattattctcggggaaaatacatgcgtctacgtgcttgcgtgctaggtgttcgaaaccttcactgtaaaagatacattacttgcatgtagtcagaaaattttcagggttgtaccgtgttcgatgatgatgaattgtttgaacggagttcgaaaaattttggtggatacccacggaccagcaccagcgtggtacacacaggagcggatccagcgttatatgagtggtgtcagctaactcacttgcatgttgtgagttgagggtgacatcatcggcccaaaatcctggatccgctcctgaacaagcatgctctaaaagattaattggcgcatccatcacgtcggtgggcattggcttgttaagatttcatgtttgacccgttgtggctcctccgctagcgagccaaccgagtggattagttttccgtagcccctctttatctcactgaataagtagacgcttctccagctctcgcaagaattgtgaaaaacgaatggtatcctggcgcgcctcttcgcggaggcccatattcatacgtactgaaagtaattagaaatttattacgtgattagagcatctccagcaataggcctgattttagagtccccaaaagttaaatggggctacacctatttttcgagatcccaaataatggctccagctccaacagtaacccccatttgttagcctctatttctttttctcttctattttgatatatactacatatttatttcttgattcacagcagaataattcaaacataaatattaataatacataaaattcaaccatattcaaatccacaattccaaacaccacaattgaaatttaaattcatttttttctcttcatattgctggcagcgcctgtcagatgcaaaaacatcttggctgttctagatattgttgaagtgttccactaatatacttcaggaaaaatcctgagaaaacttgaaaccaaagtttcagtaatttgcacttcaaggaagagactagaagcgtgcaaaccaatgtcgtcttgactgttctaggtatatccgtatatctgttttgactacaaatcaatctgaactaatgaatattgatgtaccagctatgcttggtggacggtctaatatgcaaatcaatatgagccaaagataagcagtttgatcatgtaccacctctgctcggtggtggacgttcgcgacaataggaacatcaacagccactaccacagaaacaatttctatgtacaagacctttggtaggttgtagatggaccataacctgccgcatctggaaaaaatcgagcggcatttttacatatggcttcttaagatgcccatatagaaaaatcgattttcccatacgagtctaagacaggtctgcataattatccgcacgcgaaaaatcggatttttgcgtgcgggtgcgtcactcgcacgtaaaagtagcgatttttccaaaccttttcgcgcgtgcggttgtcccttccgcacgcgaaaacctattttggaccatacgcgaaaatccttttttagtaaagagcaatggtgctgctgccgatgagagcaaggccaagaaactcctgaagagggcgtcgtcgttcacagacagatcgtcgtcgtggtgagcgatggcgggtgcagggtagggatcaaggagctcgattgacaagttcaacggatgacgtcgggtagcgcagcggtcgatcggggtagacgaggacatgacagagggaaagggcaacagtggacagtggaaccaagagcgacatgagaaaagtgcgctggagatttttcatcgtgaaaaaaaaaagagagataggggctgaacctagagcccccacgattgagtactggggggagagatttgggtgtcttcctagggcctcgctggacctcgatttttctctcttcacctcaaaaactctttggaggtttagtttaggtgctctactggagatgctcttagaagatcattattgggttgaggcttagttattttgagtagtatctaaatacccctctgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatcttcccaaaaaagaaaaaactgacttgcgccttcgcctggaagctaaatcacagcttgtctttgagtgaggcccagcgtcatcactcgcctaacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaaacctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaatgagtgtgctgcgctgcattaaatgcagcgtggggcgctcgtccaacccgcaataaacgcggctaggtgagcgccgctgtgctcacctaacccacacacgtggcgccaaacccacaggaggtcggggcgccccagccctcggggccgaaacgggagcggcccgacccctcggggagacagagggaggggcggccacatcaccctcgggcccgacccccccgagggggtcaggccacgtgggtgaccgcggctgccccaaacctctagccaagatacccccggtcccatgtcaccgacagtagcccccggcgttatgccagggcgatcgccttcctcgaggaaagcgctcgggcgtgacgccactccttaagcctggtgacaggcggggccggtctctacaggcgggcaggaatccagtggtcgcaaatcgcgcgcatcggcaagggaaaccgaccgacaataatttgcggctttcttcaagaccgctacattacttaagtagcgcacgaatcgggacgagccggttcgtttcgcctggagatgtgatgatggtgcatcggtcggcgagcgtagttaacgcgcgcacgatatgtcccatctcgactgccacggccgcaaatccgcctcgtgcgccgcaaacgggcgagcgcgattagtggaggcgtggacgcgagagacgatggggcgaggtagtaggcgcggggatcgaggagcccggcatagcgttggcaagggtactaagacaccagggaagggatttgtttccttcctctcgccactcttccccttgcctttgccacttgtgctctgactctccgtttccggcgcctacnccctgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcccgcattacccggggcggtccgtcttcttcctctctttcgcaatggcagggctggtcccgccattctcttctttcttcatagatgttctggagctttatgatctccagatggcgcacctcacccccaacgcggtaatgacgttggccatcttcgcgcacctatgcgagatgttcatcggggtgcgcccatctctccggttgttccggtggttcttcaccgtacaaccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcacgcctccgacttccgagccagcccccggcgcaagcctccagctggcgggcgccggtagatctgggagacggctacaacgccgttcttgaccgcctggcaggtctgcgatcccaggggctcacgggggccatggtgttcggcgactaccttcgtcgccggatcgcgccgctccagcggtgcgcccggggcgcctgggagtacaccgggcccgaggacatcatgaggacccaccaggggcgtaaatgggactgggaccctgaggatttcaggatggtggtccaacgggtgctgaatctcagctccatggaggcatccctcatcccccaaggggtcctccccctctgctgcgatccagagcgcgccaacatcctgaccatcatgcaggaggtcggggcgtcgggggagcgggccccccgaggccacgatggcgcgggcgggagccgcaggggggaacaacctaccccaggagggggtcgtgcttctgggccccgtgataggggcccggggggcagccgccctgccgacgcccgggggaagaggaaacaggaggataccccctccccatctcctccccgagggggcggggcggtgcgtgccaacagcaggcgcccggagggtgctgtgccgacgtcgcagcccgagggggagcgaaaaaagaagcggctccgcaagatggggggggaccgaaccatgccgaggaaacctcatctccccccaaggtggtcgtttagccgacctcctcgcaggttcgtccccgcgcccactgcggcaagttttcattctcccatctcccaaggcaagttttcactcacccgtttttcgtcttctggtttttcttctgcctcagcgagatcccgtcgcgcccttcccgccattccaagtccggccggtctgaggccgaggagacggcgaccgcggaggcccggaggcggggagttgaccggcgagaagccgcagactgcctccgggaagccgaagaagctgcccaggaggcggtccgggctcgccaggctgaggaagccgcttgggaggaggccagactccgccgggccgaggagtccgtccgggagacggaggcggcgcgcgaacgccgggcggcctgccaagcccccgactcgactccgcccgaggcgacgacgacttccgaggccgcccacgacaaggccgcgggcgcgccgctcgggcccgacccttcgggcgatgcttggggcgagccagcttcggggaacgcccccgagtccggcacgtccatcggcgggccgagccgcgcggcgcccacaccgaggcggctctcccctctgccttccgctgccccactgagcgctgaacccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcagagatcgccagggaggtgaaggaggagcgggagactgccctcatcgccaccgccgtgttcaacgcggcgcgagacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggaaagggaactggcgggtcgcgaggccgccgtcgccatccgggaggcaacgctggcggcgcacgaggccgcctgcgccgaagaggagtccgcactccgcctccgcgaggacgagctcactgggcgggagcgagctctcgaggaggccgaggccgcgacgcagcggcgggaggagcaggcgcgcctcaatctggaaggcgcccgcgccgagagggccgcactggatcagcgggccgctgaattcgaggcgcgggcgaaggagctggacgcgagagcgcgcagcggcggggcggccgcgggcgatggcgacctagccgcccgcctcgcagccaccgaacacactatcaccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggatggcgcacgcgcgagggtccgggacgccgccgaccacatcgtccacagcttcgagggtacggcccctcggctcgcgttcgcgctcgactccgacgaggagggcggtgacgacggtgcggacgacagcgacgacgaggccgacggcccgggggcgtcggagtgagcccccaggcccccgccaatcttaataacttttccttcttcttccgaggccttcgggcccccttcttgtataggctgatttaatttgtaatcaagtaaagaggaaatttctgcgtcaattaagtttgttgtgtgtatgagacgaggatggtctatgccgcggtccttctatgtcttggcttgaacgagggctcgtgcccaggtcccaaccttaagtggcgcgggtcggggctagtgcctggggagatccgcgtgtcgagactggccaggccgggagcgtggtgaccgagggttatggatgacccgattgtgggcctttgccgattcccacccggagatcaccacgccccggggcacggctcggttctgggccccgtttggcgattttagccggctcgggccaccgagggcagggtcgggcacgagcgtgctaattcaagccaagattcttcaaaagaaaacgatggcacagacacaatcctcaggaaatcgaaaatgcttttactgaaatacggaagagaaaaaagataaggatatgcatgtggtagcccccggccaaccctgcacgcccgggggggtacggggttggtccgagcccgaggcatgacacccgacccccactaggggtagaagcgacgaaggtgttcgatgttccacgggttaggcagctccgtgccgtttcccgtggccagccgaacggagcccggctgggggacgccgatcactcgatacggaccctcccacattggtgagagcttgctcagtccagcacgcgtttggacgcggcgtaggacgaggtcgtcgacgcagagtgatcgggcccggacgtgacgctaatggtagcgccgcaggctctgctggtagcgcgcggctcggagggccacgcgccgccttcgctcttccaagtagtcgaggtcgtctcggtgaagctgatcttgatcagcctcgcaatacatggtgacccgaggggaccttagggtgagctcagatgggaggaccgcctccgcgccgtagacaaggaagaaaggcatttccccggttgctcggcttggcgtggttcggttcgcccagagcaccgctggcagctcctcgatccacgagtcgccgtgcctcttgaggatgttgaaggtcttggttttaaggcccttgaggatttccgcgttggcgcgctccacttggccattgcttctggggtgggcgggggaggcgaagcatagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgactggataagcctcgggccacttagtgaacttgtcgacagcgacatacagatactcgaacccacccggggcccgcctgaacggacctagaatatcgagcccccagatagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaactaaggtgcgtgaggcgaagtgggctccgcactcgccttcatggatatcggccagaagctcgacaccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatttcagtgatccaagcaatcaatctaggggagctgggagcgctccccttgggtcccgaggcctggactccgacgggcctcgggggccgttcaggcgcgtccgtctcccctagggggtcgggtcgcgccgacggctgggcaagcctttcttcaaaggcgtccgatggggtctgggctcgcgagtaagcgagccttgagagttcgtcggcgaccgcgttatcccgtctgggcacgtgccgaagctctatcccgtcgaaatggcgctccatacgccgcacctagcgcacgtaagcgtccatctgcgggtcagagcaccggtactccttacagacctggttaacgaccaactgggagtcgcctaacatcaggaggcggcggatcctcagtccagctgccactctgagtcccgcaaggagtccctcgtactccgccatattgttggtcgcccgaaagttgagacggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcggggacggagatgggctcaggggctggggtccactccgccacaaagtcggcgagggcctggctcttgatcgcgtggcgtggttcaaagcacaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccattagaatagcgtaaagcatcttctgggcctgagggtatcgggtcttggcgtcccggagggcctcactaacgaagtagacgggccgctgcacctatcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctagcaccgtcggacaagcaggcggagggccagctccggccatcgggggcctcgggccgccgttcggctcgggggcctctcctgcctgctctctcccaggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccctccaggtaaacggcccggagcatttgaggagcttaaataggggcagtgccttctctcccagcctcgatatgaaccgacttagggcggccatgcagccggttgacgcactgcacatccctaagcttgctgggggggtgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaatcaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaatgacgaccgggttcgccagccactccggatggatgacctcacggatgaatccggcctccagaagtcgcgtcacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgccgtccagaaaaccaccgattcgtgtggtcttggacgggccgtcgcccatggcaacctccttgaccgggacctcgtcgcacgtgatcatccgctgcctcggggcggctgggacggaggtgctgagcctctcgttgccaccctcgggcttggatgcggcggcgaggtggtccgcgcgctgctccatacaagcaagcgcgcctttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagtccacccgctctgtgcggaagttggcggaaccaccgagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcgaaggtgagggcaacctccgaccaccgcgcccgccgtgtcgcctcatgggtaggggccgcggccagaagctctcgcttcatggccttgaagctccgacgagaagcgtgagcgcacgctcccccatcgacggtggcgatggtggccccaggctcctagaaccctaggtcatcgtcgccatcgtcgatgtcctcggctggggccttctgcttggcctcacttcgccggttgccggagggaagccgccggggcattgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggtgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgtcgccctgaccgagcggcggatccgggggcggccgaagctgccacaccggaaccggtggagttccaggtccaggcctcctccttgcgagccacatggtccgcgagctgaaaaagctccgcggtggtctggggctccttggaggcgatcttttcgagcatgcggttgtgccgcacgcctcccctgaacgcgtagattaccgcgtgtgcggggatgcatggtatggtgttgcggacttgacagaaccgctgaatatacgagcgaagagactcatcgtcccttcgctgtaccgcatgcaagtccgcttcttcacctgggcgcggatatgtgccttggaaattcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatcccggtcgtgtagacctggagaaactcggcggggttgacgcttccgtcatatttttcggtgatggtgggccggaaccttaggggccaacggacgttccgaaggctcgccacaaaggctcgacagccgacaccaccaaacgggggcatggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcttgacgagggaatggcagacgaacggcgggtaacggccgccgctcgccgcgccctccgcctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcagggacgacgggcgggtgacgcaagagcgcgcccgcagcttggagcgcgccctggggcgtgctgccatcgccgtagacgaggaggcgacgctccccgtctcgccgtccttcttcatcgctcgtgggcggcgaagtcgcggatctttcgacccccttgagcgcctnnctccggctaagacttcggcaagagggggcggtggagtacgagctcgacggcgcgggttctgctccccgtcgtcaccgctagcgctcggagagaggttgtgcgccactgtccgttcggccattgggctgagccggagaagcttgacgcacacgaaagaggacgaggccttagaaaaacacacgcgccccctacctggcgcgccagatgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatctttccaaaaaagaaaaaactgacttgcgccttcgcctggaagctaaatcacagcttgtctttgagtgaggcccagcgtcatcactcgcctaacaacggggatcttcctggtactccctcattaatgggcggagatttgccatggctgttgttcgaatgaccctctgatgggataggccatacctac

SEQ ID NO: 4640 - DNA, 16249 bp, Oryza sativa
ctgcattaaatgcggcgtggggcgctcgtccaacccgcaataaacgcggttaggtgagcgccgttgtgctcacctaacccacacacgtggagccaaacccacagggggtcggggcgccccagccctcggggccgaaacgggagcggcccgacccctcggggagacagagggaggggcggccacatcaccctcgggcccgacccccccccccccccgagggggtcaggccacgtgggtgaccgcggctgccccaaacctctagccaagatacccccggtcccatgtcaccgacaccctctatcctagaaaatagctatttttagttatgtgtatgtatagccaaaagtagctatatattgagacatagagaagtatacaagttcgcaatgatattaataattaaggactaattaactgcttaacaagatctaatttctaactttaacgtttgttctatatttatttatacacaatcattatcctccaaaatcaaattataccaaatgacgcttcgaaaatgccaccaagaacattacccagagcgcatagagaagtgtcactttgcagcgaactgtatttactgtgatactaggccaaagaattgtgagaaagggtagtatatctgactattgaattcaagtccatatcatctatcacttgttgcaagttaattaccttgcaaaattgcttatattttaccacctatatatgatggcatcatattcaggagagagatgaaaaatggattaatgtgttatatggattaccgtgttatattaaaacaacaataaattagagagagataatataactaatgagaagaatatattagtatttgaaatggtaatgatgtttgtttttttaattatctctttcaacgcactttcctttggctagttttatgcaattgattagttggtttgaaagcataactaaaattgtggtaccagtaatgtccaagagtcctaagttacaatcattattatatctgaaattcctatgatggtgcaaaataaaaacatccctaaaatgctaaggcaagtttactagggagggaatacaacgaaagtaattaatagaaaaaaggttttgaactgataaaacttttgatttgcggacccagatatgcaagagggtacaaatcatcttattttagataaagttttgtcagtgttctagattccccatatatgtgaactaggctctgcggagcccaccatattctaaatcatgtaaagaatcaagtctcatatgtatggtaaaagtcctgagtacacaaggaaggagtgccggataaggaaagagaaatagagttctattctggtccgactagtatatcacagatcatgtcatgtacgaaatcaagcctcatatgtatggtaaagtctgtacacaagcgagaagtctcggataaagaaagagaaatagaatcctattctagctcgactagtactacatggataatatccatatttgcttccctagttatacttcgacatggggtacgtaactaagggtataaatacaagcttatgcaagcccaatacaagccaagagggatacaaagccacctccaatctcaccaagttcattctcatggaagccaataacagctagccatcgaccatatacctgagctttacgctaatatacatataatggtaaaactggctccggccaacaaaaatagagctattacccatcatcaggggcccgaacatgtataaaaatccttgtctctcttgctctctttataactttgtttgcattctcatatcagcgcatcccaacgtactctaaacaaatcatataggtacggatcctgtgatcggtgcataatccatcgacaagtttgaactctgaaaatcaacttattgtcaaatggagggaatatatatttgaatgcaacaaacaaattatgtttcttttactcttggaatgtcataaaatccccctcccaaaaaaaaagtgaaattagaaaaataccactactatttatgatatcggctacgtgtcactgaaatttagagaaattggaaccgtgccactcagtcgtgttttccatccacttttctgtcatacccgttaattctattcttgccggccacctccggcggcgagcgacggtgtgggaagcggcggaaggaaacggagatgagcaagagcgcaaggaagcgtttgtgcagggtgctcaactgccggaagctgttggacaaggcgtgcatgcacgcggcgcagaacgagctcctcctgctccgtatggtggtgcaggtgctcttcttaaagcacgcgcgtgcggcggcggtggcgggacggcacgctgcggccaccgagctgccgagcaatatcaaggcgctaccgcagtccaagacccaggtcgcgggaggacgacacggaccgcgtggacgagcagcggctccgcgtgctcgccgccggcgcgtcgccgggggacgactggagcgtggagggcctgcggcacacggcgtccaagatcgccacgctgcggatgaagctggaggaggacgaccacgacggcgccggtgatgacgacgaggagttcgtgcggaggcagcaggccgggctggtgcaaggatagaaattgacggagatgacagaaaagtggatggaaaataggacggagtgatacggttttaatttttctaaatttcagtggcacttagctaacattatgaatattagtggtattttttaaatttcgtatatttgtaatggtatgaatccaattaactttttttatgactctcaaattttccattcatcattctgagatgtcatcacaaaaaagtcgtcatccagattcccaagccaacatactactaatcaaatttagtgttcagttatttgaaacagactattgagccgatagttgctgcagactatttacttgattacggttttttgagattgctgacagatgtgctcatagtgaggaagctgttcgacgcaatgatggcaagggaaaggcacggaggacatagcattgagtaagaaagaagaccaagcacatgaaagaagccaggatagcctaggaaagaagaacaagaagcgcatggcagaatgggaggtactcgcagcaaatcgagaaccgcttcaaccctggcgaaacaaaagtcaaggagaggctcccggctaaaagtggcacctagctagtgtacaaaacaagctcgcactccttggccggctgccatgtctttcacccaaagatgaatcgccagatggcccatccaacggaccagcgagtacgagtcatcgagaacaaatatagcggccccccaagtcttcggatgatgaggatgaggatgactatcctaacgccaatcacagagtggcctatatcttatgaggatcaacatcctacatattcttcctcaagggagtaaaaaaggacgaacgcgatgtttgctccatctcccagggacaagtgacaaagcttctctggtcggatcagtgtggggtcacctagtttgagctcagtaccacaaatatctacacacgatcatctcggattttgatcacacacggattgatatccagaacagttttcgattatttatacaagtatgttttacatcaaactagctattagaattattaaaggtgcaaagatccaaactaagacaaccttcttcaaataaaaagattcaaatctactaaaaattccacaggcaatctcgagtgtagactaggcctagaaaaacttgtcaccgttgaagatttcatcactttctaaggcttcttcatagtattggtcttctatatgttaaattatgtaagagtgagaacttatctacccaacaaaacacaatataaccacgtgtataagagatatgaatagaagtatcttaagcatgcaaaaaaaatatattacctacatcatttttcactgctggggaaggccacattagtcccggttcacaaccccttttagtctcgattgtgcaacagggatacacaatccaggactaaagataagtatttaataacgggactaaaaatccatctttagtaccggtcagtaacacgaacgggtactaatgatttttttattttttttaattctttttattgcttgcgatttttttatgtaatacatatttatatagaagtatattatattcacggtagcgctacgtgaagcgctgcgctctacgcaacacggtggcgcgactcacagcgatgaggatctctgaatttttccttttttcctccaccgaccgcgttttttgtttctccccgcacctgccgtctccaggaccagagcacttcctccaacaggtctccacgtggcctccccaattcctttttcttggtcagtaaaaaatttcctgatcaaaatcacggttaggtcatcaaaaaaaaattcctgataaaaaacaggtttcgaccatcagtaaaaaagtgaaatcaggtttccaccatcagttaaaaaaaaatgagaacggccctgcagtaaaaattttactccccgagcacaattatacgagtacttgttaaggttagtaatatttttactctagtatatttataaatccctttctcaaggtggtcatagtagtatatttataaatcatcgccaatggatacaacccacctcaaggaaggaatggtcatggcggcggctccggaactatgccaccgctcgacgccaacagctggaccacgacacgcgatgccgctctccgccatcaccaacgactccgtgccatccttgagatttggcgattgcgtctactgtagatataaaaaaaggactgaaaaagagaaaaaatggttggatacggtgggatggctggccggagacggtataaatactactccctccatcctaaaatataacaacttttaggtttcaggatttgtcttaaaatataacaacttctccaccaacattctcttcccaaccactcacaaccctccaccatttacttttcccacctacctccactactcatccaatcacaaccctccaccattcacttctatctactttcttagggcctattcactttgatgtcattttcaactgtatcaaattttgataaagttgccaaaaaagtggctacatttagtttgctgctaaatttttgtaactatataagaaatcctgccaaaattttggtaacttattaaaattttagcaactatgccaaaattttggcaatgccaaaatttggtaaggttttttttcatcaaagtgaacaggcccttaataaccgtgtcaaactctaaaacattttatattctgggacggataaagtaacattttattatggtaaaaaattactacctttatcgtttgggtggacaaggacgcacagtgaccagagtcaagtgggattcgtatagcagtaaaaaaattactagcacgttagccggaccctgaggtgttacaaaccgcccgtcgctccaccgccgctgccgccgccggaacgagatcctctgacttagctcgttctaagtcagaggcgcacagtacgctgatgtgggtatttttaaccatccgatccgcagcgaacggacgagattgattgctacagtactttcctgaacagtaaccgtgaccggtatgttgctacagtactatatcggaggcactacagcgcatgactcagattactgtgcgcctctgacttagaacgtgtttaagtcagaggagccggttcatccgccgccaaatcccggatgggaagcactcccctctcccggcttctcccgaatgagtaaaaaagtatggatcatattatctgtagaatattagttatgtcagtaacaaaattgttttattaatcctttgtattattttaccttttattaatattttgtattcttttctccacattcatccggtagtagttcagtacaaataaaatttactgaacaatatacgtcactggatattttttttactgaaggatagttatacggtaactgaacagaaccatctgtatgccgaacaaaaaattgctgtgatagttaaaaatttactcctcaagtgttggtcgttcgatccatataggtgggaagcgggactctatgtgatagtaaaaaaattacccagataaatgaggagtgggtgggtgttgtgaggtgagctatttagttaaacagcacgtacgtagagtagttctatgctgtcgaaaggacaactgcgcacgtcgaaggacgtggttactcaatagtgttggaaacagtagatgtattaatttaatatttttcttaggatcccgcttatatgtccctagggggctatttataattctattacaggttcccccattagggtttaggttttataggggaatttacatggttgtctttatgaaagggacatttacatgggtacacagtgtaatttggatatatgggcctctaataggctaatgggcgaacattggcctaatggcaaacgggcctgatggttcgactggccccttgggcctccttgaagttggacttgttgtgacgaagtctccttccttcggcgtacacccttcgccatttactcttcgcccaaaatgcctttggtctcgcgggataccagcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtgggttatatattcccccccccccccgttttcaccgccgcacccccgtcattttcaccgtgagctttctctttctccgcctctcacttcacagcgctcttgagtcaatagaccattccactgttcccctcttcgccaccgcccacacttttcgccatggcccctcgcaagccaaacccagcctccgcgataggccctgatcccagcaagatagatgacgacaccaccgcctatcttgggacttcgctcgtggacgaggatgagttggcgaagatggttacctccggcttgttggcggaaaatcaggccttcgccccgggaaaggctgtggtgccgaagcccagcgacaaccggacggtggtattcgccgtgttcttcgaggcgggacttcgttttccgtgcaacgtgctgtggctagagatcctttgcctttttcaggtggagctcccccaactgagcccatcggctctcgtccggatcgccatctttcactgggcgtgtcggaccgctaggttcgaaccgagagcggggctgttcgacgctattttttatgccaccgtaaattcgaaaacggtggtcacgcccgcagggatgaaaaagatagcgttcgggagcgtaaacttcaacgttcgtcccaagcactccgatctttggccggtcaacgccgccatgtccaagtgggaccgccactggatgtcgaagtggttctatcactccatccttttcgaggccgggtccgagtcagcgaaagctctccgatggcatcgcagggcgatcgcaccgaaccaaaagcccaaggtcaccgtcgacggcgccatagaagctcggtttgccttgcttcgcaaggtctgctcccgtcttagctgctgtgacctggtgaaagagttttgcatgcttcggatcttccctctctcctagacgtggcaagtcgaggtgagcccagacgaagaggtcgatggcttgacgagactcatcatgccagaaggggcgaacagtgagtctttgatttcctacatttatccgtgcttcgctctttcgtcctgttcggtgcttaatatgataacacgcttcgtttttgcagcgttaactcttgcccaggccgacactgaagctcggaagatgattggcgatgtgtcggtcgccgaatacagccagctgcttatgcggcaggcggccggccgggcgaaccggttgtacgacggcgaacttcctccccgggcgaagcccttcaaggccgatggggatgaagggacttctagaaaatggatgcgcgggcaagtcaaacttgctcctcggaagcaaaaggcccctgccgccaccgactctgacgccgatgactaagacactgccgacgacaatgatggcgaaggggaaggggaggatgaggaggaggtagaggttgcggtctaaacggccgtggacgtgcccaccgacaactgcactgagacgcacggctacaccccaactccaagccccgaccatgccgaaatcggggtggagtcgaacagctcccccctccgcctcaaggatttggagggggcgaagacgctggtctcgattgcagcggccagggtggcgaaggggggttcagttaagaagacctccaaaaagaaagggctcgtcgatgtcgctcgcatctttagcgatgatgagtcctcggatgggacccctacttcgcccgctagtcggagtctgggtctttcgaccgctcctggtgctgcggcagacgcgggcgaaacgggcggtagcactgcagccgggacttcagcttctgctgaccgggttgtgaagtccgcggccaggcttttcggaagccctgtgcgcaaaccggtggcttcgccgctcgccatccaaaaggggaagaaaacggtcgccgaaacatcggtttcagactattctcttgcggcgccccgcttcgcccctgctgatttcgagacttgagcggatctcatccccttcatcgagggggtaagcaatcttgtttctccggctggcagcccaagcctgttcaccgagttgaacgagttcgacgaaggctgttccgccatcaagagcttggcagtccgggtacgtcgttcgtttttccttctttttactcgtcgtttttcgacaacttatgttaacgatcaccctcttttcttttgaactagattcttgtggcccattgttctactgagtgaaccatacgggctcgccttgacggcttcaaataccgtcttcgagctaaagacgacgaattaggccgcaagaacctggagatggagggcctcgccaacacgctcaaggagacgaaggctgggaacaaacggctccaagttgaggtcgagaaggggagcgaggcaaaggccgagatcaagcgtctcaaggccgaactcaaaaaggagaaagaacattccgccgctcttaccgactactataatctcaccgagccgaagatcgaggctcttcgtgaagaggtcagcaagttagaggcgaccgctgagagagacgcacagcggttcgcgcaggaaatggcgaaagccactgaatccgccaagaccgcttgctgtacacttcgccttgccctcactgacatggggggcaaaggtgcgaggagtccctagcgaagatgcctccgcttttgacttctcggagtggactcaacaggccggccttgcggtctctgattgcgtcaccgcgtacggcgattgttgtgcacgtgtgtcggcggctttcaccatgggactgctgcaacagttcgggagcgagcacatcgccgagtttccaaattttgcgaagggggactgggaggtcagttctcaggatgtttcgcctgcactccatgcctggcgtaagtagttctggcaaaaggatggccgatctactgccaaggcgcgtctgcttgagcacttggcgaaggcagaggcagcggatcaggccgaagagcctgcggccaaagagtgtggaggagatgcaggagccagggtggacatcggccaagatcacccagaggtgtgaggccctccgcccgctttttagattttgtagatttcttttggcattttccgtggagggcgaacaatgtaaatttggccaatggccctcctcctttcatattgtagccgaaaacggcgtttttaatatatgaaatagatgtcccaagcttagctaactattatgcttgatgcctttggtacatattcttgcatcgtttcgcatacgaaatggagggttacgcttttcttccactctatgtgttttttctagttttaactttgcactttgccatttgccctttctatactgtcttagcagggtcttcgccgaaaattgtgttcggccctcctttgggaattggcgaagtaaaaatgaaaagtttgtggcggtgaagggtttgccgaaggtccggtgtccatttcggcctgtttaccgcgagatggtcataaacggcaatagttacaaggttttaaaagttgccggctggatgcggacgcaccccgggtggaccctggacgactacgactgtgtccatgtggaacgtcgagaggatatgattcgcttttggcgaaaccattagaggaccgatcgtcaggaagcgattgcccagcgtcgttatagtatagtttgtgtttcgcccccttctcctcttagggtagtgtataatgttagtagtgatgacgagccaagtttgccaaatcacaccttagggagtggtgggtgttttgggggcgaagatgtatttttttgtaagctaggctgtaaagcccgttattttctttcacctgtaccatgttgtatggcatgtattcttcgatatcttttgaagttaataaagatgtgttttgtttcctttccgctattgttcgcatagtcacctttcgtgctttcgttaggtcgaaacatgtcggcccccttgcatatattagcgaaataggtctactgacttttcagttttcgacttccgctttcgatctgtggtattctgtgcagaaagaagcgtttgtgttttcacatagatcgagtataacggtgttcggttatttattccccgaaacaagctgtcgtggtttcaacgttcgacgagcgatgcttcggccgattcatttcgcccccctggcgttttcgctgatcaggcgtttgccttggggtttttccacgaattatcattcacacaagtaaaaaaggcgaaagacacaagaattttatactggttcgggcgtccaggatagataatagccctacatccagttttctttttttttccttttcctcttttttttgtatttttgtgccgtagggcttacataacaagagatgccaaaaggcctatacaatagtatttacatttttacaagttggcaaatggggtgccaccccttctagacatagaaacgcttaagagaagcagcgttccagcagtggtcgaactcttcaccttccaatgtcgccaagcgaaaagagcccgtcctggacctgtgcttgatgaggtatggcccttcccattttgattcaagctttccgaccgccactgggttcgccttcttccttaggacgagatggccaggcaatagcttcgccagtcgaacttttttgttgtaagttgtcgaggtgcttgtggcgtatttacgcatgtgttccagtgcttcgactctcaccccttcgaggagttcgagcgacacctcgcgcccatcttcgcctctagagaacattacccttcgcgaattagcccctatctctgttggggtcattgcttcgtcaccatagagaagcatgaacggcctgaacttggttggccttgtgggtgtcgtccgaagggcccagagaatggatagcatttcgtctggccatttacccttcgccgccccctcaagccttttcttgagcgcctccaggatcttgtcgtttgtacgttcggccgtcccattcgactgtgggtgcgccaccgaggtgaacctgatttccaggtttagccctttgcacatctctctgaacttgtcggagtcgaattgcttaccattgtcagtgataaattcctttggcactccgaaacggcaaacaatgtttttccatacaaatttctgtactgctgccgaagtgattgccccaagcggttcagcttcgatccaacgggagaagtattcgattgctacaattgtaaacttgtacccatttcgtgctaccgggaaagggctgatgatgtctaacccccatctggcgaaaggctagactggtgcgataggttgcagctcataatgggatgctgcttggcttcggctataccgctgacagctttcgtacttcttagcttgctcaacacaaactttcagcacggtgggccaatacaccccctggtgaaacactttggaagcaaccgttcttgcggcttgatgagcaccgcacagccccttgtgtatttctttcgccatttcctcgccttcggcaaaggagatgcagtgaagcaggggttggagcaccccggtgcgatacagctgccctgagaccaacttgtatcttgcggctctgagttgtaggcgcttcgcttctgcttcgtcctccgggagccaaccgttcttgaggtactttatgaacggtgtttgccagtcttcagggtcttcgcccagttctgcctggtcgattgccatgatgtccaggctctctgtgggcacaattggtgtgtacaagacttcaaagatgatgcctggcgaatgtgggcctccacaagcagcggatttcgctagggcgtctgcttccttgttctggcctctaggtaagtgttagaccgttatgccggtgaaacacttttccatagatcgaacaacctccagatacctcttcattccttcttcttttggttcaaaagatttgtcaacatgacttgcctccagcttggagtctgttcggatgagcaagcgtcgaacccccactgctttcgcctttcttaggcccaacagtacagcttcgtattctgccgtgttgttggtcgtgtcgaactgcagccttgcagcgtaccgaatcggcacgccccctggcggagcgacaactgctacggcgctcgcccccttgtgcgaccacgagccgtccgagtacatcacccaaggttgtttggcaggctcgggtttaggggcgaatgctggcgtccattcggccacaaagtcggctaggatttgggacttgatggcagtacgggcgacaaaatgcaggtcgaagggagataactccgccgcccacttgctgagccggccagtaatttccttgccccggagcacttcgcccaaaggatactgtaatggcacagtgactttgtgggcctgaaagtagtgtttaagcttgcgcgaagccatcactagggcgtaagcaagcttttccatttcaatgtatcttattttcgccccttgcaaagcttcggagacgaaatacactggtttctggcctgactctgtctcttggatgaggattgcattgaccgccactggcgaagctgctagatagagtagcagatcgcttcccggtgctgggctgaccaaatcgggtgggctttgcagatattgcttcagctcgtcgaacgctgcttggcattcgggtgtccagctaaactttcccgcgccccggagggtcttgaagaagggcaaacctctttcggctgctgttgagaggaatcgacagagcgccgcaattcggcctgcgagcttttgtacttcgcgtacgctcgataggggcttcatttgctgaatggcatcgattttctcggggttcgcctcgatacccctttcagaaacaagaaaacccaacaacttgcccgcgcgaacaccaaaaacacacttctcagggtttagcttcatacccgccgtgcgtaagttgtcgaaggtcttctataagtcggacacatggttgaaagccttgcggctttttacgatgatatcgtccacataggcctctacatttcaccccaactgcttgtaaaggaccttgcacaccagcttggcgaaggttgctccggtgttcctcagaccgaaaggcatcctgaggtggcaaaaagtgccgaacggcgtgatgaagactgtcttggggatgtcggccggattcatgtggatctggtgatagccggagtacgcatccaaaaagctcatgagttcgcagccagctgtcgaatcaacaagctggtcgatccgcgacaggggggagtcgtctttcaggcacaccttgttgaggtctgtgaaatcgacgcacaagcgccatttgccgttcgacttccacaccaatatggggttcgccaaccactcggggtggtcgatctctcggaccaccccggccttgatcagcttttgcacttcggcttttgctgcctcttggagatcagcggacatcttgcgcagcttctgtttccttggcctggcatccggcttgacagccagatgatgcatgatgaggtccgtcgaaacacctcccacttcgtcggggccccaggcgaagatgtcaatgttctttttgagcaccttcaggatgttctcggcttccctttcacccaggtcgccccctagcagaacaaattttgtgggatcgacgtcgtcgatctgcatcttgaccaccttgccatggggggcaggcttcggcatgtgctttgcacggtcgtgcggttcggcctcaacattgtgcactgccctgttaattgcggccaaatcgccctttgatgtagccgaaggttgaagccccttgatcatgatcacgcctgccggaccaggcatcttgagtttgaggtagttgtggtgggagatggcttcgaacttgtttaaggttgcgcggccaaagatggcgttgtagttgtatgggatgtcgacgatgtcaaagagtatttgctcttcgcgcctattctcatctgtgccgaaagccaccgccagctgtacttggcccaggacttgaactgcttcgccgccgaaaccacgaagggaggttggtgcttgagtgagggctagggttggcaaccccattttggcataagcttcggcgaagatgacattggccgaactgcctccgtcgaccaggatttgccgaacttcaaagccagctacctcggccgagatcaccaagggttcttgatgcgggaatagcactccttcggcatcttccggtccgaaagaaatttgctgattcaagtaccgtggagccccatcgctcgccgaagcgatgttgtgcaccgttcgcagctgcatcttcttttgtcattttgacggttgagctggcggatcggctcttgtaatcacttggattactctgtgcatgtcttggcgctgttcggccgggggtgcttgttcttgaacagcctcgcgaggtgcttcgacaggtgctccttgttgtgacattggatcttgagcattgccgcgttgccaaatgtttcggcattgttcggtggtgtgcgaagagcatccatgataggcgcagtagaggtcttttctaaccttcttgcgaacaggctggtgatggctgcttgcttgttgggcgtcgaactccttgcggagggcttgtacttcttcaacggccatcactgccttgcccgcactggggtgggattggacgactcttgattcccctgctcagcggtagccccttttcgcccccctgccttgttcggcaccagctgtggatacggcgtggtgaagggcaaagtcatggcttgcgcatgaggttgggtcacagcattcggttgcccggctccgaacggcgatgcttggggggccgccatggattggtcgaatgtaggctgggtccatgccatggtgacctggttcggcgcttgattcgttccgaagcctggtgtcgttgcctgtggtcgaatggttggtgattgagtggcagtatttgggtcgaactgcagtccttgagtccacgacaaagcccctggattgggctggttcgacggtagccaactaggtgcaccttgactcatattcccttctggctgggccgaaagagttgcacttgaggtattgtggggttggttgagttgctggaggaaagcttgaaactgcgcttgcaaggctgaggtcccttccgtccttgcttgtggcgcctgaacaggtaccgatgggtgtgcttgggcagcgaccggccgaacttgtgcttgtacgtgaggggtccggtgcgtggttgcggccgaaggctgcccggtgaaccatgttggtacttgcatgacttgctgcgatgagg

SEQ ID NO: 4641 - DNA, 695 bp, Oryza sativa
agctcgtattagttcaatatgttgatcgatgtgctaaacgaatatccattaatgtcatatccttgccaagaatttactatagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgaccttcttggaatgatttgtgatcatgggtgacgaatctcttctttcctatcgttcccctgccactcaatctgcccacgtgttggggcacaggtactccaattgcatatccatccttgagataatcgatacagcactcgacaacctcttcagtactataaccctcaaccattgatccctctggatgtcattgatccctctggatgtgcacgatttcggacgtaacccttcagaaccgccatgtaacgcttgtatgaccacatttgatggaggtacaatgggccaagcgcaaccatctgcggcacaatgtgaacattgaagtgctccatcatatcaaaaaatgacggagggaaacacatctcaagttggcactgggtctcatgtgcgaatgtacggagatttc

SEQ ID NO: 4642 - DNA, 6327 bp, Oryza sativa
ccgctgaacttttatataggtcggaatcaatcaggaccgtctataagatgggacggctccaacttctcccgcattgggccgggcgccgttcccagccgcccacactattgggccgcgtgtaatctcacagaataagttcactttatgtccctaaagttatccctgaatctgttcctaggccgcacacaccattgggccacgtgtaatctcctcacagaataagttcactttatgtccctaaagttgtccctgaatttgttcccaggcctcctacactattggtcacctcatgggccgcgtgcacgctccgcatggaataagttcacttgaggtcccttaagttgaactttttttatttcattaggaatagattttcttaaagagctcatatcatctaaaactaaaccctaatcatttaatattttaatatttggtataatttatgtttacccgttgcaatgtacgggggtattttttttagtatacatatatgtgatcacggtctctgtttggatagacactaaaaaaaaattgtctagacgagcaaaactgatcacggattttctgcccgcctttacacaaacgactggaaatcgacatttccacaggtgccctgcgtgatcatttccttgttcactgacagccatggaaatcactactgataggcattaaagtgtatagtacctccttgtcaaaatgtatgaggccgttaattttatgcagaccattcaacaagtaataacaaaaataaatgatatttaggcacggggccgggaagcacaacgggggtggcaccactggacgtcggcgtccacggcgctccggcttacctcgggcgaaacagaggcgaggccggtggagagggggcggctgcgaggcttggcgcggctccagtcgacggggaggtgcggccggaactcgccggtgcggtggagagaggaggtggcgcgggaagacgtttgggagggctcggcttgctgggaggaggcaaaaggggaagaacgggaggggcggcgccattttataggccgagaggaggagggaacggccggagggagctcgccggccggccatccatggcggccaatcaaggaggattaaatccggcgaatttaatccgaattaagaggggaaatcaagggggaattgatgatgaggaggagaggaaccgattttcgcaatcactttggaggagaaaccactggggagggagatcaagaggcggccgcgcttctgttcagccgtgagaagaacaggcgacggctcggctggaggaggaagacgacccagcggctgggccagctgggccacgcggaggattagaaacagactttatccgcggagagtgaggaaggttgggccgagcaagggaggcgaggagatgggctaaggagaaggaaaaaggcccacgagggagggagagagagagagagaggaggaaggggaggaggggggcgctgatacgcgatcagccgcgcgcgcgcggtcagtcgctccccctctagtctcttctctgtatctactatacttatgtatatactacatatacacacatatatacatatgtatatatgtgtgtatatatatatatttataaatatatttttaatatataaaaaatatatacacatatatacaaactttgtatccgatgtatacgaattttatatacatatgtattaaaaaattaaaaaaataagaaattacatcacgtatacaaagtttgtatacacgtatgtaaagtttgtatacgcgtatataaactttgcatacgcgtatacaaactttgcatacgtacgaatacaaactagcttggtatacatacgaatacaaactttgtattcatacatcttaaaaaaaactaaaaaaacagaagagaaaccgaaaaaaaaagaaaaactaaactgaaccgaaaccaaaaaaagggaaaaaaaaaagggcaaaccgaacagaaacggaaaacatggaaaaaacaaaaaaaaacagaaaactcgctctcccgtgcggcgcgtccgccgccccctctcctcgcgcgacacgtgtccagtcatgcggggaggggcgcgcgcgagtaatagccttctcgaggggaggaggacaataagacttctgccatgggctgagagagagggaggactttgggccgaaaatgacccaaagggagagaggatttatttttaggttttctatttttagttaactctgaaattggtttttgttgcttaataaatatttttgctgctctgaaaatttgagtaaaaattgagggctcctctttgaccatggagaatttaagaaaaatactccaggccacatttgaatttttcttgtacgcattttaatgtttgccatttcctttttgaattttaattaatttattatttcttttagagaatgatttttaaaacgggatgaatttatcaggttgtgacattaaaggagtccgactacttgaagacctcatttatcactccgttcggtgcgtactgctacatcatgatgccttttggcctgaagaacgctgaagctatgttaccaacgcataattaagagatgtttgcagtcacagctcgagcgcaatgtggagccatatatcgatgatgttgtcatcatcaagacctagcaaaaggtcaacttgattgctgacctggaagaaaccttccaaaacatacgtgcctttaggatgaagttgaacccgtagaagtaccgtcagggaagctgcttggtttcatggtgtcgtatcgcggcatcgaggccaacctggagaagatcaacgctatacgcgatataaaaccaccgaccactcggaaggatgtcaaaaactcaccgagtgcttggcggttctcagttgatttatttccaaggtggagaacgaggcatgcccttcttcaagttgctaaagaagacaaacgatttctaatggacgcccgaaacccaacgagcttttgaagattttagatttcaatagtttcctcacaatatatttctcgtgctggcttcacctcatccataggagcctttgctactttatgcattggcgagaataggagcgagacattcaaaaagctcaaaggcctatttatttcatcggtgaagttttggccgaccgcaaaatgtggtatccacaagtctagaagttattgtatggagtgctgatcacggtcaggaagcaagcacattattttcaaagtcacttggtcactatggtcacgtcttttccactcggtgacgttcttcacaatcgtgaagctttcggcaaattacaaagtgggctctagagataatggcattcgatatagccttcaaagcccgaacatcaattaagtcacaggtcttagcagattttgttgccgagtgaatggaaattcaagaagggacaccaatggagaagctggagtactggactatgtattttgatgagtctccatctctggcgtgctccaaatccatcccctttcccccatactagcccgtccagtttggccatcttgtgacagcaaagcaccgctgcaagaggaccgatgcttggaaaggaaatcgccgcagccttcaacgcccatctcatggcgctaccatcatcattgcaacatgctacgtggttgctttgccgtcgcctacccgtcctcccaccacggtggcctcgccgccacgccactctagccttgccgtcctcctaccatgccaagctcgctgccacaccactgtaggctgcgcaccatgcttgacgaccacgagcctccgtgccaccctcgctgaccgcacttgtccccgcgttgccgacgcctcctctatcgacctttgcgcctccgtgatgtgggctccagccgcacaggcggtgcctccgaccacgccagtccactgtgccacttgctgcttctgcctcacacaggcctcacgttgccgtggcctcaccgtgttggtcttctcggcagtccgcgccacgccggccatgccgcctcgccgccagcccgcctccacgctacgctggttgtccgccgacacatcctctcccggcaacactccctgcgccgggcacccactgccttgcgcaacagccagatccaaccaagagagggttggatccgggtgtgaaggtgttagatccgcccctccaatggccatggtgactgtcgccgtgcattgcctactcttcctgtgccaagaggggtttctgccgaagatgtggccttggctccaccttcctagctcaccaccggctttttcgtcagtgagctccggcggtggctaggtagaggaggggcagcgcgggtggctagggttccatccctgagccgcccacacatgggcgacgcagaggaaaaagtctggttccgtctcagaaatattgcgtcaatttccggatgtgaccaaacgcctatgtaaatgacttatgtgctgcctggaaaaatgtttccattaagtagtgagtataatttctaaaattactgatattagagtgcatgacatgaacgattatacgatatctttatctttatctttacctacttaaaaaacaaaatctgcttcaaacaaaaaaaattatttctccgttggtcctcctggtccgacgacttctcctgctcgagtcgtccatggcgccacacgggcaccatgtcgccaccacatcgacctatctttccatgtgttttctcctctaattaattgcaaaaatcgattgttcactcctccctcatcctttcctttgtgattttctttttcaattcggatttaattcactagatttaatctcggtttaacggttatcaatgatggttagacagctatcttcccccggttgttcctatcccaagttttgcggattcactccgattttggaaaaaacggaaagaggagatcgagtggatccaaagctctcaatcaattttgggagatcatagatttgatagggatgattggctccggtaccatacaggcacataactgtctactggaagttaagagagacaggctatgaagggaggtaggtaggagacgccttttcaattttaaagtatagcgatactaatgttttaatttaattattcatcagctcataatagctattttattactggaaaaaagtttttacccgttgcaacgcacatttatttttttttctagtaataataaaaatacaaaactgccggcagggcaaatgcgctacacagtaagataaattttagcatgacctttttttgccatgtttttattgtcatcaacactttatttaaattttccatacaataaacgagtatatatatctcatacggtccaacagtaactaggtgacgatgaggggcacagccttgagaggggtagccataacaaggatatcgttgcttgtgtaccgctcggtgacgtccacctcctcagccgacatgcctttgggcaggtgccactcgaacgcatgcagcaatgacgcgactgtaaatggcacgacgagctctaccattggcaaagcagggcacagccttcggccagacccaagcggaataaacttggcctgcttcccccacaagtccagctccgtcttgcccaagaaacggtccggcaagaagtcgtccggtctctcccatgcggtagagtcacgcattatcgcccatgagttgaagatcaccgtcgtgcccttggacacggcgtagccgccgatcctcacgccgtcctcgaccaccaggtgcggcaacaggaggggtgccacagggtgcagccgcatcgactccttcactgcggcctggaggtacggaaggttcaccacatcggcctccgtgatcgtcccattgcctccaagtgcggccttcatctctgctcgcgtggtggccatcacattagggttgcgcagcagttctgccatggcccactccaccgtgatcttggtcgtctcggtccctgctgcaaggatgtcaaacaaaaggattttcacgtcacggcgagagagcttgccggtggacatgagcacaaggagagagtccagcacatccttgcactggtcgtcggtgccctgggctaaacggcagtcaattatgctgtccaggatatggaggactcgactcatgtgtatggccgtccagtggcgaatgccttgcaaatctagcggccggagcagcgggaagaaatcggacgcgttcggcttcgcaagtattgcaacgatatcctccataagatcccttaaattggggtgggcatcgacggagagaagcacgttcgccaggaggtcgaacatgccatggtacaggacctggccgatatcaacctcctgcccagcgcggcgacggaagctgtccaccatgtcgaaacaccttacgctcgcgggcgctgcgcgccacgccg

SEQ ID NO: 4643 - DNA, 3435 bp, Oryza sativa
gcgagaagacgtgcgttaccgagatcctgcgcagggtcttccatagaggatcgtagctcggcagccaaaccattgatcgttccgcgtgcgcgagcgcacgtctcgtgtccgggaccgtgcgcgccgcaaggcgccgatcgtgcttggcgaatgcttcccacgcagcgtcgcgcgaggagatgaacacggtggtgacgaggccaagcttgagcgtcatcacggggccatgggcgtgagccaggcttgcgagtttgtggtggaggttgccgccgcgcaggtcgagtaggttaccgactatgggcagcgtcctggggccaggcggccgctgcccatcaccccttctgtttgttcccacgtaacagagtagtaggacagcaagtgatatccccagaaaccacaacccacttgccattttgtgcgttgcagacttgtagttaatttgaaaccataagaatggtacccgccctatatatatagttatatacctcgagctttccaaggccagtttcgtccgttcctcaaccttccgctatcaccgtgggagattttttttgtcactatggccccgttcttttctccgacaaaagttagatattcgtggcacacttttcaaactgctaaacggtgcgtttcatgtaaaacttaattaatcataagttaatagcacctcattttacgtaaaacacttaattttcatcttcatttacatgagtttcaaacaccaccaatagctaacattcagccccctcctcccacttgtcagatatggatccaacagtagaattcgctcttagggctcctttggaacaaagcaaaaatagaggatttttataggattgaaatcctatgcaaaataatggaatgagcattatatttgagattcctacaaaattccaatagaatggcttgattcataggaattttggaggatttctaacacgaggttagaccacatggaaaacttttcttaggtctatctttctccttaaatcttatacttttccaatgaagcgtacaaacaaataagtttcacaaaattcctgcattttgaaattcctagttatcaattaaacatgccaactctcaattcctacgttttcatgtttctatgttttttaattcatgtgttccaaaggagccctttatttggtgtggttttgcttgatgttacattttaaaatacaaagatgtatcaatattcgagtatgcaatttgatttaagagaaattatattatttggcaccggcatgcgctcaattaattttcaaactagttatcaaccctgtataccgcacgggccaatgattatacaaaacatttatctattttttacaattataacattcaaataaagtttaatttatttgatcactatttttaattatattttcatttcagtgttatataattacgctccaatttcaggacagtgatttcaatgcatgctattgacttcaacagaaaaaactatgcgtgcaatgtcatgagtagatctatactgaaacaatgaaggaccgtctatattagtccttctggataatatcgctaccaagatgctataattataacaaacaattctagatagatttttatcataagagtggaaagtgtggacgctttttcgtggccaacataagatcactaacaatttgtggtgtaaacaacagagtcgccaaattcgatagatcaaaacctgctagcaaagccgatttcaagattaattcactttcgtggaattacacgactaatttacaagcaaattagcaaagaagataaatatcgtacttacgtgacgacgaacgagtagtttccgagcaaactaccaaagcataatcttctcggtttcgtggagaagcacgattatttttcagcgcaaaaggcaaagattaactaaattctaggattgctagaactcagccatgaaaacgaaatagaaaataacaggaaagtaaagaacgggaaaatagtatattgacaattgtttggggtccccattaaccgtacatccgcatatacatatatagatatatatatatatatatatatatatatatatatatatatatatatatatatatatatatagaaagtaatgaaagggccacgtaatctgaaaaacaatggccatcggatgaatgtttggataaaagatgaccatccgatcatagatatccatgcagcaaaagaaaatacttttagcgtcttctagcgtctcccctttgacacatgaataaaagaggcacttccctccggtttcttctagcgtctcccctttgacacatggcaaggaaaaaagagtccacaacatgaaaaatacactataggatattgatttgcatggaaaatgactacactactgtttgatctcgtgctgattaattaaatttgagaagtgaaataagtaaaacaaacatacatgaattggtgttgtgtaaaaaaaataaagatattgctgtagtagtatgtaatttatgggctacttcgcagtagtaacatttaggggcaagacagcaagaccactataattgtaaaaaaaaaatttaagatctttaacaaagatgcatctcatggtcgcacaaatgcacaactttgagtggctaatatgtaatggaaacctataaaaatactgtaggatgtaaaaatagacgtataaattaaatttgtacatgtcataccaagtaaaacttttactcctaaattaaaccataagtaaaagtttcagttaggatgacgtagataaatctcaaacatccatttttcatcctacaatagataaacaaagtcaagaatgatgtcccatgcatttacacaacaattttttatctaagggtttgtgtttaagaggaggagaacagagaagatcgaaaaaaaatacacaaaacgagttgtactattacgcatgattaattgagtattttttaaaaaagatttaaaaatgaattaatacaattttttaataaaattttctatagaacttcttttgaaaaaaaatacatcatttagcagttcgaaaaacgtgcgcacgaataacaatgaagattttctcccaaatcactattgccgaacacagccatgtttttattcaaatagaagttactgaaggattttcaatttgaaattcttgtggaaaaaacttctaaattattatatttttcaatccaaattgcaattaatcttatgatgtattaattagttaatcctaaattgcatttgatatgttctttctggtttattgagaccaacattgagctgggctgcaaaggaaattaatatggaattatgaatgtgccttttttcgctatttcaataatatgatttatagtagaacgatgttaaaagaaaactagtatatatatatatatatatatgtatatgtatatgtatatgtatatgtatatatatgtatatatatatggatatatatgtatatatatg

SEQ ID NO: 4644 - DNA, 600 bp, Oryza sativa
ggacaactgcgcacgtcgaaggacgtggttactcaacagtgttggaaacagtagatgtattaatttaagatttttcttaggatcccccctttacatgtccgtagggggctatttataatcctattacaggttccccattagggtttaggttttacaggggaatttacatggttgcccttatgaaagggacatttacatgggtacacagtgtaatttggatatatgggcctctaatgggctaatgggcgaatgttggcctaatggcaaatgggcctgatggttcgactggccccttaggcctctttgaagttggacttgttgtgacgaagtctccttccttcggcatacacccttcgccatttactcttcgcccaaaatgcctttggtttcgtgggataccagcgcgactcttcggctttcgccgtctttgcttcatagtcttcgctatgggggcttcgcccaaatggacttgatgccttgagcttgaatcctcgctaggtacatggtttcggcaggcctggttggggggtctcacgacataccaccaacaatatatacatatatagcaaatctattctacacgcctcccttagaataact

SEQ ID NO: 4645 - DNA, 678 bp, Oryza sativa
ttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttcggctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcggtaccactcgacatactgtgtccacattattaatttggtatctttataccatgatccatgagacatgatcatcaatttatacatgtgctgatcattaa

SEQ ID NO: 4646 - DNA, 638 bp, Oryza sativa
  unsure (1)..(638): unsure at all n locations
atgcagaatgtgcattaaaatccccgtccaggaccggccggggtacacaaacgacaatgttgacattcagatccacgtcttacaaacatcataaaagtcttacataaatgcagcggaaaaaggaagacaacaggagctaagccttgactagaactgcagcgggaacaccactccacaagcaccctcgatggcacggacgaagcctactcctcggagaaacctccatctgacacatactcgaactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattattattaactatccactgtccaacgctatcccacgttacgacaggcccaaccatccacctaaactatccaaattcaaaagattacactagggtgagactaatcacggtgaatctggttgaccgcctataaccacgggaacggctactcgaatagttttactctgannnnnnnnnnnnnnnnnnnnnnnnnnnnnnnnnnnnnnnnnnnnnnnnnnn

SEQ ID NO: 4647 - DNA, 1755 bp, Oryza sativa
catccagttgatccgtcgaaaccgtgccgagtggttggaggatgacgccgacttccctgaagctaggcgaaatcggtgttgaagccgacttccgcctaggcctacgggatggagacgctgtcgtgatggagatggccgccaaatcgtcggggagcttcatcaggattggtgggtaagccccatcatcttgatctggtgtcgttggagaagatgcgatcttgcccgagtggtttgaagccgactcgattgagatggtcttgaagtaactttcagccgcgtttgggagtccaaacgggactgaaatccggttctctcccgactggtttgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacagtagcccccgagacctttgcagtcaaccatcatagccttctcaaagataataatctgagtgcttcaaacctttcatgccaagatctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcattctagccgactgctttttagccataataaaagaaatccgagtggttaacactataaaaggttcacgaatgaacacacttgacaggcatccgaataaaaaactctaaagattacccaccaagtattataaaaattatggtaatgaataagtctaatagcctaggctatgactatttaccataatgaaaacaggcatataacataccaaggaaatgactatggtaaaaacaagtcattccaagttaacccagacagcttttgtagcctaataaagctgacaaaaacagtataacacctttctgtcgggcaccttttaatttgcattgcaataattccaaagaattatatgaccgcataaaaaggattttatcagcattgggcaacactattgtgcgcataaattgccaaagcaaaaaatgcctaagtccctaaggaacacaatgggccacgctgttaaaaatactgagctgaggtactgttcaggcctaagcccatttgcacctccgatacccttaacaagaaatcccgagatccaagcgtcactt

SEQ ID NO: 4648 - DNA, 9019 bp, Oryza sativa
cgttctccctgtcaaggaaatcatcgggtggcggccagcatgcggtgaggcttttccgacccccgatacaaacgaggttgtggtcttctctcatttcttctatggcggcttcgctcttctaacctcgaaatttttccgcgggatattaaacttctacggaatcagcttgcatcacctaaacccaaattccatagtccacatcgccaatttcatccatgtttgtgaagcctttttgggaattaaaccccacttcgctctgtttcgccgaatcttctttctcaaaccccaaccgaacaagaataaaccatgtgtagtcggaggggccggatttcagctgaggggaactctgagccagaagtacttctcgatgcccttcaagacttcaaacaaagggtggcatgcaaactggttttatgttcagaatcctgagcctgctcttcccgagtactcttgtcttcctccggtgtaccaagatacttggaactctcttccgattggggatgaagcagcccaagccttggagttgatggatcgcatgctaaaactcaaagaacaaggcttacaaggagagcagattactcggcacttcatcaaatgccgattggcaccaattaaagaaagatcccgcacagcattcgagttcgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaaccttcaacccatgaccaaaacataatctcgtcttcatgttgagttaactaaccgtggaggcatctcattcaggaatatgcattgatgaagtctgaccccccaatcactcagcgccggtctcctcgtcagcacaccgttcagggaggtggagggccaacaatcagatcagacccgcaacctcaaacctccaatccaactggacagacaggttctcgcaagaggaaactggtgcttgacaacgatgaaggcgatgacgacaacaagtctggggacaagggctcgcctaataaactcccaaagcgtaccatgcccaggaaaaaacttgctaaccgcccaacgccaaagattagaacatcttccaggtataaacctcttggtaccatttcacttcggcacgcttctctcatgaaaataatactgaatattaaaagaatactttgcaggaaaccatccgacatagatccaactggaaaggatcctgatccggctgtgacagggccaagttcatccaaagatcctgagccgactgccgaaagccagccagctagcgcccatgcttcgggtgataaggccgatccgagtgaccagccgccgactggaaaccagtcggcagcagctgaaactgcaacaacccaagagcccccgactggaaaccagtcggatgtaggtcccgatcaagaaatccccgaagttgaagcgcagacgacaacttctcaaggaccagaggctggtaacgactcgatgattgggtctccaaataaagaacaaggatcacgtcacgctcagctaggaacatcctcaggtaacccatcctctcaagtgatgccgatttgaacaacttcagcttattcgtctaatgtcttggaaatacatcaggaacaccaggcgatgacgaagaagcaattcctcgcataaaggcggctgatgactctcgtcctcctatcttgctcaaatggtgggacgagaactcacaagtcgccggcatcgtcataaatcgtcaaaaagaagatgaggaagtgtgccagctgaagaaggcacttggagaggccactcgcatcgtgaatgtaaatcttccgggtgactgtctttaataactttgttctctctttagcagaactaaaccatgaaccatcatgcagagaatccatcttcgcaatgaggccaagactacaactttggaaaagctggttcctcatttgggaactcttaaagcagttagggaccagctacatgaggccaaggagctcgccaaaaagtcagagaaggaattaagggaccgaattgcccagctccaggattcaaacttcgagctgagtggtgcatcaaaaggtaatctctagatctgtcccattaatttatgctgtcgtaactgtatcctcaaccatctggattgcaaacagcgcaagccgccaggatggctcaaatggaaaaacagattgaagccttgaaaaaagacaaagcagaactggctgcacaaagggactcggccttgaaggaagttgaaggtactgccagctgacaatctgaacttctctctgttaaatgcggcagattcttatcataaatgtgttttgtagaccgcaaaatcaaatctcaagctcaatttgacgtcctggttggtaagatcaagagacttgaaggagcaagagatgaagtcgccaatgtcgcaacaccactcgtccaagccatgttcctcaataacagtggtccgagcgcactcgacgcaaccgaaatattcgacaagctgagagttgctccggatgtatatttcaagaatatcaagaaagctggaagtatgggagctagcatggcattggcgatgaccaaatccttgtacccaaggattgaaattgacgccattgatggctttgcagacgggacaagcgaagaagctgcccttgatcttatcagcaatgctcaaaacgcggctgacaagattgcaggtgacgttgtagatcaattccgcaataccgaccttcagccaagtagtaataactctgatgatgaaaagactgattctgactgagtgtaaatgtagaaaatggaggctcaacttgtacaatactggtgtatttatgctgtgtttgataattctagccaagtcgttgatttcttaaaagcttttatcaagctttgttgagcctaaaacccaaagaagctattaaaaactttcagtcctcgcagactaagtagaaaaaccaaacaaggcaatgatagaccaagtaagcaaattgaattgataagtaatcaaactccattattatgatgatagcccccgactgacaacttcaagaagaaaacttgatgttgacagtcaagatagggaagtacaatgataagcttaagcataaaaacgacgaagatgttcaatgttccaagagttatcgacgagtgtaccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgaccgaatcaaagctgcttcgcggacttcttccaatcggtgcaagtcatccactcggtcctcttcgtagcgttcttcacggaaattttgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgtagtatcatgccattggctcgctccacctgtccattgctcatggggtgccactgaggcatagcaaatcttaattccaaagtcttcacaaaagtctttaaaaactccgccagtgaattgtctgccattatcagtgatgatccgattgggcactccgaatctatgcacaatgttgatgaagaagtctcgagcgttatctgctgtgatcgtgacaaccggtttagcttcaatccacttggagaatttgtcaatggccacaaagaggtgcgtgtaaccgccgactgcctttttaaacgggccgaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcagtaggccaaaagaaaccctgccggtaagctttgccgacaatggtgcgcgcggcagcatgatttccgcatatcccagaatgtatgtctttcagcaattgtctcccttcctctaaagatacgcagcgttgcagaatccctgaagggctttttttgtacaactcagcttcatgcataacataaagtttgctccgccttgaaatccgctcggcttcatctttgtcttgggggagttcttgagaagtcaaaaatcgtatgaggggttctcgccagtcggcttcaaccatagctatgtcatgagtgcccgcaacttgagtagtatctttgtgaggtactgtcggcgtataaaggtgttcgacgaaaacatcagagggtgccgcctcgcgcttggatccaaagttggcaagtctgtcggcggcctcattattgtgtcgaagaacatgactgagctcgagtccatcgaacttgtcttccaatttgcgtacctcttgtcgatatgccatcatattgtcgtcaaggcaggaccactctttcataacttggttgacgaccagctgtgaatcgcctcgaactattagacgctttatccctagggaaatcgcaatcctcagtccatgaaggagcgcctcatactcggcgacgttgtgggatgccgaaaaatgtatccaaagcacatagcttaatctttctccagttagggaaattaaaaccactcctgctccagtacccgaaagtcgttttgatccgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccctcttcctcgtgctcaacgaccaggactgtgctaacaacctgggaggtggcagatacatacagcaacaacggctcctgcggatgtggtgaagctaagactggcggctcggtgaggagtttcttgaaatcttcgaaggccttctgtgcttcgggtccccactggaaatcatctgttttcttcagtagcttaaagaagggcatcccccgctcgccaagtcttgaaacgaatcggctgagcgccgccatgcatccagtcagcttctgaacatctttctgggtacttggcggtttcatgttgaggatagcagtaactttctccgggttggcttgtatgcccctatgagacaccataaaaccaagcagcttccctgacggtactccgaaggtgcacttttcagggtttaatttcatcctgaaagcgcggatgctcgcgaaggtttcttctagatccaagatcaaatcatccttttgcttggtcttgacgactacatcatccacataggcttcaacgttgcggccgatctgtgttgagaagcatctctgaatcatacgttgataagttgctcctgcgttttttagttcgaacggcatggtgacgtagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttctttcgaactagaaccgggtttgccagccagtcgggatgaaggacttctttaatgaagcctgctgctaacagcttggttaattcctccttgatcgcgtccttcctgtcttgtgcgaatcggcggagtcgttgtttgattggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaggggaatctttttagtcttggcttcgctttctccactctttgagatcttggtagcgggcacttctccttcgctcgtcgtggctgcagccagtcggatatcctctcgggcagacgccatctcgcgggtttgagccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctcggtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccgtcaatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctgccggggtgtcgccgtcgtccttcttccttgacgtgctttgttcttcgtcagagttcttccgtgtagtcttggtgtattgctccgcaaactgcttgtagacgaaacaatctttggccacgtggttggagttaggatggtgcgggcattgggagttcatgatcttgtcgaacgtgttgacgcgcgagcgctgtcgagaagagtgggtggcggttgcaacaagttccgcaggcttacgcttgcggtccttattgttgttacttccacctcctcccggagccggcgtacccttgtttggcttccaactgggacccgactgctttgatgcggtgacgacgtcttcagctttggcgtactcgttggctttttcaaacataagcttgactgtcctgggaggcttacgcccgaacttgccgaccaattcttcgtggcgaatccctttggtgaatgcggcgatgataacgtcgtcggtgatgtcggagatcttgttacgttgttcagaaaatcggcggatgtaatctcgaagggattctccggacttctgaataacgttgtagaggtcgtattgtgtgccgggacgctcgaaggtgcctcggaaggtggcgatgaagtggtcgcgtaattcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattctaggttagtggtaccgtcgtacttctctattccagtcggcttgaagccggctggccaatccactcgacgcaggtcgtcggtgaaggctgctactctgtcaaggtcgtcgtcgtggcggtccggcgaatgatgatggcctcgagctgctcggcgctgtatgattgtgtcgcgaagatcgacggggcggcgacgaggtggtgagtgaggccgttccactcggcgctccctatgatggtcgggaggtgagtgaacggaccgctcgtcgtgacccctgctcctgcgattggatcctgcgccggtgatgctgaggcttggataacggtagtcatgagatcggaagtgggggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgataagatcacgcgctcggcgccctgcttccaaagctcgctgccgtcgatcttcagcctccttcgcggtccgctcacgctcctgctgctcacgccgtagccgttcttgttcttgtgcttgatgctcctcctccagtcggcgacgctcagtctcgcgacgtgcttcggtctcccgggcttggcgttgctcctccgtctcgttgttggccatgaagacgccgaagaagagaggggtgtagttgtcatctaggctttcgtcgaagtcgtcgagatccgggtcgttgtagcgagagctaaactcatcgtactccacgatgtcggtggggcgcgagtcgacagtgggagagctgtagtagccatccagttgatccgtcgaaaccgtgccgagtggttggaggatgacgccgacttccctgaagctaggcgaaatcggtgttgaagccgacttccgcctaggcctacgggatggagacgctgtcgtgatggagatggccgccaaatcgtcggggagcttcatcaggattggtgggtaagccccatcatcttgatctggtgtcg

SEQ ID NO: 4649 - DNA, 557 bp, Oryza sativa
gcacgacatggtggacagcttccgtcgccgcgctgggcaggaggttgatatcggccaggtcctgtaccatggcatgttcgacctcctggcgaacgtgcttctctccgtcgatgcccaccccaatttaagggatcttatggaggatatcgttgcaatacttgcgaagccgaacgcgtccgatttcttcccgctgctccggccgctagatttgcaaggcattcgccactggacggccatacacatgagtcgagtcctccatatcctggacagcataattgactgccgtttagcccagggcaccgacgaccagtgcaaggatgtgctggactctctccttgtgctcatgtccaccggcaagctctctcgccgtgacgtgaaaatccttttcgttgacatccttgcagcagggaccgagacgaccaagatcacggtggagtgggccatggcagaactgctgcgccaccctaatgtgatggccaccactcgagcaaagatgaaggccacacttggaggccatgggacgatcacggaggccgatgtggtgaccttccgtacct

SEQ ID NO: 4650 - DNA, 676 bp, Oryza sativa
  unsure (1)..(676): unsure at all n locations
nnnnnnnnnnnnnnnnnnnnnnnnnnnnnnnnnnnnnnnnnncactaaatttgattagtagtatgttggcttgggaatctggatgacgacttttttgtgatgacatctcagaatgatgaatggaaaatttgagagtcataaaaaaagttaattggattcataccattacaaatatacgaaatttaaaaaataccactaatattcataatgttagctaagtgccactgaaatttagaaaaattaaaaccgtatcactccgtcctattttccatccacttttctgtcatctccgtcaatttctatccttgcaccagcccggcctgctgcctccgcacgaactcctcgtcgtcatcaccggcgccgtcgtggtcgtcctcctccagcttcatccgcagcgtggcgatcttggacgccgtgtgccgcaggccctccacgctccagtcgtcccccggcgacgcgccggcggcgagcacgcggagccgctgctcgtccacgcggtccgtgtcgtcctcccgcgacctgggtcttggactgcggtagcgccttgatattgctcggcagctcggtggccgcagcgtgccgtcccgccaccgncgncggacgcgcgtgctttaagaagagcacctgcaccaccatacggagcaggaggagctcgttctgcgccgcgtgcatgcac

SEQ ID NO: 4651 - DNA, 661 bp, Oryza sativa
agcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtgggttatatattcccccccccccccgttttcaccgccgcacccccgtcattttcaccgggagctttctcttttttccgcttttactttacagggctttttgagtaatagaccattccaatgttccctttttcggcaccggccacactttt

SEQ ID NO: 4652 - DNA, 895 bp, Oryza sativa
  unsure (1)..(895): unsure at all n locations
nnnnnnnnnnnnnnnnnnnnnnnnnnnnnnnnnnnnnnnnnnnnnnnnnnnnnnnncttcttcataaagttcttttacctagtatagcggaaaggcctaatttctgaatgaagttgttaattgtggagctgcacatgtattttattatcattggtgaacatttgtttcttaacttctgaatgtctaattgattctaatttttgtattggcagagtgtgatgcagatcttgttgaaaaaattgtttgtgccctatgtgaattcatatctcaaaagaggcttcccattgcctatcatcaaggggttctccatcagcgatgcatacatcctcacttcccagtcaagaataattgttagctctgatgttgccttcatcggaggtcatactccctatttaagccaatgaaagcatctggcaagaagtaggcttgttgctcaatcagcaaagcatcagaaatcgccatgtcccatggaacgtgtagtgctacttcctcaacatgttagcattatttcgttctgctgtataatgttcttttgtaaataaccgtaggagttgtacatatgtaaatctaggaaccatagaactgtagaaataggctgctgctatactggagaaatggtgggttggttgtgatgtacccacaattcttccaaatgaactggcaatatacttgtacacgttctgtcaaaaaaaaaaatgtacactccactgtatagtgttcagttctgtaatctatgctgaatttgctgtatttaaccataatctggaaatgtatcatcgttccagtatcaattcctgacttcttgtattggtaagatataaattatcactgcaatctgcctcactgaacctgtaaacacaaactgatctctctttattttcagtgtagctgaatt

SEQ ID NO: 4653 - DNA, 1090 bp, Oryza sativa
  unsure (1)..(1090): unsure at all n locations
nnnnnnnnnnnnnnnnnnnnnnnnnnnnnnnnnnnnnnnnnnnnnnnnnnnnnnncgcgttatcgatcgtaagttgccaatacgctaatataggcgcgtcagtgttgcccgtgtgtgtttcaagcgatgttgtgatttatatatctgtttgtgggactccaatttatcaaatgcattacagctacatttcaccgatcaaacgttgggcgtgcacatgggcataactttttgtcgcttaatttcaatgtcgaatcatttcgatgcaccaattggaatgtcatgcctaagttaatcacccaatggctatgatgatgcgttcttcatctataatttgtagtaactcataaaatcgcagatgtttattgaagtagatggttttttccctgtttttaggagcttatgaaaggtgtaaaccaaggagaaggttcgagtgcctatgacatcgcccttcttcaatctcaggtatgcatcgtttcatatttttcatagaatcaacagttgaatggaagttacaatgcagacttcaatttcaataaagttgccagtttcagtaaaaaccactgcagtttgttgtttttattatttgtgtgctggcgcttgactgcagattcgaaatttagcacaagaagttagagatttgactatatcaaggcctattaccatattgagtggcaactccgactctggaggtttgttcttgtttgatcctctcctcgttctgttttcagtttcactcttctagcagtcatgcaaagagtctatccatataaagcttttgttacatctttttacttagattatttgtcaatcttaaggtttagatagacaattattggcttgtatcagctcctctacaaggctaccaccccttggtgaaaaagtggtcaatagtcatatttttgctaaaactcgttaaagagtgtcaatctctattctctaattcaatattgagtaattcatgaagctgaaatgcttcagcgattacagtatgaatcatgttgattggtcaataatagcaatgtaatgaccaatgggataggaatgctggacaatcaactggttctcgcaacattcatgaacatatctcact

SEQ ID NO: 4654 - DNA, 652 bp, Oryza sativa
atccattataaacagtgtggaatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatagacggtgtaagtgggtagactatgggtgttggtcggtgagccgcgaacccacttattttaatttataagtggatttgcggtttattttagcctacaagtggatttcacgccacttacactcgtaccataaaccaccgtaacatcttttcggttttcactgtgtgagctgctgcctcttgtggtagtatagtgttcactgttcagtgtccagagagtgata

SEQ ID NO: 4655 - DNA, 11368 bp, Oryza sativa
tgtgctaaaaagtcaacggcgtcaaacatttcgaaacggagggagtatatcgtttgtcccaatgttcttatcagaatgcatagcagcataacaccttgttgaaataaatacttgtattgtttgttttgtttcttgtctcttgtgttctcttgctgtttgttgtttaataaacaactgcaatttttgcttgcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaacttccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatgatggaccattgtttgcccgcagtatgctggaacttcttccatctgttattgtatggctagatagtggatggtaagcttagtatgcctggttgctgcaaattgatggaatgatggaccatttttagcctgcagtattcttgaacttcaatttgttagtacaaggctatttagtttgaatgagtgatggaatgtttgttcactgttgatgcctgcaagatagaatgcctcgaatgtcttcttgctttgatcaattaaccatctgcagggaatttcgttgtttcaatcatctttggtcgacctcgagagctttctgtttccgtttcaatcatcttttcgttgtttcaatcatctttggtcgacctcgagtactacttagtagtagtggaccagtaatttctgcccctccgctctagcacaaacccaactgacgaactgatccgccggttgagagatggagcacatatgcgtttttgcgttgtgaggacatcgtgaggtacgtgtcggctgatctgctggctgagctcacgtgcatctgtatcggatcggaggcagaggttagaggtacgtgtcgattgcccgtcgtgagtacttcctctgcttgacacctggtgcactgccatggcgaggtggccatgaaacccgaatccctagctctatccacacacataaaactagtcttggattctactagtagtaggccaaaagcaacatccattataaacagtgttggatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatagacggtgtaagtgggtagactatgggtgttggtcggtgagccgcgaacccacttattttaatttataagtggatttgcggtttattttagcctacaagtggatttcacgccacttacactcgtaccataaaccaccgtaacatcttttcggttttcactgtgtgagctgctgcctcttgtggtagtatagtgttcactgttcagtgtccagagagtgataaaaaaataattaaataaagcctgaaatgtgctactatcaggcacactgtaatactgttactagcccgaactggtttgcatcaaaaatatttttaacggttttcaacttcttccatgtcactatcgatgatgcttatttattgcagttttttttcactattttttccccatatatatgtcactgtaacaaaacaaaatgatcgattgattcatcatctcggattgtaatcagctgcatcccttggcgccgaagccgatcctctggttggcaacgtcgtacgcgacggcgaacgtcttctgctgcgtgttcccgaggatggcgatggacgagtcgtcggcgttgggcgcgaacgccaggcacgcctgcgacaccttggagacgtagagcacgccggtgaagtcgaggctgacggtggcgccgccggcgaacgccagctccaccgtgggtatctgcgccgtccggtggccggtgaagtcgtagcacgtgtcgaggatggacagcgcgggcgccttcttgtactgcgccatggagcgcgcgaacgccgcgcggagcggcgcgtacgcgcgcggcgggaggcgggtgatcaccgtgccggagtcgatcaccgtgccgccggccgccgcgaacgccgtcgccgggatcctgatcgcgcggccgccgaccttgatgccgacgaggtcgatgtagtagaacgacggcgtcgcgccgtcggccagcgccgtgaactgcgcgttcgccggcggggcgccgccgagggacaggtagcccctgccgctcgacgacgacggtaggcagtaggtgaatccggggccgtagctcggcgcgccctgcgacggcagcgacaccttctccctgccgaggccgaacagcccgtcgacctggccgaacagcccggcgttctggtcgccgcacccgaagacgaagcccgggagcgtgtccgacgccgagagcgtcagcgtgtcgcgcacgaggttgccgtcggtctgcgactggtcgccgtactggacctcgtaccggcacctgctgtccgacgagcagcccgacgcgtcgagctcctggcactccggcgcgccgcacgccacggcggcgtacgtcgacgacagcgacgggtcgaacagcgggtcctgctgctcgtagcagtcggcgcagggcttgcactgcacccacgacaggtcgctgccggtgtcgaagatcacggcgtactgcttcgccggcgtcccgagcccgacggacacgacgtagttgccggtgccgagggagatgcccctttgcgccggcagcgacacgccctgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgagaaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggcaataaactaaacgtatatattttttgacaacttaaaaaaaatggtatggttaaaaatggctttaatctgaaccgccccaaagctttttactgcactgaaaattttgtgtagtgatcagtcatcagcatgccaaaagtttactcgcatcaatcagcaacagattacctgatgtaattctgatcaatactactgtaaaacatattatgtttcccttagaatatcttataaattcgatatatgctgcatatgctatcacggtagctgagtttcagtggtactaaaatttcagaataatgcagatgctacttcagtcacaatacttgtttgcaggatacagactaaccatactccaaattggcctaacagatttcttattgggtttttcaattcctcagtttgatcaaatggacgagatttatataaagcaagttcgatcgagatggttaatggccgaccaggttacattatttttccgcagtaactgcttcagtttcagatacagttgcgaaaggagacaggctgcaaaactgacactacctttcgatgcagtgcaggccgagctcggcagcagcgagctgacgctgaagacgtgccagttggggtcgttcgttctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtcaaagtcgtcctcctcgtcgtcggcggctcgtcgccgtcagccggccgcccgtgcgaaggaaaaagattaggttgttcgccacacacgctgctggctagctactagccggcgtccgatcaaggagcaccatggcattacacacacggcgacgactagcgatcgagctagtgacgaactgtcaactccaactcccaactcgatccaacttgattgcacgagcacgaacacgcgcactacggaggccctgtttagatttcaacttttttttcaaacttctaatttttttatcacatcgaactttcctacgtacgcaaattttcaacttttccatcacatcattcctatttttttaaacttctaattttagtgtggaactaaacacagactgagcgtaaattgccgtttagatcagtcgtacgtcaagtcggagccacttaaattaagtggatccccagcatcgctctaaatgtaaatgttcctatgatgtttagcaaagataaaggataagaaaaaagaattccggtcaaatttcgaattgtctggattcaccgtataagcacctgattgattagaatgcttgaattcttgcccattggaacctgaatgcgaaatgcttatattttaaaacagaaggattacgttgccatatatatatatatatatatatatatatatatatatataatttatttcaaatctagatcaatttggctacgatcgaaatgggcataggaaaatgacacctcttcccgttccgaaaggcaggcagagagaccgacctgtgtcacaaattgtgtaatatattgggtggtgaatgctgatatgttggaggttgctttcctgcctccaccacgccagaaagcaggaaatgcgtatgcatgcagtgctcgatttgctgatgcactgacaaagtgatcacaaacacagctggtgcgttgcaagcgtgtgtcattgctgcgtgagatgaaacgaaacgcgcattgctaattaagcgctgttcttgttgttcagtaatactccgtaattgtttagttggttcagtttagccctggttaggagttagttaaactatgtagttgtagtagtagtacataaacattgattcttgagaagttacagcgttgatacattgagaacatgacagaggatgagacattggcacacaaagggcaccaataagttacacacactcatatgattgatgcattccaatatgctccttagacagcatcagatttgattaattaactttgattagactcatgaacaacacatagcattttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcattgcatctggtcagtcagccgcgtgcagaaatgggcgaagaaactgtacaaagtgcatggctagctaacatttactgtcacttcatcgatcgcactgagtacgaaagacgagtagacgacgaccatcattagtgacgtccacgctaattaccctctcgagtcaaacacaggtgcaggacattagtgcggttaatatcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcataaacttgttacaaatcagcgagggttgtgtgtttacccgtgcgtgtaatctgtatagtgtggtagtgtgctgatgcttttacagatctgtgtgtttgggtgatgaattcgatgtgacatgggtgtgtgtggtttctgcaggcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcaggtataagattcagcacatttctcttgtgaattcctattacttgtgtgatatatgttgctgtccatgtgatgttttttttgtcagaactttagatgttctgtacatatgacaattggatgagttcgggcctgtatggttgagttggcatgctaccagtgtacatgatctttcttgactgttagcatgttctgaagaaatattcttgctactttaataagaggttgtcttgatgacatggtgctcattttgtagtacaataaatgaactgtatagattaggggtgtacagcagtttttggaatagtggtatcttgttctcttggttacatttactgaaaatcaacattgctgataaaccgtaattctgaactagtgatatgggtttctttggtagtaatcacttaattaaacaatagtattagttgtaacaatatatatttggtgtagtatacatcttactgttttccgttaacatgaaatgaattttgagatttactgctttcagcttgtctttctgttcttttgtgctgtagttgtgacttccttgtatgctacaataaatgaactgtatagattaggggtgtacagcagtttttggaatagtggtatcttgctctcttggttatattgactaaaaattaacaatgccgctaaactgtaattctgaactagtgatctgggtttcctcggtagtaatcacttaatgaagcaatagtattagttgtaacaatgcatatttgctgttgtatacatcttactgttttccattaatatgaaatgaattttgagatttagttgtatacatcttactgttttccattaacatgaaatgaattttgagatttactgcttttcagcttgtctctgttcttttgtgctgtagttatgacttccttgtatgctaacattgttacatagttatggtctgtctttgttgttgtattctgctaatcaatttatatactcccttcgttttgaaatgtttgacaccgttgacttttttagcacatgtttgaccgttcgtcttattcaaaaacttttgtgagatatgtaaaattatatg

SEQ ID NO: 4656 - DNA, 1116 bp, Oryza sativa
  unsure (1)..(1116): unsure at all n locations
ctgcatatgctatcacggtagctgagtttcagtggtactaaaatttcagaataatgcagatgctacttcagtcacaatacttgtttgcaggatacagactaaccatactccaaattggcctaacagatttcttattgggtttttcaattcctcagtttgatcaaatggacgagatttatataaagcaagttcgatcgagatggttaatggccgaccaggttacattatttttccgcagtaactgcttcagtttcagatacagttgcgaaaggagacaggctgcaaaactgacactacctttcgatgcagtgcaggccgagctcggcagcagcgagctgacgctgaagacgtgccagttggggtcgttcgtcctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtcaaagtcgtcctcctcgtcgtcggcggctcgtcgccgtcagccggccgcccgtgcgaaggaaaaagattaggttgttcgccacacacgctgctggctagctactagccggcgtccgatcaaggagcaccatggcattacacacacggcgacgactagcgatcgagctagtgacgaactgtcaactccaactcccaactcgatccaacttgattgcacgagcacgaacacgcgcactacggaggccctgtttagatttcaacttttttttcaaacttctaatttttttatcacatcgaactttcctacgtacgcaaattttcaacttttccatcacatcattcctatttttttaaacttctaattttagtgtggaactaaacannnnnnnnnnnnnnnnnnnnnnnnnnnnnnnnnnnnnnnnnnnnnnnnnnnnnnnn

SEQ ID NO: 4657 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnatacgtaatgaccttgttgccagaccatttgagactcaccatgctatacccagccaggtataactccctaggtcaatttaagtatagttagcaagccaaaagttctagttctcacctttcttggacaatttagtgcttaataactatttcgccccttgtgcgggttgtgtacattcacagggttatgtcatctactctgttcggagaaagttgaaaaaacagtatgctcacttgaagggtaatcaaataatgaaaatgaagcaatcaggcgctgaggtcagctagcaatctgttctatataagaaatatattctgcactgttactcactgccttcttttctgtcagattacagatactatactatatccagaagttgcctttacaggtgacacaaagtctgattttattcttgacccacgaaatgcagatgccctgagagcaaaagtccttataactgaggtattggctttagattttagtttccttgattattgccctttctcccaagcctgtcaaaagtatttgttccagctgtatgtaatcagtcacatttagagatgtaatcattctcatgggacatgtcaaagtcagcaaaaagggtgtgaagtataatactccctccatcccataatataaggcgcgcacgaatttcaagattcaannnnnnnnnnnnnnnnnnnnnnnnnnnnnnnnnnnnnnnnnnnnnn

SEQ ID NO: 4658 - DNA, 365 bp, Oryza sativa
  unsure (1)..(365): unsure at all n locations
nnnnnnnnnnnnnnnnnnnnnnnnnnnnnnnnnnnnnttttaatgcacattctgcttgaaattctattcgggaatttctgggcgtgacactccctgcctccactccttggcttcttgttcaaaaggcagagccgctgacgccgctgcagcgcctcgccgcccccaccttgaccgcacccgctcgccccgcgccaatcctcccgtgctcgcggttcgatttccaccacacgatccaccgcctccaccaccctttgcatcctcgccgtagctcgttctcgcggcgcccatgaacaccagccgagcgccgagaaaaccgcggccaacctcgaaccgaccttgccgctcccactccgtctctataaacc

SEQ ID NO: 4659 - DNA, 688 bp, Oryza sativa
ggtcgccacccctcgccgcctctatgatcgccatgcagatctgaagggacttggaggggtcggcgccatcatcgtacttctcggtgaggtagggctggagctttgggggccctcggacattccgaagactcgccacaaagacctggtagccaagcttacccggtggggatgtggggggccttgccccctgcctggggtggcgcgacactccagaggatgctgcgccttcccccgtagcggcggtgtgacactcaccacgccggcgctcgaaaaaacctcaaaaatcacgaacgcgccccctacctggcgcgccagatgtcggagaatgaactcctccaccagggaaccgtgaggcccccctttgtgagttcggccgggggcagcgggtgagattcgagggcttggtgagcggagctgtgtgatcttgagggggttaggcccctccaagacgatgagataaaagaggtttatacaggttcgggccgctatgaggcgtaataccctactcctgtgcatgattgattgaatgtagaacaccagtgcttggggttatgagacccaaacgccagttcgctcggaagtcccccctccaccactaggcctggacctccttttatacctcaaggggttaccatatgggcccaacaacctaacctagctccggtggataagtattataatctttgca

SEQ ID NO: 4660 - DNA, 356 bp, Oryza sativa
  unsure (1)..(356): unsure at all n locations
cgaattcgagctcggtacccttccgtaaaatcgagatctatttaatggcactattatttagtctaaatagggtctttttcttggtctcttgtttaggtttttgtctgtttgcgcatagttgcggttaccggattttcgtcgatcgtggatatcttgaagattcatgaagcttcgtgaagaccctgagcaaggcaagccacccttgaacatattgagcctatatttgaacttaattatattgcttgcaaaatattatgcattgataggattacacttaatttgtttgccccgtctgaaaggcannnnnnnnnnnnnnnnnnnnnnnnnnnnnnnnnnnnnnnnnnnnnnnnnnnnng

SEQ ID NO: 4661 - DNA, 174 bp, Oryza sativa
catactgtcaagagcaagctcgatgctccaaccgagctattcatgcacattgcccccgacaaggctagcaacaccctgttgatcatagacagcggagagagcatgaccaagcactacctcacaaagaacctgcggaccatcgtcaggatcgtgaccaaggagatcatggaagcg

SEQ ID NO: 4662 - DNA, 692 bp, Oryza sativa
cgaagaacttttccttcatttattgttgtaaaaccaagcacttacgcaaagcttatgttagcatgtgaatatagtacgtgcagttgcagttgagccaaatagtactcccttcgtcccataatataagggattttgagtttttacttatactgtttgaccatttaactcatttaaaaaattttaaaattattatttattttttttgacttactttattatccaaagtattttaagcataacttttcgtttttcatatttacacaaattttttaaataagacaagtggttaaatattgtaagcaaaaacttaaaaactcttatattgtggtgacggagggagtaattggcaagctaactttggtccgtagctcaaatcaggtttggcaacttcatcactttgaggaaaggcgtccggcagaagcaggcaagcagcagcatcagcagcaagttggtcgagatagaggataccatgaaatgaaacagcatgtgccaagcccactttaccacaccgatggtccttactccttaaacttgtgccgatttgtggttggtctgccgacagacatcacctcgatcggccactggtttctctcgatttaaagaaggttctatgatgcccatgtactctcatcatgtgaggcccataccgtgaccaacgaataggacttctacggccccatctttatgtatgc

SEQ ID NO: 4663 - DNA, 1334 bp, Oryza sativa
caaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctgggcttgtagtatagctttcctctagtcgacgcatccaggcaagggtgggcgtgatggagcggggcgggccctgcgacggcctctgtcgcttccggattcacctaggcacgagagggggctgcccgttgcccgctggggacgggggtgaaacctgaggtgtggtgtgcttggctagagggggttatgcgaagggtcctgtcacggcctctttctgatatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttaaaattggatagtttaggtggatggttgggcctgtcgcaacgtgggttagcgttggacagtggatagttgatattgtttaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctatttttcccaaccccagagtttgagtatgtgtcagatggaggtgtctctgaggagtaggcttcgtccgtgccgtcgaggatgcctgtggagtggtgttcccactgcagttctagtcaaggcttagctcctgttgtctttcgtttttctgctgcatttatgtaagacttttatgatgtttgtaagacgtggatctgaatgtcaacattgtcgtttgtgtaccccggctggtcctggacgggattttaatgcacattctgcttgaaattctattcgggaatttctgggcgtgacaagttggtatcagagccaggttgaccgtaggacaagccaaatggaaaaacctaagagcc

SEQ ID NO: 4664 - DNA, 456 bp, Oryza sativa
  unsure (1)..(456): unsure at all n locations
tcagaatgcttcttcaccagatccttgaggcgacgctcctcaaggtattccagctgcaagcaaaaattgcagttgtttattaaacaacaaacagcaagagaacacaagagacaagaaacaaaacaaacaatacaagtatttatttcaacaaggtgttatgctgctatgcattctgataagaacattgggacaaacgatatactccctccgtttcgaaatgtttgacgccgttgactttttagcacatgtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4665 - DNA, 623 bp, Oryza sativa
  unsure (1)..(623): unsure at all n locations
nnnnnnnnnnnnnnnnnnnnnnnnnnnnnnnnnnnnnnatatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcaacagtacaagtacgccttctccggcttcgccgcgcggctgtcaacggcggaggccgccgcgctccgacggaagcccggcgtcgtctccgtcttcgccgaccctgtctaccacctccacaccaccaggtcatgggacttccttcagcagcagacgacggccgncgtcgacgt

SEQ ID NO: 4666 - DNA, 694 bp, Oryza sativa
  unsure (1)..(694): unsure at all n locations
cgggtcgaacagcgggtcatgctgctcgtagcagtcggcgcagggcttgcactgcacccacgacaggtcgctgccggttcgaagatcacggggtactgcttcgccggcgtcccgagcccgacggacacgacgtagttgccggtgccgagggagatgcccttttgcgccggcagcgacacgccttgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgaggaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggcaataaactaaacgtatatattttttgacaacttaaaaaaaatggtatggttaaaaatggctttaatttgaaccgccccaaagnnnnnnnnnnnnnnnnnnnnnnnnnnnnnnnnnnnnnnnnnnnnn

SEQ ID NO: 4667 - DNA, 939 bp, Oryza sativa
  unsure (1)..(939): unsure at all n locations
tatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctaggatcagacaggcgagcgtcaattgttcgggacagaggtattagcgaaagcggaagagaaagtcagaatcatcagggaaaggttgaggattgcccagtctcgacagaagagctacgcggataaccgttgaagggagctcacttttgaggcaggggattacgtgtatcttcgtgtcactccgctccggggagtacaccgctttcagacgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaagcaacctgggaaagggaagatgagttaaaagccgcccatccgcacctcttcaaaagaacctccgaatctcggggccgagatnnnnnnnnnnnnnnnnnnnnnnnnnnnnnnnnnnnnnnnnnnnnnnnnnnnnnnn

SEQ ID NO: 4668 - DNA, 1287 bp, Oryza sativa
ccccccctccctgctgggccggctgcaagccgaggcccaaccaggccgcccgccgccctcctttcccggggtcgccgacaggtggggcccacctgtcgggtccttcccccacctccggccgacgccgcgccagcaaccgccgcgcccgaaaccgccgccgcgtacacgcctccgcctcctccgggccacgtcgaccacgcccgcgcgtgcgccgcgttccccgcacccactcccctctctctcccgctcgcgcccgcgcccgagatggccgggattcgattttcgaatcccgcctctctcgcctcccccactcccccacgtcggccggcgattcccgcctctcccggccacgtccggccctctgtctccctatttaagctcccccgtcgctccctctcgctttttccccatttcgcctccctctcccgagctccccatcgctcccgcgccgtgcgcccatccgccgccgcagtttccgctactccggtcgcctctagccgccgctacactcgccgccgcaccgtgccgtcgccgccgttgggttcgcgcggccgaggtccacctcgtccacccctcctccgtagagattcgccgccggagcccaattgatgacgtcagccctggaatatattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgatgctccggtgtacttctgtttataaatgctcgctttatgcaaatgaaccacttcagctcttctttgatgattccctgcatcatacccctattccggtatgacttgctgagtacagtgggtagtactcagtcttgctctatttttcccaaccccagagttcgagtatgtgtcagatggaggtgtctctgaggagtaggcttcgtccgtgccgtcgaggatgcctgtggagtggtgttcccactgcagttctagtcaaggcttagctcctgttgtctttcgtttttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgaca

SEQ ID NO: 4669 - DNA, 3552 bp, Oryza sativa
  unsure (1)..(3552): unsure at all n locations
gtttccccccccccccccaagcggcggagccctgccgccatgggaactcctcgccgtcgcgtcgagctctatgtccggcgacatctcgccgtccacggtccgtcctctgccgccttctccctcaacctcggtcgccgtcgcgcggccaaccccggagcatcgccgccttcttggtcgccgcggccaagaacgccaccgccgcgaccaagggcgccaccgcacgcctccgttcccttccccggcacgcccgccgtgacgcgacgcgcctcggcatcgcgttcgtcgccgtgcgccgctgctcgtccatgcgccgccatcggccttcccatcctcaactcgccgccgacgccattacctcccgtcggtgagctccccacctcccttttttcgctgtcccagcactcgcgtagctcgcgtcgcgcgtgctctgtttccgctgccgtgcgcaatcgagagccgccgttggcctccctctcggcgactcctctagccaccgccgttcttgagttccctctctacctccccaagccgctgtttcagccgccggcctcccctctcgccctcgcgtcgcgtcgcccgatccgccgctgccgcgctcggccacttccgctgtgcctcccctgccgtcggcctccctcctctccttgattcccggcgccgccaccttcctcgggcccccctcgacctccccaacccctccccctggccgccgaccttccctcctcgctcccgcgccgtgccgcccctcccgccgccgcaaggcgccgccgcgagccacagcccggcgaccatcgggtcccgcgtcaccgcgtgtgcgccgcaaccccataccgcgtccactgagcccgagcgcgcgagccgcatcccttcccatcgcgcatccacgtcggcatcccggcgagcttcgccgccgccgccggccgtcgtcacgcgtcgtctccccaatccgagccgtggaatcggttcgccttgacctcctctagccaccggtgttcgtcactcgcttcggctcgccgaagttcgccggattccgccgcgcgccgtgagccgtccgatgccattcccgcccctcccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaagtccgcaattgctccctccaattgctcctctctctctctctcaccttcttattggccccactcgtcaatgagtcaaagataatcttgagaatgtctttccaatattccacaaatatttctctcttctataaattcagtaaatcattttatcttattccgtgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcggtccaatcgtccgattgaccccgttctacttccagtatttccgtaaaatcgagatctatttaatggcactattatttagtctaaatagggtctttttcttggtctcttgtttaggtttttgtctgtttgcgcatagttgcggttaccggattttcgtcgatcgtggatatcttgaagattcatgaagcttcgtgaagaccctgagcaaggcaagccacccttgaacatattgagcctatatttgaacttaattatattgcttgcaaaatattatgcattgataggattacacttaatttgtttgccccgtctgaaaggcagaccggtgggtctacccaacttgttgcatctgatccttccattgttaattgttatatcatgttcccttgtaaccatctagttgcgcctcgatattcgtgcactctgtgcgagtatcgacggttgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgatcacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcccttaggtcaccagacgtggccgttctacacgggctgggtgattcgggttagtaatgtcgtgtgggtaaagtgtaccccctctgcagaggttaacaaactgttcgaatagccgtgcccacggtcatgggcggatgtgaggtgattccttagcatagtttttgttttaccctgttttatgaaaaggtgttaaggtttgggaaacctaatgcttgggaagcatttagctgtccgggggacagtgggaccgggtgtccctggaagtgattggtcgtttggggaccactattatcgggaagtttggaaaattggtttggtttgggaaaaaccagatttgaagccaactctgggagttgtgcaaatcttgataaataaatttgttacttctcacctcccgaccaagctgagacttgtctcgctctggttgtggaaagcacacacttagattgttgaaaacttgaaaacaaaattgtttgcaaataacagccttcccttgaagcctgcattaaccacctaagtttccctggcttgctgagtacgaaagtactcacccttgctctatataaatatatatatatagttcctccgtcttgaagaaaagatgaagtgaagcgaagattagggtttcgtcctggttcccagccgtcgcctgtggtgttgggtgttagttcgttggttctgctactgctgctgctgctgttggtgtttcctcgtccgcgtcgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagnnnnnnnnnnnnnnnnnnnnnnnnnnnnnnnnnnnnnnnnnnnnnnnnnnnnnnn

SEQ ID NO: 4670 - DNA, 1463 bp, Oryza sativa
  unsure (1)..(1463): unsure at all n locations
nnnnnnnnnnnnnnnnnnnnnnnnnnnnnnnnnnnnnnnnnncgtcggttgtattctcaggctgttctgagctacaacctaagttaaggtaaataagtcctctatttattttaaggattgctatgattcatatttgtcacagtgggtaccagcactatgtcctaggactggtaccgagatcgcggtttcgtaggaagcggttcgcgccgttttccctacgacacgctcctgtcaggtgccgttgtacggcggtaccagattggggtgtgacagttagccttccagtggttcgtaggcgccgttccaagccccgccaccgctcgccatggccttgccgccgtcggcgcccgctcccggaggccgcctctcgtcgccggaccttcacggcgcctccccaccccatccgaacccagaaacgaaacccttgagccccggagatgctcccatccctttgaatcgaaccctcgtcgtctcgtcgtcgtttccccctttgctcgccgccggttgccgccaccgcgattcgccgtcgccggctaccctccggcaaatctgagccgttggctcactctctcttgtcctccttgtcgttccaatgtgctccccgttgccctcgccgtcgcatggtgtcccggtgaaactgccgccgtccgccgtccatctcggcctccccttcttcctcctcccgccggcccgcgtggctgccacgtaggcgccacgtcggcgccacctcggctttgaccgaaccgagccagtcagccgcctcctccctcccccaccctcgcgcgcgcggtccacagtgcgccaaccggctgcgcgtgggcccgccgcatctctggtccatccggtgcacgcgcgtgaaccgcgctcacccgaaaccctagtgccaccctcatgcgccgctcccacggtgagccgcgccactgacaagcgggccccactcgggaccccgcaaggtggactcagcccaccggccctctctctcccccactctccccgcgcctccttgggccgcctctccgggccggccggcccattagttcggccgagccgtgcctctcctctcgggccgcacccaagccgcccgaggaagtctaaatcatatccctccaatttctttccaaaaagggtttaataaattattaaatcctttttcctttagacagaaattccttaatccttagagaatccatatcttctcaaccgctcctccgattgactccgttccacttctaataattccgtaaaattgagatctatttaatggcactattatttagcctaaatagggtctttttcttggtcttttgtctaggttttcgattgtttgcgtatagttgcggttaccggatttccgccaatcgcaggttttctcaaagattcgtgnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4671 - DNA, 727 bp, Oryza sativa
ccccctggaattaaaatattgcttgctcaattttaattcgttaaagttatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaatcgggtgaccttgtttctggttctcctttcactggtatcaagtatgcgaaccggcttctccacgtatgttaggtcctcctggatatcaatgtgttccgaatcagcctgttcttcaggtacccttaagcacttctttaattgggacacgtggaacacgtcatggatgccgatcatattggatggaagttctagctgataagcaactttcccccttcgttccaggattttgtatggccccacgaagcgtggtgccaacttgcctttcgtctgaaagcggtgtacttcccggagcggagtgacacgaagatacacgtaatcccctgcctcaaaagtgagctcc

SEQ ID NO: 4672 - DNA, 1842 bp, Oryza sativa
  unsure (1)..(1842): unsure at all n locations
nnnnnnnnnnnnnnnnnnnnnnnnnnnnnnnnnnnnnnnnnnnnnnnnnnnnnnnattctgactttctcttccgctttcgctaatacctctgtcccgaacaattgacgctcgcctgtctgatcctagaagagaggtgtgcggcacttccggccgtataaagcttcaaacggtgccatctgtagactggcctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcaactctgctatttcagaatcgtttacttgagctgctttgacttgatccacaagcgtaggccatgccttcagagcggccacaaacccgtgttcaacaattcccacgttgagatgctcaaactcctgccgcaattcctcacacataccctcgatgcacagggcagtgcagtaacttttccggcttaaagcgtctgccaccacattggctttacccgggtggtagtgaatacccatgtcatagtctttgattagttccaaccatcttcgttgtcggaggtttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccactctgccctcttgcattaggacacatccaagtccgtgacgggatgcatcacaatagacttggaagtctttcatctggtcgggtagaatcaaaactggtgcggatactaatttctttttgagctcctcaaaactcttatcgcactcagctgtccatttaaacttctcatctttcttaagcaactgagtcatgggtcgggcgattctggagaagttttcgatgaatcggcggtaataacctgcaagtccaagaaaacttcgaatctgcgacacggtcttcggcggggtccatttggtaaccgactccacgttcgatggatcaactgccacaccctgagctgtaatgacatggcccagaaatttgacttccgtcgaccagaagtcacacttgctgaacttggcgtatagctggtgctccttcaacttctcgagtactagacggagatgttgttcatg

SEQ ID NO: 4673 - DNA, 2776 bp, Oryza sativa
ttcttcttcggactttgaatagataagaatgtcgtcgatgaacaccacaacaaacttgtccaaaaattccatgaacactttgttcatcagattcatgaagaatgcgggtgcgttggtaagtccgaacgacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgtttttggttgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctcggctaattcgttggccgccattctgtacggtctcttgtaaattggagcggttcccggtgccaagtcaatccggaattcaatctctcgcttgggtggcatggtagtgaggtcttcggggaacacttccggatactcgcagactatgggtatatcttccaatttcctcaaactcttctccacggtgtccactgggatttccgcttcaatctgattcaaagagacctcttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcattggtgtgctaagttcctctcttattaacccatgcatcccgacaaatttctttgaaatgaaagaatgcgttgcaccagaatcaaaaagtactgttgcagggattgagttaacagggaacatacccagtacgacctctggtgctgcttgtgcctcctccgcagatgcgtggttgacacgagcctggataaaccttggctcggcacgcctaggcttcgggcatttgtcagcgaagtggccaagctcgccacagttgaagcaggaccctggttttgctccagtctccttcttggcttgcgcgggcgggcctgactgtgccggtgccattggtgggcgtggagctgcaccgcggtttgactgacctctatggtgggtctgactgccaccggcgccctggggaaagttgctagggttgaacgggcggtactgacggacgatcatggtggtaggtccaccctgctgcccaggagcgaagcgcggcctctggtgacttccctgaggtaccctgaactgagcggccttcctcttcctgtccatcttgttgcgttgatcctcctgacggattgccttgtcaaccagcctctcgaaatcggcgtaatctccagatatcaactggttggttagctcgtcatccagacctgccatgaacttttcctgcttctcggcgtcggtacggacatcctctggtgcatatcgcgcgaggcgattgaactcatggaggtactccgtcacagtcctgttgccctgatgaagtgcccgaaattccctcttcttttgtgccacgaccccgtctagcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcagcatcctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgctgttgctggcctcgcctgttgcgcggctaccattcctggtgtagaccatctggagggaaaagcagacgggggaaaagaagaaaaacagatgctcaggaactaagctttattacataggaatttaaactgcaattgttctgatctgattaaaacacttaaagagcaagcaaaaatctcttattaagacagccatatcataggcacatgatattgaccgtcgactaaccccaaacaagcaacctaaacacacaaactaacaagcagaagctagacagtcggtaaactaatggaaaacgagcctaatgctcggaacggctcctgcggtcggtggaatcgaaggcgtcctcctgctcgtcaccaggtccctctgagcgacttccggaccctggcagataagtctcgccgctgcccgactctgagccactggagctgctgctgctgagatcgcggctgccactgggagtagcagacaaccaacctccgttgcctctggctgggcccctggcggctgatgctggagcgaaagaaagagcggacgcgggagctggagctggagttgcaagaactgcgggcggaac

SEQ ID NO: 4674 - DNA, 1443 bp, Oryza sativa
tcagagcgccgatcctcatgagcttcccatcattcaaggccttggtcgccttgtacaggtcagagtgcatcctatccaatcccctcatcacagcacacatgtgaccaaaggtggtgtcgttctcgccggctgtcggacggaaagtactgacatcatcactgctggctcgacgagggtgaaaccagtacgccgtgtcgtggaagatgtagttgtggcgctcccgtagtctggccatcatcaggtatgctgcctcctgacaggcgtgatctgctgtgcctccagatgcctccaccaccatgttagctaggcaggtacccacgtagccgtggacctccagacgaacacggtgaggaagctcgccactgagcggtggaatcgtcgtgtactctggcgcgttggggtagcctaccaccagcgtcatacatgccaactctgccacaaagtcgatcatgccttctccgcggtggttgggtgggtggccggccatctagggaagacaaaggagtaggatcaatgcatgctcaatccaaatttaaataaagcaataaaagactcaaataagggaatcgaataagagcgaaatttttatgcatagatcattttacatgagagcgaataaataagacggactcacataacgataaaataatgagaaattagatacatactaataataacaaataaagcataaataccttgcaacccatgttcctgagctatgacctaatgcatttcacccatcagatcccaactgactgacgaataaatctcaacagttttactaaaaccctggactgacttgttttgaaaaaaaatctcacttaaacgagcgaccaagatttttttccttgaaccacaagaacagatcccaattttcccggaataaaatccaattgcaaagaacatatgcaatgaaaaggattcagagggctcttaggtttttccatttggcttgtcctacggtcaacctggctctgataccaacttgtcacgcccagaaattcccgaatagaatttcaagcagaatgtgcattaaaatcccgtccaggaccagccggggtacacaaacgacaatgttgacattcagatccacgtcttacaaacatcataaaagtcttacataaatgcagcagaaaaacgaaagacaacaggagctaagccttgactagaactgcagtgggaacaccactccacaggcatcctcgacggcacggacgaagcctactcctcagagacacctccatctgacacatactcaaactctggggttgggaaaaatagagcaagactgagtactacccactgtactcagcaagtcataccggaataggggtatgatgcagggaatcatcaaagaagagctgaagtggttcatttgcataaagcgagcatttataaccagagttgaaagaattaaaacaggtgttattatttaaacaatat

SEQ ID NO: 4675 - DNA, 6134 bp, Oryza sativa
ccctgcaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacagggagctcgctacccgggaggggaaaaagcgaaaggaggaggaggaaagggagctttgctccttccggtttgggaggaaagggatgagaacgagccgcgcctcacggttttggatgcatgcggcatggggcgccgggcccgagaggatgacgccggcgatgactgcaaaaggacggggacggtttgaaggcaagcgcggacacggtggtcgtcggggcaggcgacgaccgagggtggcgatggcggcacccaggcggtcggccactcgcacgggcgcgcgggaatcgaaggaggcggccggaattttgggcggtgtcggcgggaagcgacgccgagagagagagagagagagggcgctctctgagggagtcacgtgcggcacacgtgcgatggagaggctggcgaaagaagaggatgggccgaggatggtttcggcccgagcgagttggagggaggcaaaatagacttttactggaaggtttgatttggagagaagtttgatgtggagattgaatttgaattcaatttgtgtatttgtacacgagggttcaaggtggatccaagggaggggtcaagaaagggcttcaaaagcgggaattttggtatttttgggatggatttatatttggcggcacgaaggattatttcagaggatttcaaaaatggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagaggtggatcggaaaaagaaagaaggaatccaacctatgagggaggttaaatagactttcacagagagatttaattgggaggttttagagttggagtctagattcgaatttcggggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcaagattatttcggaacggaaatcattttggggagaactcaaggcgaaggggattgaatcttgggatttagagttcaagggtggaagtgatctcgatttgcatattcagacttgggtcagaagttcgagaaagaaaacagggtagattgatgaaccaatacagagagaaagatagatgaatcaaaacctaagaggttgaattcgaatttgagaatcggtttgaaggaaccaaggagagagtttatgacgcgaaggtgaatccttggacggagttagggttcgggcattcgacaaagttcacggatggggttccaggaggggattccgaatagaaggaatcgagcttcgggactacattgggatggaaattttgaggagacgatctttgataacagggtatcgagacaagggagggatttaaattgagatctttggcacaacttagactcaacactcaaggaatgaaattttcgcaattaggatttttgccgaattagtttttaacgtctcacgaaaagcggagcgttacactaactgagctaccacgcgagttaaaggaggaggagggcgagcgaggaagaggaacggagggctatcgcttcgggacagggcgccgtgacgagcgacggcggcgcgggagcaagctctccgggagcggccgggaaaggggaagaagaggtgcccggagctcctcgtcacacgtccatgcacgcaccggcctccctggtgcttggcgacgaacggcgacggtgcgagccgagcagggcgacaaggcgcggcaggcgaagacgagagggatagagaggaggaggagcttggcttgggttttataggcacgggaagtcggttttgggggaggaaaccgacttaggtggtcaagggagctcggctggcagtcgtgctcggagctagcggccaagcggcggcagtggaggtggtcacgggtggccgggctgagagggaaaaagcaaaaaggggagaggaaaggagctcggctccttgccgatttgggcgagcagagggaggagggagagcgcatgagagaggggagccgaggctctgccttcacgtcttggacgcacgcgcgcacaggtggagcgagtggcagggcggcatgggctgctgcgcggcgcaggcagccagggctaacgtgcgggcgaccgagcagtcggccacgcgcgggcgagcgcgtgcgcaacgcgagggcgcggcgaaattcgaaaaggcagcagcggaaatcggccccgaggggagttcgtcgggagagagagagaaccagagagagagggagagggagagagggtggggacagggagggagaggagctctgcctccattgtttggaaggacgcgacttgaaccagcggacagggggtgacgccggtggtgaccacggaggtctctgcctcccggttttggatgctagcggcgtgcagcggcagagcggcagcgcgcgaaattggtccatccaaaatagagggatgcaaaatagacttcttccaagaaattgatttggagaagatttgaacatggaatttgactcggacttctggattgggatctggatgagaggaagggtctaggaaatgatcaaaaggggaaattttggatattttgggggtcgggcgaaaatttggtgaggatttcaaagagaggacttgaattttggaatttgatttggagacttgaatcggaattggaatctcgaggtgggcgattttgatggcgacgagagggaacaacgatggagattgaattgagatccatggcacgacttaaactcacactcaaagaacgaaattttcgcaattaggattttgccgaattagtttttaacgtctcacgaaaagcggagcgttacatctgcacccttgaatcgagcagggtgagaacgatatcatgcaggaatccggaaaactcaaatcataccttaatgggaaatcctctcatttttgcatgtcacttaaaaagtcatcaaaaaatttgaaaagatttgataggatagaccaatatgtgatatgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagccgtacagatgccgtattgcggttaggaaaaagaaagaaacaaaagcgaaaaacgggagtcgagaaggtgtgcggcgccggcgtggttgtgattgacgctccgaggcgtcgtctcgcttccagtagcccagacggcgcgccgttttcatgggccttagaccttccacgacttgctcataggtcacgggtgatgcacgaatttaggccgaggggtttcccatgtgatgaaaatagggggggtaagtactaaagctaaaaattggaccaggtgcctgagaacccccttcgtctattgggctccgcacctacggccacggcctcgtcgtcaacagctgggagccccagccgagcatcctccgccgccgtgttcgtgacacactgcgggtggaactcggtactggaagggatcaccgcgggcgtgccgatgctctgctggccgctgtacgcggaacagaggatgaacaaggtgctcatgggtggaggagatgggcgtcggcgtggagatggagggatggctggaagggcgtgtcaccgccggcgaggtggaggcgaaggtgaggctggtcatggagtccgagcaaggaaggaagctgagagaccgcgtcgaggcgcacagggaagccacggccatggcctggaaagacggcggctcgtcgcgcgccgcgttcgcgcagctgctgtccgacattgacgacgcccgtggcaagcagagtagtgtcagcgtttagctccactttagaacacgaaaataatttcacaattcccactgaaatcatgtttgtagtactcgaaatcgtttcatcgaaacgttgattttattgctgacaccaaataattcagatcaaacaaaattttccatcccggattacatagctgaaaggctgaaatgccatttcagcaagaggacagtacgcacttgattagtatacactctgtaaatactacaaaaatctctcgatacacctgcaaatctgtaggcagaatctctgacgcctggcgatggcgatggcgatgatcaggcagctttggcgagctccctctcgacggccctcttgaggaagctgccttcctcgacgaccatctgaacggggaggaagccgaggccgctggcgacggcgagcatcacctccttcatctcggcgcggaactcctcacggtcgacggcgccgtcgccgtcgcggtcgaaccgggcgaacaggccgcggtacaggtcgacgagctcggcgtccgtggcggcggcgccgtcgacgccgaagtgggtctccagcacgcggaggctcatcagctcaccggccatgtcggcgtaggacagcctgccgtcccggtcgccgtccagcgccgcgaaccggtcgtccaccgtcgagttgaaggccccctcgtcctccacgaagctctccaccgtcctcccatccaaaatctccacgctcatctcgcccgatcgaattcttggctagctctcagctggttcaggtgttgtaggtgtttgacgagatgtgagaacgagttgccgctatttatactgtcgaatccgcgtgtctacaacgcgttaattaatcagattattgcgcatggtttttggcctggtaatatgctgtgggatgtgccaatgttgacgagttgtttttcgccaagtgaagaaatgctaaacgtaagcaaagttcttgttcgcctcgagggagatacgctagctgttgtataaagaaaaggagaggaagcccatggattcgggccggtttaggcaggttgcagatcatatgacagtgacagtgagttggaatatcattgacaggacgcggcgaatctgcgccttgctctgtgcgtggttaaattaaacatagcattgctgcagaggcagaagaagcgaagaacttttccttcatttattgttgtaaaaccaagcacttacgcaaagcttatgttagcatgtgaatatagtacgtgcagttgcagttgagccaaatagtactcccttcgtcccataatataagggattttgagtttttacttatactgtttgaccatttaactcatttaaaaaattttaaaattattatttattttttttgacttactttattatccaaagtattttaagcataacttttcgtttttcaaatttacacaaattttttaaataagacaagggg

SEQ ID NO: 4676 - DNA, 3068 bp, Oryza sativa
  unsure (1)..(3068): unsure at all n locations
nnnnnnnnnnnnnnnnnnnnnnnnnnnnnnnnnnnnnnnnnnnnnnnnnnnnnnncaaatcaggtttggcaacttcatcactttgaggaaaggcgtccggcagaagcaggcaagcagcagcatcagcagcaagttggtcgagatagaggataccatgaaatgaaacagcatgtgccaagcccactttaccacaccgatggtccttactccttaaacttgtgccgatttgtggttggtctgccgacagacatcacctcgatcggccactggtttctctcgatttcaagaagtttctatgatgcccatgtactctcatcatgtgaggcccatacggtgaccaacgaataggactcctacggccccatcttttatgtatgcttatgtttaattattaaccaaaatttaaattttaatattaaatttaaagctgattttgagatttttttttcatcgaagtttatttttcagcctttacttttaggtcgttaagaacacgtaggtaaaagttttattcacaaattatttatcgttttgggtttgtttgtgggtcccgataggatgtgcttttggcataaaattacaatttgtcaattcaaaagcatacatattcagttaaaaattgtttcaagttgacttttatatttaaaatattcggtttaaattttggtccccaaaattgtttgcattaaaccatgccaatgaatgaaatgtctaccacgcatcttgtttttttttggcacagtttgcccctaaaacaatttcgccctaaaagtgtgcgtagggtagtttagacgccacaatagaaagttcatagaatatatttttttctttttgaaattgttttaaaattcttctaaaattcattagcaaagtgcatatatcaaataattttgggatggtttggttttaagcctaaatttggcttaccaatatttggcaatttcaatagtgtttagtgtctatttggtttaaagccaaattttggcatgcctaagaaaatatgccattttaatagttaacttaggctattttggcttcaatccaaatacaactttaccttctcaaaattagtcataccaaaacttaccaaaaattggtaaggccaatttaggccacaaaccaaaccagccctttatacataaagttttaatgtataaaatttatgcaaaaattagtagtgtacgtgttaggctagtataaacccactcaaattccatgggccaacgggcctcctaagggaaagggaaaacgggcaggaaacaaatgggccacgaaagtttatgcacgtgggctgtattggaaatttggaatgcatttgcgtaggcctcggacacggcctactaaatagaactggactgcaaaagcccatgtccccaaagcccaaaaatctgtgagcccaatagcctgcttccttgatgctctgaagtctgaattgacaggcatggcatgccttgcaagagaaagaaaattgctttcgatttgcctttttctttgcgtggatggatgcattgtttgaacgatggcggcagatgtggatgtttgtccagcaaagcgtgtgcttcgtgacaaccatttctccccgttctacgtcaatcctctccttttcccgtgttcattttccggtggttatcgtgtcattagtccacaataattgcattccagggacatctcctgccatgctgaagaataaggcatcgtcatctgcatgcaggaatggaaacacatagtattagttttttttattttttctggtcttggattcattaaacaaagctatcaaatgcaatgcttttcttcggtgtgatgggaaggaatcatgtttcatgtggacaaacatccctgctacgaaaatgcagagtcgattatttaggagatgtagtaattgtttagtgatttgtttccttctgatggccgtaatgtgacctgaatatgatgttaaagattttggggatagtcaaaaagagaaagaaggttacatgcgaagttctcagggattgcatcaccctacagtttaagggggtaggttaactagaagtgatccataagggcagcaaccacttaaaacaactgttctattcaagttcattagagaagtcagaggtagtgaaaggagaaggtgactttatgctactgagtagtgagtactagtataatcttgaagtaggcattgattgtttaatattaaggagtagtgcattgcttactgcagttctagaagaaacaaaaacaagggctctgttcttggcagaatgactttaaatggaagaaatagtatattttaaccaatgttcacgtttcttggaaaggagaaaaacaagttgaaaattggattggtttcattaattataacctgctggcctccaaggaattttatttccacaatgtgatatattaattaagaaagctcaatatagcttgatatgcacaaaagatatgatattgttgaaatgtattggagatagtctgtacacaaagttatatttttttatataggaataaaaatcattctgtcggtagtaatttttaactgagtcatcgatatagatatgaaaattccaatatgctgtcagatccgtcgattttgtagtcaatggattttaaggatctcacttgattggaaatgacgaagcggtacgaaatctattttttcttaaagcctaattggcaatgacagctcatgaaatgagttttcatttctcggatgattaacgagttgttacctaccgctgaacaattattattctacatttgatgcaagggaagatgcttaatcccaccagatacaagctgcatcaggccatcacacgagtcaagtggtcatctcaccgacactacaaaatcagctcaaatagctcattcggttatgatttccaattattcgaatccaatttttatatactatgttcagtatattttattatccttgctgcttttttttttgggggggggggggggttcacaagaaagaagtacacaattaatctccccaattctctatgaaaattaaaagtgtacaatatttaatttgtcgccgggcattttctgtttaatctgcaacaaaagctgcc

SEQ ID NO: 4677 - DNA, 6634 bp, Oryza sativa
gagaaatagcccttgataatcaacttctatactatactcatcagtgtcttctgaagtttgcagtacatggtctgagctccagcaaagagtgattccctttcactgcagatagtacttcaaattggaatttctgtgctctgacctttgaggacacacccttacttctcagtacattgtgcaatcttctttgtcctgcatgcatctgtacttgcaaaatatgctaaaatatttttgtttgtctaatggatctaggtgccagacagtgaatagaaaaattacattagtcatcttacagttttgaacaagaacaattaaaaaatgccaaagcctgcaagttggttttgagaagtcagatttgcgagaaatacaacactgcacaattacaagttggactttacattaaaactagtatcttggccagacagtacacactccagggaaaaaaaagagtgcgaaaaatacacgtttgcgccatttgttcccatattacatacaccaagaaaaggcaaaacattacaaacatcaaatgtgaagaggaatttatcagtaaatgtgagataaatgctaccctatttctctcaaataaatcgaaacaaacagaatggaaattatcgtgtacacttatgtatcggtgatccgtacacgatatgcacgaggtacaaaaacttaaaacgaattctacaagcacttaataatggtactaacactaaacaagcagtgcaatttactcaagaacagggagggaagaaagctaggacagaaagaaaagggcagctaatacctggccagctttcattatgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcaggtttgcagaatctgaattctcccctgcatttgcaatgcaatttggagttgttgttaccttttgcaaatttcatagtttcatctcattgagtcattgtggttaatagcttggggctacttattgttgaatgtacttttatgcttatggtatattttgatctttttcatatgtaattcttgaatgatcttgagaaaataagattttttttagcacatgagggtatctctttttctttaagtcgaagcgaagattgttgtgtatgcttggtgtagactcttgaatgttcagctttggtagttggtccttctctttttgtctttgtgctgtgctgagatctaaaagacataagtatcttttttgttgttgaagcaaccagtttatcatgtgtcctgattttggtaggtgacactatcagactactactataatgtgaccacctaaactagatctaatgatcgtgatgtcactaagcagttcagttcaaatacagatagatctcagccaaaaaacaaacaaacattttggtttttatgatcaagaaaattcatcttgcattgatcactgtacaatgtacattgcttaaatgatctcagggatcaggatcagaggagaagagaagatggagttcaaagcagccatgttcgcggccgccgtcgtagccgtcctcctatcgtcgccgtcaccggcattggctcagaagaagagcccgccggcggcgccgtcgccggtgtcgcttccaccgagcttggctccggcgccggcgccggcgccgcactacgtcgacctcgccgagctcctcagcgtggccgggccgttccacacgttcctcaactacctggagaagacgaacgtcatcgagacgttccagagccaggcgaacaagaccaaggagggcgtcaccatcttcgtccccaaggactcggcgttcgccgccatcaagcagtccaccttttccaacctcaccggcgaccagctcaagacgctgctgctgtaccacgcgttccccaagttctactccctggccgagttcaagaacctcagcgagctcaacccggtgaacacgttcgccggcgcgccgtacacgctgaacctcaccgacgacatgggcaccatctccgtgcagtcgatgtggtccaggcccaagatctcgagcagcgtgtacgccacgaggcccgtggcggtgtacgcgctcaacaaggtgctcctgcccatgcagatcttcagcaaggacccgccgctggcgccggcgcccgccccggcgccggtgtccggggcgtccgacctcgcgcccggcccggcgttcggcaagacgggcgccgtcggcggcaagtcggactcgacaagcgccgcgtgcggcgtcggcgccggcgtcgtcaatggcttggtgatggcattggctggtagcttgatgctcctgtggtgatgatcagagagagagagagagagagagttcttggagtcaaatttgcaacagcagcacattgttcatgcttctccacacttgattctattttgaattgatttgaaagagccattcttttggacatagtaggcaatgtttgtaggatcgaattggagtatttttttttacaacgtattacgatcataattcataattactcatctgctgatggatgaatgaatatgaaaaggggtttctcttacatttctactacatctcttctgctcctctgtttgacgatgacatttcactagttcattattcagaaaaacaactacgtactactataattgatttttcaagaaggaaaggaagatcactactactccctccgtctcctagtaatttatccaaattcgttatactagggagggatatcttcggttacttttttttttttagacgaagggagtactccgttgtgaccgacagtgtaggtctttgatgaatcagtcccttccatgtacgaaatgattcatttcaaatcactcccattgatgctcaccaccaccagccacgtgagccatgtcatggtaagatatgttcagtctactacagtacactgatgattgatgaggttgttccatcttggcataaacaacaagtgtgagatgaaccgtcattggcgagtggttgtgccgagttgaaagattcacagataggactataggaacacgtagtttatgttcgaaattttgaaggattcttcgcttgcctttggcgtgtcgatcgtccgtagaaatttagaggccaaccatgtgcgacgagcatatggtgtgctcgtctcctcacatgcggttagttttttttgcgtgtccagagattctgttccggtgagaaattaatgttctcactagttcagatcttcggttcgatccccatttgactcgtgaattattagtctaagtttttgaacatgtgttcgtttctctactggagtaagagtatgttagtagcagtcagtcagtgaaacactcgggaagtacgtttctcaagtcaactttactacagcaagcccttataactctaggtacttatcttttcgcttttcgcttatgattatacttatcagccaaaatttaaatttttaatcttaaatttaaagttgattctaaggtttttcatcgaaatttattgtttagccttttttttttggatcgctatgaatacgtaagtaattatttttcgtttacaaatataccgtttcatgaaacgatggctccatactaactttactacggaaatcaccaccaccagcagcagcaagcaagcaagcgaacaccggcgtcgactcttcggtcgtcggcgccgagccgtctctcgcgagtcgcgcctcgtgcatccactcgcacaccggcggtgtcgtgcgcgcggcgcggagacagtcgcggttacgaggccgtgggggccttttttccgcgaaagggacggagatgatggtgcgtggctgttacaggggctgtggcctgtggcgtccgcgaacggaggcccatgtgcaaactcccggaagtttatcactgccgcgcgcgggatcagaggcagcgacacgcgcgggccgtgggctggtcgggtgaaccatccgttgccggttgagggcccctttctttctttctttctttttttcaaaacgaatggaggagcgtcaatataaacaaactgtacagtaaggaaaaggagaaaaagtaacggaattgctagaaaacttccgtaagtttttctctcaaagcttgcagatttgtagtcatcggatcgcttcgagatttgtacatactgagaaaaaattgctagaaaaaattatcacacatgtcacgtgtaaaatcccgatgatagtcaatcaaatcatagttaaatacaagttttatataggttacagtataattacaatacagttatatttctattatactatagttacttctaaaagttcttcactaaaaaaatttgcggcggtattttagatactcccaaaagtaaaagctagatccttaaacccagctagtgactagtcaaccaagtagccaattttctgaggcccttgggcttctccctgatctttgtgactaggccggttgcccagagctacttgtgctgaaaggttcttgattcatttacttccaaatccctcgcgagactagcagtattaacgtgcggtgcggactgtttgatttggtgctcctttcgaacacatgagtagaaagtcacaaaaaaagaagaaaaacatattaattaaatgtcatggcatatgctattatatgaaaatttaaaacattgtaatttgtcaaatgagttgtttggatgctcaacatgaattttacaaggaaaatatccgcatggaagtatgactgtaaaacatctaaaggagtaaagtacaccgtactatctctgtttcatattataagtcattttatctatttttatccagtcaattttttttagatttaatcaagtttatagaaaaaatttagcaacatctataacactaagttagtttaattaaatgtaatattgaatatatttttaataatatcattgttttgtgtttaaaatattgctatatatttttaaacttgatgaaactttaaaaaataattagtagaaatggttgaaacgacgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggtatggaaattaaacgcactaatagccctctggactctggagcatgggcatctgcatacccgtttaatgccatcagcatcaaactaaggtgttgctaggcaaatcttcatataagttttaaaattttatttcagattgatttcagtggtttacttagtaattttcgttcattttcgttgcttgttaatctacctaaaattacttataaaaaatcatattcgaaaattcaaaatcaaattaggtcgtaatgcacgtcaaagtcaagtgcggtatgttaagggtctattgggttcaccgattgaaaaaacagaactgaataatatttcctccgtatcgaaataaataaaattaatattggatattacatactatagtactacaaattttagatataaagtaagtgcctacttcttctgtaaaaaaacaaacctagaattggatgtgacaaaacatagtataataagtatgcacatacttgttataaaagtggctccaaaatcacatcggaaaccaaacacggaagaaaacgctataagatcaatgtgtgttttaattcttattctgtgataaacaattggcatgttttggagataatcaattttcaggtgatgatcggattcactgttattttatgtgaccggtccgaccgggtggaggttgccagtcagaccggtgctatgtgtgtggtcagaccggccaggcccgcggtctgaccggccgacgctgagtcggtttcggtttcgggttgtttctttggatatccgtgattgtttcatggttatggtttctagatggattctatacgtatgtaatactgttgtttgctactaatgagtcaagttgggaatagcttggtctcggaatatggtttctgtcacgcctggaaattcactaataatttccgaactaatttgtgcataaaatcctcatccaggaatcaactgatgtacacaaactgacaatttaatatacaaatccatcataataataacgttacacacttacaaaagaaaagaaaacagcagcggaataacgggctagcgatggcttcagctccactcccacaggcagctcaactggggtataagccaaacgtcttcttcttctggatcctttttcttcaactgaggttgattgattattgcaagaatgagcatatgacatacttaacaagccacacagcaaatatgcaaatgcacaaggaaaccaaaggatggcacaatatagtctcatttg

SEQ ID NO: 4678 - DNA, 2830 bp, Oryza sativa
tgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccggcgcactcgcgaaccttcgaaacgacggaaacgacaagctaacacgcaaaacgaagaaaaagactaataaaaaccaaataaacagtacataaaaaataaacaaacatgtagatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacgttaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccagagcacgggagacgacgacaatgacgtcagcggtgacgtcatcaccggcgacgactcgggcacgcatgcccgccggcgaacgacggcgcggtggcgcgaaaggagagcaccaaaacgatgcgggcgacgcggcgaactcaccggtgaccaaaacaacggcggaagatcaacggacggcggcggcgacgaggaagaagcggcgaagactttcggcttgacgacggcgatggtgttccagcggtcgacagcgacggcagaggggcggacgagatcggcgacagtttggcgatcccgatggcggctttcccgagcgacgacgacgaccggagcgacggcggcgcacggctagacaaccgccggcgacggcggcgcaaaagctcacggggttagggcactacaaacgccggcggccgaaggcgaaagtggctgcgggtaaaggggagctcgggggtccttttataggggcaagaaggcaccgggaaaggcccacgccgaccggcgacgcgaaggaaagtttatggttcggagagaaagacgaatttgattcgagatcgaatccacgagtttccaaactgaattaggcgatgattccaaaagagaaaaggtagaggagatcgagaagatcatttcccctctattgatttcaccggatcgggaaataggcgagcgaaaaaggaaaggcggcggcggcgcggctcggctagggttcggccgggcgacggctggaggaggaagacagccctgacaggtgggccccacctgtcagcgggcgaatgcgcgcgcgggtggctgctgccggactgggccgactgggccgagggagagagaggttttgggccggctttctgcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggattttcaaacaagaaaagctcttaacaattataattagatcattaatgatcaaataattactgaactgttctttgtatcatttaggaattgagctccaaaaaatccgagaaaatttcagagagtatacttaatcatagagaatttaataaaaattaaatccatccatgctttaaatttaggaaattttatttcccacatttaacttcacttgtaaattaatgaacgtttaatataaattctaataataatttattaaataatttataaatcctgaaacaaaaatcaggatgtgacagtttctttgtttgtttcatgtgtaggtgactcgatgcctcgggagagtatttgcggaaatgatcttctcgatctcctctaccttttctcttttagaatcatcacctaattcggtttggaaactcgtggattcgatctcgaatcggattcgtctctctctctgaaccctaacctttccttcgcatcgccggttgccgtgggccttcgccgccgcctccttgcccctataaaaggacccccgagctcccctctacccgcagccactctcgccttagcccgccgccgtctgtagcgccctagccccgtgagcttttgcgccgccgtcgccgccgttcgtccagccgtgcgccgctgtcgctccggtcgtcgtcgtcgctcgggaaagccgccatcgggatcgccaagtgtagcgcccgttccgtcgtggcgcctagcgggaaaattatctcttaaaaaccctaattgtgaaatttgtttctttgcttgttgtctagtgtccgtgccatctcaagatctcaatccccgatctatcgtcgagtccaatcccgaatccaatccttccaaatcaaattcctccgcaaaagtctattttg

SEQ ID NO: 4679 - DNA, 9549 bp, Oryza sativa
ccaagtcctccctctccgctccctcgctgccacttcccgcgcgccgtgttcgcgtgcgcacgcccgcgcggatgccgcccgttgcaagccgcgcgcgcgtgccgagtggccgaccgcccggtcgccgccgccgtcagcctctgtgcgcgtctgtcgcccgtgtcgtcgcgccgctccaaatcgcccgccgtcatcgccgtcgtcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttccccttttcccccaccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgtttgttgttgcgcgtgtcgaaggagtcagcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcgtcgtgtgctcgccgccgtcgccgctcgagctccgtagcacccacacgtcgccagcctcgctaggcgtagctccgtccaatccgacgctagcatcgagttcccgaaaccgcgtagatgctctcaccgccgggaatcgatccctcgtggcctcgccgccgtttccctcttcccccccctccgccggttgtcgccgccgtcaagcttcctccggcaaatccgagccgttggctcgtctcccctcatcacgagcaaccgcccggtgtgctcgcttttgtccgtatcgccgtggttcgctccgccgctcgccgccgccgcccgccgtccattcgcggccgggtcatcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagccctgtccaccggctctctctctcctccctcccgcgcgcgcgcgtcttgggccgctctgggccgccttcttgggccggccggcccgttaagctcggccgagccgccctttctctcgggccgcgccctagccgcccgagggaagtctatattccctccctctccccttttcttttctttttcttttccaaaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcatgcttagaggtcattaatagggctttattttcgccgtttgttgagttgtcccgttttgcgtatagtttcggagcccgaagacccgcagagcgaggatttcgaggatcaagctccagatctcaagcaaggcaagccacctttggacatcttgagcctatattcgaaatctaattatattgcttgcaaaatattatgcattgataggattgcacttaatctgttgttccgtctgcaaggcagattggcagacctacctaacttgttgcatttgatccttccattgttaattgctataccatgtccccttgtaatcatccagttgcgcctcgatattcgtgcaccctgtgccagtatcgacggtcgccttcaaacttaaaatctgagtaacaacttgcgtaaaactggagttttacaaaagacttggaaaacccgacacctgggtcggtgcttgcgaactaaatgaatttccaaaaccgcggaccgggaaacgtaccgggtgtatggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcataaggtaaacctgtgtcggctttggaaatgccttgccatgaaagcttggaggtctcccgacgtggctgatccccacgggctgggtgatccgggttagtaatgtcgtgtgggtaaagtgtaccccctctgcagaggttaacaaactgttcgaacagccatgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgtccgcccctccgccgtcgctgtcgaccgctggaacaccatcgccgtcgtcaagccgaaggtcgtcgccgcttcttcctcgtcgccgttgctgtccgttgatcttccgccgttgttttggtcaccggtgagttcgccgcgtcgcccgcatcgttttggtgctctcctttcgcgccgccgcgccgtcgtttgccggcgggcatgcgtgcccgagtcgtcgccggtgatgacgtcaccgctgacgtcatcgtcgtcgtctcccgtggtccggccgtggaccgatagatctcggccgttcgttttggttggatcgatctcggccgttcgtttccgtgagccgccgccatgcacccggtccaccatgaacccgacccgctgacgcaataatcctcttttccttttcaaaaataattcattattgcgtcataattcaattaaaacctatataaaggatttaatccgatttaatcttcggaaattcataactaaatcatcgtaactcggttttgagtggttcaagttgctaaattcatctaaaatcatgatctacatgtttctttactttatatgtactgtttatgcttgtttttgtactgtttatttggtttttattagtctttttcttcgttttgcgtgttagcttgttgtttccatcgttgcgaaggttcgtgagtgcgtcgggagtgttcagaagattaattgaagaccgattattgcaaggaaagtcacatagatcctaaacacaatcctttgagcatgttgatcctatatttaaattctctctttatttcaactgtgcatttattttcgaatgtcactaggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaataatagttcacgatagtcaatcgtgattggttaattaattacttgccaactaaaacttgataatggtgggttgtgagcacatggttttgagagtcgcgctcatgacaattaaggaccggttcgcgagctactattgtgaaacattaaccgtgccaaccacaagccaacgtgggcaacggctttaccttttgtatagcatggttcattgcggagcaccagactgagaagtggcggagataagtccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctcttgccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtatagccgggtatggttgttcaggatggttgggcctgtgcagcatgggtgtgctgttcagtgttgattaaaatttctaattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtagctcggctgattcctggatgagaattttacgcacaaataagttcaaaaattactagtgaatttccgggcgtgacacacacataaagtactattcatgttctatcgtttaataacaataaaaatactaatcttaaaaaaaaatcaaataagacgaacggtcaaacgttaaacatgaatagtgtaaagctgtatttatttgggatggaggaagtataaattataaggcctatattttttacacagtcttcaacgacatactttgaccattaatttatttcatattatatcatcaacaactataaagttaatattacatgaaagtattttaaaatgcaatcttattattaacatatgtaatacttgttgtagatattgattattagtcaaaagtcaccgattttgattttttttaaataaggacgctttataattcgaaacggatagagtagtaggatattttacatccaattattttattttacagtggggtattatttagttgagtatgtttcttttttctcatacaccttagagaaaacggaggaaaagggaaggctgggctgctccgtgaaaaggaaagatttggttgcttaccagattctctattgtatagctcggctcgttttctaattccagcctctcgtagagtgaggtcgatactcgtagagtaggcagctgcttcaattttatccaactcacatgtaactcttttagtaacttatgaatacaataagtaaattgtaataatgctcggcacaccaacttcacatcatattaaataacttaagcttcctttcacacatgtattccctcctttctaaattgatcatcatataatggaattcaaaatttctcaaattaattattatataaccgcatggacacatatttcatcagaatacaattaatgtagcatggaaaaatatacgcatgctaagttgtgattggcattgtgttttaatcgatgcatacattatgggagaatgtgtgcatgatgtcttaattgatatgatttaaataattattgggtcctgtttagaagattagcccagggctaatgtttagtcatgaattggtaggctaaacattagtctagggtagtatgtttggatccatgggctaattcaaggctaaaaggtggagacagagggagagagagaactgctttttatggtccccacataaaattagccccattagcaccccttggaggggctaatgttttaaggggggctaattcactttagcctcaaattagcccacctgtttggatcattgagggctaattcaggagtaaaaggtgggggctaataattagcccatagaaccaaacagggccttggtcttgtctcttggtgcataatatatagtataataatcaatttgggaaggagagagtagttcactccctctgcactcatcacttttctcgcaaagccaatgctcatcgtccgctctcactttgtctctcctttcctcttctctcctctctcatacagcttaccactgctcagggacggagctacattgaagagtggcggtgcccaggaacctgatcaataattttttttaattttttttaaaattatagttcatctatttttatcatatatgtaccccttcaatctaaactcagacgctcatatcagactaagctcagcctaaaatagagtaaagcaagtgagtgttatttcttcccatttcgttctagctccacccttactgtagctgaaatggtttctcctatggttagtctaggttgtactactgttgcactcgctagtagcagcgctgcagcagcagcaaattcgagttcctttctttgttttttatctttgttttcttccttccttggcataggccggtttagctgagtgcgtcgtgtattaaaactctattttttcaatttattgacatacaatctagcagcagcagcaggcatcgagatgggcgcagcggtgaatgccccctgaaacggaatggaagccgcggacaagacgacgacgaggcatcggagcaagagccgggccgatgttgtgggattcggtcccgccagcgtacgaccaaccccggccgctccgcgcccgcgcgacccgcacgtgagagcaccgcgcccgcgcgcgcaccaccacgcgctggaaatgctcgccgtccgtctctacgctaggcagcctcgcccacacgcacacagccaaagccaagacgcccatccatgtggtgtggcgcagcgagctgaactgctgaagtggtagtggtggtgtggtccatcgatcgatctgtgcagcagcagcataagctgcttggtggtgcgctcccctctgcgcggcggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaagagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttcaccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggttatagagcacttaaacttagttacaaagtacttcctccgtcctaaaatgtagacattttttaggttggcacgggtattaaaaaagtatgtgagaatgattggagaatgtgtatgattagttgaaaagaaaaggaatgtgaatgagaatggttgtgattggttgataggaggaggtaggtggaaaaatagcttcattttgggacaagacactgtgttagaaatagctatattttaggacggatgtagtacttacattgagctacaatgaatcaaaattagattttacaactgtttttgtttctagatttatgatttttgacatattcatcatattctctttttttaacgaatcggcgaaccgccaatttcatggaatacatgagtaaaattgtacaggcacaagacgcaagaataaaaaaaatgtgcaggctcaaggcctttggtcgaaatgcttcgcgcccgccaaggttcatgtttttttatcgcttcctccttaattttggctgttaggctagtcgtcaagagctctttttgctggaaaaccctgcggttccttttgttccaaatctcctaggcgaccagcagtattaatgttcgaaggagccttcggtgcttcgctagtccacgcagtagcctcccatcactcagagcaagtataatagtaggctataagccagctaaatgctaaggtggaggagaaaaaagaggagaaagaggagaagcgggctataaaattacagccggtttggacactctttttatccaccacggagatcagataaagaggcgtgtcggtgatatgggcccgggggtatcaggtttagagggaggaggccgcccctcgatgccacgtggccctcccccgaggggagtcaggcccgaggtggggtggcggccactccttccccaaagactagtcggaggaggctgccccccaatgccacgtggccctccccacaggggagtcaggcccgaggtagggcggtggccactccttcccagaaactggatggaggaggctgcccttcaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtc

SEQ ID NO: 4680 - DNA, 17769 bp, Oryza sativa
  unsure (1)..(17769): unsure at all n locations
ataaacctcttttatctcatcgtcttggaggggcctaaccccctcaagatcacacagctccgctcaccaagccctcgaatctcacccgctgcccccggccgaactcacaaaggggggcctcacggttccctggtggaggagttcattctccgacatctggcgcgccaggtagggggcgcgttcgtgatttttgaggttttttcgagcgccggcgtggtgagtgtcacaccgccgctacgggggaaggcgcagcatcctctggagtgtcgcgccaccccaggcagggggcaaggccccccacatccccaccgggtaagcttggctaccaggtctttgtggcgagtcttcggaatgtccgagggcccccaaagctccagccctacctcaccgagaagtacgatgatggcgccgacccctccaagtccctccagatctgcatggcgatcatagaggcggcgaggggtggcgaccgggtcatggcgaacgtcttccccatggccctcaggggccaagtgcggggttggcccatgaacctgctgccgcctcggttcactcctaggaggactcttgcagttttgagctccgggtgccgtcgaagcccgggaccccctgtgctggctcttctttagcgactggctttggtcctgccggctggctacggtgtccggcctggctcaactgatcgtcctttcaagcttcaagtattttcaatttttcaattcattagcttgaaatcttatatttgtttccccccattctattctcatggccctgcgacgcccgcgtgttgcgcatttgtttgctccctcggtggtaagagcccaacctctctcccatctacatgaacgattcttcgctaagtgtgggggctaagttttctagccttcagttgagccccgagtgccgtcgatgcccgagaccccttgtgctggctcttccgtagcggctggctttggtcccgccggctagctacagtacccggcctggctcaactgtggatggggattgctggctctagagttttcggctctcacactcatgcgaaagtaatcgtccatgtagaaggaaaagagattggaagcaggccaccgaaaggaaagagcaaacagaatgtgtagcgtggggacacaggctcgtgggaacctgacctcgtttgctaagtggtcacaggcttcccaagatggttcggaacccatggtggggggtcctcttcgagctaaaggtttgtgtttgcttcattcatacaagcaattctttgctataagtgtgggggctacgattcctagctctatcctagccctgcgtcgagctctgggtaccgtcgatgcccggggccccctgtgctagctcttccgtagcggctggctttggccccgtcagctggttacgacgctcagcttcacttgatcacaggcgaagattgttggctatagaaagttcagtcctcacactcgcgcgaagataatcgtttgcatagaattattattgcttatatttatctctcgcctatctcttcctcacggtcccacggtacctatgtgtcacgcgccggcttgcctcccttggtaacaaaaagtttgtattcgcttcatccattcaaacgattctttgcttaaagtgcgggggctacgatttctagctctatcctagccctgcgtcgagctctgggtaccgtcgacgcacggggccccctgtgctagctcttccgtagcggctggctttggccccgtcggctggttacgacgctcagcttcacttgatcgcaggcgaagattgttggctatagaaagttcagtcctcacactcgcacgaagataatcgtttgcatagaattattattgcttatatttatctctcgcctatctcttcctcacggtcccgcggtacctatgtgtcgcgcgccggcttgcctcccttggtaacaaaaagtttgtattcgcttcatccattcaaacgattctttgcttaaagtgcgggggctacgattcctagctctatcctagccctgtgtcgagctctgggtaccgtcgacgcctggggccccctatgctagctcttccgtagcagctggctttggccctgccggctggctacggcgcccagcttagcttgatcgcgagtgaagattgctggttagggaaagttcagtcctcacactcgcgaaaataatcgtttgaatagatgaagtagaacatgaacagagattaacaaatggcaggagcaagcgaggtacgcggcgtaaagacacgggcggggaccctctagaatctacctgcaggcttgctgaatatatacagaaaataagttcacagcctaaggtacgggctagcgaatcgccctcaggctagggcgaaaaaggcgcatgggtcctagtgccagcaaagaaagaataagagatcgggcccacatgtcatttgactaacagagtggcgtcaaccctgaccacctaagaaaagttttggtcagggctaacgccgggggctactgtcggtgatatgggcccggggtatcaggtttagagggaggaggctgccccccgatgccacgtagccctcccccgaggggagtcaggcccgaggtggggtggcggccactccttccccaaagactagttggaggaggctgccctccgatgccacgtggccctcccccgaggggagtcaggcccgaggtagggcggcgaccactccttcccagagactggatggaggaggctgccctccaatgccacgtggtactcccccgaggggggtcgggcccgaggtagggcgccggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatatgatatagtagaacaagtattgatccgaaggttaaagcacccatcggctagaggtccgatgtcatgaaatccacaagattagattaaacaatgaaacctttgttgccatcggctaaatccaacttatatgtatatgcaatccttatgagccgatgcaacgtccagataactcaccggctgaaaccccgatgaatcccttattggcaatcaataagcatgctagagattatggttctaagcacgacttagtagatcaaacttaactaatgcaacactaagtatgaaaagaaacacaatatctagacaatcaagtcgttgactgattttcagggtggtaaatgcctaggctaatctaatatagcaacgcgatttagccgataccggcagaaaccctaaagcgagagacagccgatagagctaaattgatatgctaagactagattaacagagacatgataaataggtaggcaaatatatcatccaaaccagagcaatccaagaggtcgaatatactgatgcagccttgaacgacgccgatgtagatgagacaattgcctggaccgacggaacattggacttatcccttcgccggagatcgaagacgatgcagccctgcgttgggtgccaagttctgccggaacgtaaaaaacaaaagtagaagtaaaaagggtggcgatgcgccgaattatattgatcgtagcgataaactacatagaccccgggtgtacatatttatacccatgggttgatacaagtccttgtcggataagaaagtacatagaccccgagtatacatatttatacccatgggttgatacaagtccttgtcggacaagaaagaaactttcctaaagataaaaggaaaagataaaatccttataggacactaaacacactttcctaaagataaaaggaaactaacaaactattcctaattaatagataacttgccatgccgcattctctttgaactcggtttcttatggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagggtcgggctcccccgaccccctctctaggtcaccacgtacggtgggttaggtgtctgcctccaggtgcccacctacccgcatttatggcatcccaagcggtcgcgccacgccgcatttaatgcggtatgcagtgcactcaaccggtctgtgaccgatcgaatgaatgatgggacccaagatgtcaggcgcaccatcgcgtgtgtcaggcgacgtgcagcccgacatatcccatcaaataatgatggtgagaggttctcatcctcttatcccagccggagtcggtcctcccgctctggtcaatgcaaggctcccgtttcccggtgtaataggagctcagaagtcttcacccattaaatggtgactgacaggggcacccccgtgtcaggcggcaagatttaacaggctccatcatcaagatgacgtgtgcttagcttcccaagtcaagagacaagacatgcatttaatgcaaatattataatacttctccaccggagctaggttaggttgttagacccatgtggtaaccccttgatgtataaaaggaggtccaggcctagtggtggagggggggacttccgagcgaactggcgcttgggtctcgcaaccccaagcactggtgttctacattcaatcaatcatgcacaggagtagggtattacgcttcatagcggcccgaacctgtataaatattttttgtctcatcgtcttggaggggcctaaccccatcaagatcacacagctccgctcaccaagccctcaaatctcacccgctgcctccagccgaactcacaaaggggacctcacggttcactggtggaggagttcattctctgacaaggcgtttttttttcccctcctcctcgccctctctctttattaacgtggccccatgtaaacccggctctttaatccccccgcagcgaaatcaaagcgtcggtacccagtacataatacctccacggtactcgtactcgtactccccaactcatgtggcaaacaaacgtaatcttctcatcccaccgacggatcgatcgatccatctctaccaaatgcgccccgcgcgtacgaacctatcgatcggtgtacgacgtacgcgcattccgcgaataatccacccctgcccctgcccctgccctgcccctgcctgtcacgctacgatatttaacgtggctgttggcctccgtttgacaaccacgcacgctgcgcacgcattcgttcgtgcgttcgttcgttcgttcgcacgcattgatgcgcggtccggatcccgacgccgctggcacgcgcgaggacatgcccccgtgcagctgctgctgacctcgatcgctcgcgcccggttttttctcccccctctttataacccactgaaagccgagtattattccaatgcagcagcagcagcaatcataaaatcgcagagaaaacgagagagagagagagagagaccattcttcttcttccacggcctcgctactctcatgagcaaggatgaggagggtgtggaggaggagcagcagcagcagcagcaacggcccaatgccatcgttgggatcgcaggagtcgccggcgacactgggatggccggccggtgagctgaatccaagataggatatagggaggatcgatatataggcgaagaaatatggaggggagttttggtgatggtgatggtggtggtgggttttcggtcgacggccggcgctgcaatgcggcatacaagggaaagccaggcattttctctgctgttccaagtactacctttcctttagctttcctctccatggaagaaaaaagaaacggttgcattattcatgtgttttctctgttgttaattaactcttgaggttgattaattacttcggtttttttagctaggcaagttaactagtagtagtttctgctacagatggtcaatgaagatcatgctaagacgacagtcacactgtatatctgcattgattccttccttctagattgttatgcattttcagatctctctctctctctctaaccaatacgtagctattggaagaattaatgtatgtccaattcatctcatcatctgtgtttgttgttgttgttgttgttgttcgaatccctgcttttgcacagtcactactactgtttcttttcggtgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctgtctttgctttcttttttgtcattggatttttgaggtgcctttagcgtgcagccttcgctcttgactattgcaccccggtaccacgtaccattgatgttcagttgggagaagttcatgatttggtggtagttgacgaatgctactacaattctcgagtgtaattatatatttgtatcgtactttctattattgcacccttttgatgcaattctttttctttccaagttccaacctaatggtacttgttgattttgattatatattcattctagtgcatgagtatctaggcgcctaggcctggacacaattctgctgtgttcttctgtactgcttgctgaatgttgcctgctctccaaaattttctgaatcctttccattagagtggtttctttaactgcatactcgagtaatacattgtacgaatacgcgtatatattcaatttagttgcattttttttctaataatgaaggattgaaggtatataactacttttggtctctacaccaggattacaatttaatctcaaggctacaccaaaatagcatcacttgatctaatcatagttagggggtaaaaaccatatatcttgctgtgagcctgtgagcatttggagccttatcccacgtggtatattgtaccgtgaacagaatctaactctttggcaatcaacgaattcatgataatgacatgagagaaaaagctccgaattgaaatttgaaagggatgccctagctctagtgtcggtacggtgctttgtacatgcaggggtcattgcccatccttcataaatcatatatttatggctcctttaaaacacagaaataagaaaaaaaacttcatccaataagactgttgttatagaaagtcagaatataaataaaaaggatgaaatggtattaagaggtctagtggacccacaactaaaaagacactctttgggacaaatctaaaacctataaacccctctttttaggacggagggagtataggattgcatgtataaatataaaacatagatgaaaaatgtaggaaaaatatactccctccgtactcgtaaaagaagttgttttggacagcgacacggtctccaaaatacaactttaacttcttgtttctataaaaatatttattgaaaagtgatatatgtatacttttatgaaagtatttttcaagacaaatctattcatataatttttatattttcaaactcaacaacttgagagttattcatgatttatattcctatggtttgatttaaacattgtcctaaatgacttcctttacgagtacggagggagtaagatagattgtttagaacaaatatgaacttagtaaaacacaagaatcataatgtcgttggtcaatttatcctcaaattatggttctttagagctttcattattttatttagcttggacttagctaataaatgaaaacaaaaaaatagggcttggtagatgttcgaattcatatggaatctctagcaaaggaaaatttccctctacctttcctatgcccaaatccttcattccaaacaagcgaatagtgccaaatacaatacaaattgaaatcatccatatttcctacaaaattcctacaatccgaaggagccctcaatgtggcccttaacatgagggttggatctcatgagaacttttctcaggtctatctctctcccaaaatcctatactttttctatggagcatccaacaacaagttacacacaatttctgcattctaaaactcctatggatcaactagctagtatgccacgtcttcctacatttttcctgtttctgtatttttgaattcatacgctccaaaggaaccctaaagaaaacctaatttccttccaaatgaagcatgcaaattcttaaatagtactaccaaattttatatttaggacatgcttttagagccatgtatacaattttaggtctcctttgaatttcagaaatttaatttggacgatttcaatccttgggatttttttctataaggtcattctttttttttcaattttcagatcgtccttttgcacgagagaatatgattgacaaaatcctaaaagtttattttatatacctccattccgtacggaatttttcatatcataaccccaatgcactctctcactctctctgctcttacgaatttttccttactattgaaaataaactaattctaaagaaaatcatgtgctccatatatatagctccaaatattatttatgcgtgttggagtcctatagatcaagttggaaatggcgttctactcgtacatttatccctttcttatgcgtttttaacatacttgtgtttgtttcaaagagcctctatagaccaataagaaacttcttttttactgtgaccgtgaagcttagagcaggtataatagcagactataaaccagctgcaaatatattttaagaagataaatgagatgagagaagagaagcgggctacagatttgtagctagttgtagcacggactccaagacgcagtgtgtatgacagatgggaccaggtattaatagtgtagtatgtaactattgtgtgaatgagctattagattggctatagatgaattggagctagtagttaactatactattaaacttgctcttatgtccaatacgggtgaggatcatctatcataacatcagcatcattacagtcattggtatgtgggtcactacctcctattatcacacatatcagtatatataatgatggtgtcattatgaagcaatataggctgtgtttagttcgtgtgtcaaaatttttttaagtatacagatacacacatgaagtattaaacgtatactaataacaaaacaaattacagattccgtctgtcaactgcgagacgaatttattaagcctaattaatccgtcattagtaaatatttactgtgcatcacattatcaaatcatgacgtaattaggcttaaaagatttataacacgatttatatgcaaactatacaattgttttttatctacatttaatgctccatgcatgtgtctaatgacaaaaatgttaaaagtttaaagaaaaaaattgaaatctaaacacggccataatccaatactcccatggccaatggctgcacgctttggcattggtaggaaaccttcaggcccaaccaaagaggcatttgaccaaaccgtccggaattcagtggcctcgggatccgttctttttcccgagcatgcgtgcggcacagcgaaattagctactcccagcaacaaagatggatcgttactccaacttgatatggtttagctaattagctagctttacacagcatcatactatcatactatactattactactataatcgtcaccattgatttctttaatcaagctatctaatcctatgtgccccctgtgttgttgagctgctggttttgactttgttggcaccgagatatatgtcatgagaattggtgtccgagacttgaatggttggtagctttgacgctagcttttaggatagatactcctatgatatcagtaaaaaaaacacatacacaaaatgaaatattaacagtgtttggatcgttcagatagctagctagcccttgaatacttcggttgtatgcatctcagctgcttcattatttcttaatccatcatgtattattctagtatctcgtggtgttctgtgtcagatgggcctcgttaattatagcttagcactgttgtttcaaaaatctgcggcttgcttcgcgcaacacattgactttctgcctgcatctgtaggcgtaagatctccttggtttgatgatccatgcgtggccatgttaatttgggactgatagggatccgtgcttttgtcagactgtcagtgtgcagcgttgatcatgagttagtacacctaatatgttcatcttcatcgatatctcaaacatcaattaagaataaactgaaatggccatacctctattaagagtctgtatcttatcatgccttgttaatcttgactgtctcataatcagccaaccaccttttatattagcgaccgacggcgaagaagaaaggtgatcaccctaacaactagctagctactcaccattttttgaaaaaaaaaacaaagaaaaaagaagaaagagaagaagatgtacgccattatttcgctccggtcaataacccgtaaaaaagcgtgacaatggaataaaagttaggttttatttttagacttgtacatgctgttgaggatttaaaggcaaagactaaagaagacaataaaaaacacatagaataatttaaatttaaacgttggctatggcttactttattaaaaaaaactaaacttagaagagaaatgtgatcccttctaatacaacaaatctcttcatctatttaaatttatggtagaggagtcacgcctctttaacattgatttttttttttggatagtgtgagtaatgcgctaggtacacgtacaccagtacagttagtacagcaacgtacagtgtgcgtctctggaggcgtatacgtatccggtttgatgagggcatggcccatgctagatcgccttggctttccatatcaaaggacacagggtttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtctgcaagtaaaatccgatcatccagagttccagactgcttgcaaatctggactagaaggagagggcatcattcacagggtgatatggacatatgggacaagggcatgcaggccgaagggaactctcacaatggcacaaggaatgtttcgaaccaactgtgtacaaacattcacaccaaataaaaataaatgagatcacatgaatcaaaatccaagaaaaagagcgtacgtggattgaaccacatacacttttgaatcagaatagtgcatcaacctgcctactcaaaataactccaggtacaggttttattttatattttttttaatcgaacaaaacaatcaggcagacaatgtacatcgcgagagcgggctggttacgatcgctttgctttgatcacaaagcgaggccttccttccgaaatgagattctgctacacctgtgcaccgcgccgcttttcacaggcccatcgaccgttttcacgggcttttcggcgtcaattatcgcggtggtattttgtttggagtcgattgccttttgttcctttctgctctccagaacagattcaagcccctaaaatgtgcacaacacagatatggattggcataaagaaaccgaaattacctgaatggaggacaaacatctgcatattaattgtgtattaccttcactgcctttctttcagactgagccaactctgtgagcttgagtttttcattagcttcctgtggaatggagagcatagaaggatcattacagcacaatgagcagtatgagccaaaagaaaagcgaactatccaagataaggcatccttagaccttgcatgcaatcctgaacctttataaatgatatctactcacctgaaaaaacttggcatttattccatcttttagacctccagctatttggcagaggtaccatacaccagcattagttgcatcctgtcggtaaacacaagaggttaggcaaaaggaaaaaatcagcacgttaaatattgatgggtatgtttagccacctgtttattatcaagcaactcgatcttcccttcctgataatgtcaaaggagaacataaaggtcaggataaccaaagaagtgttctgacacaggttcatgctcaagggttataaactaataaaactcaccaatccagcaaccatctgttggattgctgcaatatcaaatccaatttgagacagatcatctttgacatcattcacctgtgcatagagaacagaatcatgtcttttgcataacattgggaagaacaaaacttttctgctttcgagaagaaaatgaaaaatgctgtaaaatttatctttccatagatgagtacttgcagatttacagtagctatttttaagaaggtatattttaatgcaactaaagaccattcattgatgacaaatatcattatgcttatgcttgcgcttgtatatattcttggcttcatgatgttgttttatggtttatgggcaagatcgatcacttggaatatgctgtcaatgattatagtaaaagccaacaattccaccatatttcaatgcatatcctataatagccatgtcaagtgcttcctggctttatcgagggcacagtttttagcttgaaacaatattggcatgacaaagaaaatcctgatccaccttttcagatgcgactacacaaatcaaactaataagagttatgcacctcaggtagaaacacaatttaataataaagttatcagatgctaattagacttgatgtaatgaaaaaaatgaaacaataattattgctccagagaaaaaaaaaaaggaacttcaaaaatttccatgtgtaaaaagttgaagggctagcagcatcacaaatcaacaaacctcgtttctaataattttggagacctccacttgctcatccattttcccatctaaattttccaggcgctgacttagatgcctttttgttgcctgaaattaattgaatttagaaaacactagtcagcatatgcgaaggaaaactacttcaaatatgtaacgattcagcatgtaaagcatacagctaaagctgaagacacttgatccaattgcttcgacatactctcaacagctttggtcatgttgcgtttggtaacaaacatgacatccgataaggacaatccctgcaggaagatactataatgtaagaaaagtttaacacatacagttcatcattgtactagtaatttagtctacaaacaccattaggacaagacagatttgatggttttacttaaatactagggcctagggatcatgaaaagagtctctcaacccgaaactgtgattcttgatagaatatttggtcacagaatcagagaggtgttattacatgactaagaaagcaatttaatcccccgcccaaaaaaaaaagaatgtggtttattcatgatgtctcaaaatacatacaagggtgccaaatgccaattatatatcaaagttggatacttggatccacatagaaccactgggactgcatggaaatactttacagggagacttaggtagcatagttcttaagacatataactacaagaaacaaggtaaacaagcaaatggggaacatcatattactctcttcattcagttactaatttattgaaggctgtaagtataataaaaggaaaaggatagtaaggagtgtttgtggagaaagaaagcaaggaagaaaaatcagaatataaaagctgatagatcaaagtggcattgtatattcctgattttaccttccaccacatatagcagtaacccattgctccaactgcagctgcaggcagtatgtaggaggataaactgcctgcaaaagggatgcaaatgctagtgaataaacaacacggataagaaaaagatacatgtcacatggggacaagtagctagtgagatatgttcatgaatgttgtgagaaacagctgaatgtaccagcattcctatcccatttgtcattacattgctattattgaccaatcaacatgattcatactgtaatcgctgaagcatttcagcttcatgaattactcaatattgaattagagaatagagattgacactctttaacgagttttagcaaaaatatgtctattgaccactttttcaccaaggggtggtattcttgtagaggagctgatacaagccaataattgtctatctaaaccttaagattgacaaataatctaagtaaaaagatgtaacaaaagctttatatggatagactctttgcatgactgctagaagagtgaaactgaaaacagaacgaggagaggatcaaacaagaacaaacctccagagtcggagttgccactcaatatggtaataggccttgatatagtcaaatctctaacttcttgtgctaaatttcgaatctgcagtcaagcgccagcacacaaataataaaaacaacaaactgcagtggtttttactgaaactggcaactttattgaaattgaagtctgcattgtaacttccattcaactgttgattctatgaaaaatatgaaacgatgcatacctgagattgaagaagggcgatgtcataggcactcgaaccttctccttggtttacacctttcataagctcctaaaaacagggaaaaaaccatctacttcaataaacatctgcgattttatgagttactacaaattatagatgaagaacgcatcatcatagccattgggtgattaacttaggcatgacattccaattggtgcatcgaaatgattcgacattgaaattaagcgacaaaaagttatgcccatgtgcacgcccaacgtttgatcggtgaaatgtagctgtaatgcatttgataaattggagtcccacaaacagatatataaatcacaacatcgcttgaaacacacacgggcaacactgacgcgcctatattagcgtattggcaacttacgatcgataacgcgaagcaatcaacagaattagatgcccagaatcaactactctactcaagaaacatcaggcaatccaccgacctgaagctccgccaacacgtcagatagccggccattccgcagcacgatcgagctcgtcaaccctgcagctcgacgccggccaaaaaccaccgcatcaggatcagaacacagcggggcgatccgcatctcgaatcgatgctagaaaatatagtacaccggnagnagnagnagnagaagaaggaggggaaggttgcggtgacgagacctgcgccgacgaggatgaggaccttggaggtggcgaaccccgtttgcatcgccatcccctcccgccgctcctgcctccggggctccccccgtctcttcctcgcgtccgacggcggggtcggtggcgaggtcgtcggcgaccgcggggaggagagagagagagagagaggaggggagattggcgaagcttcgggaaggggaaagctgacggcgaaggcggaggaacgtggtgactgacatgtggaccccaccgctctcgggcccacctgtcagtgaccacgtcagaggggtgcgcggacaactgggcgagtggtggggttggacccggcttcgcttctgtcgatggtttggcgagcccgacccgagccggtttacacgtggacggaccggatttacccattggggtatttgaacggggatagcgcatgccacgctgtgctctagaatgccaagtcagtgcacgtaccacggcattactgcgtgaggcctgagcgtggatttttttgttatgtcttgaacctttttatttttaattaaaaaaacaattgaaaaaacttattttaaaaatttgaatcttttagctacgcatactgtcatgccggtctgcctaatgttccatcgttatttggtcacgccggcctaacggatgtgacaatgttatttggcctcgtcaccctgactaacgtgataagataaaactatcacgcccgttgtggtgacgtgtcgatgttatattgccacgttggatggaatggcgtggtcaaaagatccatattttgaagtaagctttggaatggttggatgaaaatttggatattcatgacatgcttttcaaactactaaacggtatgttttgtgtaaaaaaaattttatatgaaagttattctaaaatatcagataaatatattttttaaatttgtaatacttaattaaactcaattaattatacgttaatacaatctcgttttgtataaacacttaagcttcgtcttaatctgtatgagtttcaaaaatcaccttagcaatcaaatgtttgaacacatacacggagtattaaatataaacgaaaaagtttagatcctctagcaaaatttttcgccatgtcacatcaaatatttaaacacatgcacggagtattaaatataaacgaaaaaaactaattacacagattgcgtataaaattgcgagacgaatcttttaagcctaattgctccataatctgacaatgtggtgctacagtaaacatttgctaatgacggattaattaggcttaataaatttgtcttgcagtttacaggctaaatctgtaatttattttattattagtctatgtttaatctataactaatataaatattcgaatttttccggtcgtcacactggtttttcgtcccgcttcgtcgccccccctcccccaaaatcccaatccgaatccaatcaaaccccggaaaaaaataacaatcacaatcggagttcaatcacacaaatcatgatgcatgtacacatatatatccaaaccaaaaccaaaaattagatcaagggggtcaccaccgccgtcgccattgccgtcgcagagacggctggccgccggcggcttccctcctgctagatccggtggaggggagagcgccgccaccgccggtccctcccgttagatccgccggcggtggcggcggagggcgctctccggtggtaggggagagggccgccgccgtcgtcggtggtgggagaggactccgccgtcgccgctgctcgcgggagaaggggcgcc

SEQ ID NO: 4681 - DNA, 4673 bp, Oryza sativa
  unsure (1)..(4673): unsure at all n locations
nnnnnnnnnnnnnnnnnnnnnnnnnnnnnnnnnnnnnnnnnnnnnnnnnnnnnnnttatttaattatacacatatacctacttaaaaatatcaaatatttcagcgaatttgtattttaattaattgcatatttttctgatatgtacgcttcccgttgcaacgcacgggcacttttgctaaaccaaacaacacttttggttaatatacacactccgtaatcacccggtgcaacgtacggacacttttgctagtactttaaatatgtgttcatatatccaatatgacacactaaaaatttacaccctgcatctaaacacagcctcaatcatgaaatattgaattcctatttttcaagaggatatacgcggcatgagcccatggacaggcatttaccgccgctgttccccgcctagccacgtctctgccacgtcaccacggccactccccggggaagacgaccgttcaaacccgccgcgactacccgacggcggcgcccatgccgccgcctttttccttacgccactcccactccgggcaccggcttcaccttcttcttcccaatccctagcctttctcgcctcgccggcgccggcgtcgccatggcggcaggcgccggccctctccccacccttccccttcttcttcttcttcttacctttcttttcaacgcctccgcgtcgccggacattttcgccgtcatctcccagtcgggcctcgacttcgtcaaggacctcctcgtgtcccgcgccgcggaggccatcgtgcccctggaggtgcccgacatcgagaggtccgtgagcatcccggtcatcggcaccgtggacatggtcgcctccggcatcgtcctccacggcgtggcggtcgacgactccaccgtcgccgtcggggacgacgggatcgtggtggccgcgtcgctgtccagcgttaatcttactatggggtggagctactcctatagcgcctgggtcgtcacgatctctgacagcggtaatgcctcgattcaggtatgggtcgcggtattcatgcgttcaattgttgttgtttttttcacagttcgagagatgatgctagattggagggggacttccatgattgacaagttaatgttcaaaattagtggtttagtgtctgaatttgcgcttattggcatgtatggaatgaaacatgtatgtaaagtagaatccagcacgttatgaaattgagtagctttgaagacactttcaaatctagttctttagttggtacatgagtaatttacattgataggcacaatagctggttacttgttgcacggtgcatattggggtgacatgtgggctgcctattaggagcagctggcatttgtgcttaggatttacttcaagatgatcttaactttttctctagatcattttagctcaatggagtttacaattctaagcacctaaatagcagcattgcagcaggcaagcaacatttcaataacatagatatcctatatgcttctcagttaatttgttggaattataagctgcttcttttttaaaaagtaaaaacgtctcagttgtgtttttgaaagtttacaccgaaacaatgtcacctatggcacttacaccttatttacctgtattatttgagtactagacacccttgacatgtatatatacgaaggtacaagatgtattcatgattccttttcgctaaggttgatggaatggatgttgggatttccatggggatgaagaatcaaaatgggtctctcaagctgttcgttacagaatgtggctgtaatatgaagagcttggacatatcactgaacggaggagcatcttggttttatcaggggtacgtgcttcacaattttacatatgcaaaaacttgtcaaattaactgaggttgctctgtaaattgcttgtttggtcgttagatcagagggcgctcatcccttgctcagtccctgaaaatgagataacataggcttttgatatctgctctgtcaacaagccctggttcagtccctgcttcctccagcccttatcctgaaagaggatactttttcttccccactcatcttattaagcctttttctttgccggcttagcttccgtgcccagatagactttgactatactataaaagagagctagatgatctgttatcaagtgagaagaaaggctggtccagaaccaagcgaacaagggcttgtactgtcggaggttccaatggttccattcttgatctgatttctcgctatcttattcggtggcacaatacaaaacaaaatatgactcctataattgcccgatgtgggtagccatgcccattctaattctatttttctgtacatcagcaatatatataggaaacatggtttatatctgtggttagaatatcatgcaattttttttgtcaaaataattgccctatatattcctgaatgctgttgatatttatctgaccccacatggattgatattattcctcttaccttttctaggtttgtagatggtttcagtaatcatatcagatcatcagtagaaaatgcaattacgaagaaaataatggagggtgcatcaaagcttgactcattccttggaagccttccaaagaaaatcgatgttgatagcatcgctgctatgaatgtgacatttgttagtgatccactcttcaagagttcctctgtggagtttgatatcgatggactgttcattccatctgataaaactgcagtttcaagacacatgcattttagaggtgtaaaatatgtaccacctcttggtagctcttcaaaaatgctatggatttcattggatgaagatgttttcaactctgtttcagctctctatttcaaggtatatcagaattcataagaaagtggttgttatcatggttaaaggattaaagccttactgcagatgtgtaaagttgaaggattatctgaacttgcttttgtcaaaagatatatatatatatatatatatatatatatatatatatatatatatatatatatatatatatatatatatatatatatatattacacaaaagaaagatatatattttgttgattgtgtccgtctagagtagctaacttgaacacgtgttcatgtttgaatggaaacaattattccctccgtcccagaatataagcatttttagagttggacatggttactaagaaagtaggtagaagtgaatggtggagggtggagggttgtgattggttaagtagtggtagtaggtgggaaaaatgaatggtggggagttgtgattggttgggaagagaatgttggtggagaagttgttatattttaggacaaatcttgagggctaaaagttgttatattttgggacggagggagtaacaaatatgctaatagctgtaaaaatatatattctaattgatatgatacttggattgttcaggctggttcactacaacgtatggtggataaaattcctgatcagctcttcctgaatactgctagttggaggtttttgattccaaggttatatcagaagtaccccaatgatgatatgctgctgaatatttcagctacttcacctccttccgtgaggattaatgtgggtaggattgatgccgcagttgacttagatgtcacagttaatgttttggattttgatgagatagttccagtggcgtgcatatcagtggtgagatttttctaataatttcctttcctgatttcatttgatttcattgctagttgcttgacttatggaaagtaaacatattgaaatgtaacagtattgcaccatctggcagcacttgtatactgtccgtgttgtctttgaccttcagcatttcatattttctcccactgagaattttagaaatgaaatctatggcacattgagttgtgttcatgttttctttttttgtttcatccgttgatttacaattggacttccattatacataaacatttctacacgaggaaacacgtgcaatttccacctctttgataccgttgtcgcatattgtttccacagtcagttactgtctctggagctgcagtggtttctgggaacaatcttgctggaagagtcgagttagattatttctcattcaccttgaagtggagcaaagttggcaaacttcataccttcatagttcaggtattttggcctgtattatacgatttaatgacattccacagtttgtaatttatgatggtgtaatagaaaagaggtgagcttgggaatctccatcctatatttatggatatgcctaatttccaagagggactctgaggggctaactaagacatgcgttatcctattggaaagaaaaaagtaatttcggttgaaaatgccttcttcataaagttcttttacctagtatagcggaaaggcctaatttctgaatgaagttgttaattgtggagctgcacatgtattttattatcattggtgaacatttgtttcttaacttctgaatgtctaattgattctaatttttgtattggcagagtgtgatgcagatcttgttgaaaaaattgtttgtgccctatgtgaattcatatctcaaaagaggcttcccattgcctatcatcaaggggttctccatcagcgatgcatacatcctcacttcccagtcaagaataattgttagctctgatgttgccttcatcggaggtcatactccctatttaagccaatgaaagcat

SEQ ID NO: 4682 - DNA, 10786 bp, Oryza sativa
ctttattttcagtgtagctgaatttgacattttacactatcaaaataaataaataaacaaatagaatttggcattttacaggaagctccttgaggccttgagtaatcaggggtcagtgactctcttcctcctcctcctcctccaattggaaaaacaattttaggataagacaggggctaccccgcaaaaatgactctccgttatcctcgagtcgagttccccccaaaacccagaaaaccccacgacgccgtcgccaccgttcgtctccgcctccgcctccgccgccggaaatggcggccacctccctcctctccctcccctcgctccgcctcacccaccgcctcctcgtccccgcgtcgtcgtccgccccagcctcccgctcccagttccaaacgctcgccgcgaagaaggcagccgtcgccacgggcaccggcgagggcggcggcggggggcgtggagcgggcggcgggctgctgtcggtgctcgaccgggcgatggcggacgaggaggagtaccgccgggcgcgcgcgcaggtgcaccgtaagggcgtggaggtggaggggtacgccatcgagggggtctccgtcggcgggcacgagacctgcgtcaccgtgccgtccctcaacgtcgccttcgacatcggccgcgggccgctcttcgccgtgagccaggactacctcttcatcacccacgcccacctcgaccacatcgtgagcgccccgagccctgtcctggtttgattcattcctgtgctgcttgtgcttcgtgaatttcgtgtagaggcaactgcgcctctagctaagcttgggtgcgccatcggtgaagtttcatagaaaagctgatgtaaggggattgattcagtaatttcaagggaattgtcaccggggaaatgcctgcttaatttactatttggactgtggcctttagtaaatgtctgcttagtttatttgttcaacaacatgctatcgtgaattcgtgatggataggatttttatcaccaattcttctgataagttggcctaagttagtctgcgtgtaattcttaaataataaatagtctcatcttgctctatacctgcttttactttggagcggtgtcaagaaaatcatgattgtgccaacatatttctcctttgcatagcaacgggagaattttccaatgtttttccctttaaactgacgaatatgcttcactgtcagtttttccatttgctgctctaacagaatcacaacataaatgcagccatatccacctcagttttgttattttgattgttcagggtggtctcccaatgtacatagcaactcgtggcctctataatttgaagccacccgttgtatttgtaccaccatgtatcaaggatgatgttgaggatctacttcaaatccatcgtagaatgagtcaagtcgaccttaaagtggaattggttgcgcttgatttgggtttgagctcgtttcacctcttctttctgtgtttctctctccttgtttatttctaatgtttctacgattgcattcaggggagacatttgaaatacgtaatgaccttgttgccagaccatttgagactcaccatgctatacccagccaggtataactccctaggtcaatttaagtatagttagcaagccaaaagttctagttctcacctttcttggacaatttagtgcttaataactatttcgccccttgtgcgggttgtgtacattcacagggttatgtcatctactctgttcggagaaagttgaaaaaacagtatgctcacttgaagggtaatcaaataatgaaaatgaagcaatcaggcgctgaggtcagctagcaatctgttctatataagaaatatattctgcactgttactcactgccttcttttctgtcagattacagatactatactatatccagaagttgcctttacaggtgacacaaagtctgattttattcttgacccacgaaatgcagatgccctgagagcaaaagtccttataactgaggtattggctttagattttagtttccttgattattgccctttctcccaagcctgtcaaaagtatttgttccagctgtatgtaatcagtcacatttagagatgtaatcattctcatgggacatgtcaaagtcagcaaaaagggtgtgaagtataatactccctccatcccataatataaggcgcgcacgaatttcaagattcaacctttaaaacatttgaccaacacttaatataatatgaaaatgaattttgtttgttaaagattacatcattagattgagatctaaatttactttcatgtggttataattttgttgctacaaatcttatagtatatgagaaattataagctaaagattagttttggagaccgtgccaacattgaccacaccttatattatgggattgggagagtagtataatacagctatagtcttgaaatatcagagaacagtaaaaggcagtctaagtaaaaccaccctattatattgatttgtcacatcttcagactgtaaaataacaaaagaacttcctttttatttgatcagagggtccatcaaatctgaaacatgacaaaataatttcaaatgtcctccctattgaatgctttggcaccaacattatttgaccttttcacaggcaaccttcctagatgaccaaattgatgttgatcatgctcgggagcatggccacatgcatctctctgaggtaaatgatgatgcacttgtcactttctccctgccatgctatgattctaatgagctttgggacaattctgatagttaaatgagatgtctgtataaagtattactgcattaatgcaaatctggtatgtcgtctacagataatggagcactcccaatggtttagaaacaaagccattgtactgacacatttctcaaatcgatatagtcttgaggtatgtaatcactaacctataaatcattgggaatccagtgtttcctaaaaataatagttgcggattctagactaatctgacccaaatgattattttgtaggatattagacaagctgtttccaaactacagtcaaagttatcttcaaaggttgttgcactgacggaaggcttcaaatctgactatagatagtgtatagaagtaggtcagctgtgcttctcacccttacttgctgagaataacttgagttacttacactaggaattggccattcatgaggaaaaagggacagaattaataggtttgtgctgtttggcttttgtatgtggcatttatatctcctatctttctatattagaaaataaagtttatatagcattataactaaatgattattgtgatggaaaaatctatattatacatgccaaaggtgattcagtaacatacataacattttcttgacactctccagcttccagaataagaaaaggttagctaaaatctctctctttctgctgtttttttattccccccgcccccccttgtactatctctctcatgtacatattatattttaatatatcacagtaggagcctattctgctgtttaaccgtctaaaaaaaagaataagaaaaggtgtaaaaagctgggtattacaatacgttggagaatctgaaggccaaataaactgaaatcatgaaacgcatacatctgcatgaaatccaataagttgtaaaatatcgtacagtttcatccttgaaagcaacaagcaggcatacacttctattactgtgtactgcgtaccatgagtacgttctcttgaaaaatagataagttacgagtttgttctgaagtgtcgtacagtataatccttgagaagcaacaagcacccaagcaggcacacactaatattactgcataacatgagtatcttctttggaatagatcaaccaatgagtttgttctttgaagcttcttttcttgtattcttttttgctaggtacatgagagcagtggcagtgctgctagtatctggttttagcataacggattttccttgcatcaatgtcttgttcacttacatgttcaacagattcgtcatcagtggagcaactttcaggatcttcgcgtgcgggaatgatgaatatgtcagattcatcaggtaatctgaagctaactctcctcatgctgttttggctcctaatagagattctatcgatggagaagctgtcccggatgttaggagaattattttcataagaacaatccgggttaattgggcaaacctttggagagtgcctccgaggtgatggggctccaattgcctccccctgaaagctctgaggagaatacaagatgtcttgaagagtgttttgccttatttctgccttgactgttctggtcttgttatgctgctgctcctcttgaaggcatctgggcttcattctgttgaatagtgctttaacatggcaacagctctgtgagcccatcttttccctctcttctttggtgatgaacgatagtgtcatggcaaatgcgcttatatatgtccatgctccgtattgtgttgggcaagtaaaataatctgttttgcatatactaggttgtgtcaaaccttgttcatgtcaaagtaggacgaattatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactacctcaatacttccattctaacattttctatatttatattaatgataataaatctaaatagatatatatgtctagattcattaatatcaatataaatatagtaaatgctagaatgacttacgttgtaaaacagaaagagtagtatactccagccaactactaactctaaatcatctatagtctatctaataactaatttatactagttaattacaaatatataatacaccatgataattggtcctacatatcatatatatatatatatatacacacatatatatacacatacattttaaagttcgtgctacagcgatgtatatctataacccgtttttcttctctcctctctcttatctccttcacgtatgtttatactgctcttattacctccggtcaccggcacgtacggacgtgacgacgtcgcacgcgcgcgcttataaatgcagccatacatagtgcgatcgtttcgtggccagagagagagagagggggagagagagagagagcagagcttgaactgaccggccggtgcagtacaaataaaaattatacgagcaatcatgtggttgctgccgctgatctgcttcgtcttggccttgctgctcgccgccggcgccagcggtggtggtggtgccccggctggaggaggaaatggccgcggcggccagcggcgtggggtatacgtggtgtacttgggcgccgtgccaccggggacctcgcccaacatcctccagcagacccatttccgcctcatgggcgccgtgctcaaaaggtccatcgtaaaataaattaatttttaactctcttcctgttggtgctaatgtctctcaagttgcactagctagcagtagcatgcatgtcagtcaataagaaggtactcgctcagtttgccgatttgtagcatggcattaaatatattctctccgttttatattagaagatgttttaatttttcaaagttaaatttctttatatattagaagatgttttattttttaaagttaaatttctttacgtttggtcaagtttacggaaaaatgtaacaagttctacgatactgtgttagttccattcaatctaaatactgattttttaaaaaaaaatcacgatagacatacacacgccactacatacgcagcaccgcactcacaccctcacaaatggacccccccctaacatatgctctaagagatagaaaccaacggcacatccttgatctaacaaaaatcctgttaaaaagcacatgcagaccatcgacatatcccttatctcactaaaattctattaaaagtctacatgcatgtgcataatattcgtgggcaccagaatttgaaccctggttagtagaatcatacactcacgactccgctaccacaccactagtgtttttccaaatattgaatatagtacgattgtatagtataaaaactatttatatgtttttcttgatcaaacatatatgatttgacttaaaaaaacaaagcatcttataatgtgaaatagaggtagcagttttctaaaaaaaaactccatataaattaaaataagcagacattgttacgttaatttaaaaacccgtgtacacttctctcactttgctacagtgttgcacttcttgttaatttaacattgtctttctctttaactattttcaatggttgaagattattttaatcttactatcgttatatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcagcagtacaagtacgccttctccggcttcgccgcgcggctgtcagcggcggaggccgccgcgctccgccggaagcccggcgtcgtctccgtcttcgccgaccctgtctaccacctccacaccaccaggtcatgggacttcctccagcagcagacgacggccgccgtcgacgtcaagactggcggctccgcccaccgccgccgccgctcgccccgcgcccgcgccgccgcagcatcagcgtcgacgtcgtcgtccccgacggccgacaccatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttgtgtttaattaagtttataaaaaaatagcaacatttatgatacaaaattagtttcataatttgacgtatattttgatacaatgttggttttacattgaaaatttactacttctactccctctgttttaggttatgactttggtcaaaattaaactactctaattttgactaattttatagaaaaaatagtaatatttttaactcaagacagatatattatgtaaatttattcaattatagatttaacgaaattatactggtattgtaaatattatacttttttctataaagatagtcaaatttagagtagtttgattttgaccaaagtcaaaacattttctaatctgaaacggaagtagtataatttggtcacttaaaaaaattaactaagaaaaaagtcattacaaatgacttgtaatatgaaacggagagtatatatcctgatgtttcccgggcggcgcatgcaggaagctgataggagcaaggtactacgatgtcggcggcgaggcgaagcggcagtcagcacggagcagcgggagctcgccgcgggacgaggccgggcacgggacgcacacctcgtcgacggcggccgggaacgcggtcaccggtgcgtcgtactacggcctcgcggcggggacggccaagggcgggtcggcgtcgtcgagggtggccatgtaccgcgtctgctccggggaggggtgcgccgggtcggccatcctcgccgggttcgacgacgccgtcgccgacggcgtcgacgtcatctccgtctccctcggcgcgtcgccctacttccgcccggacttctccgacgaccccatcgccatcggctcgttccacgccgtggccaagggcatcatggtcgtctgctccgccggcaacgcagggccggacgccgccaccgtcgtgaacgcggcgccgtggatccttaccgtcgcggcgagcacgatcgaccgctacttccaatcggacgtcgtgctcggcggcaacaacaccgctgtcaaggtatatatcacaaaattaaatatatctggacatgttctttttcccagattcgttgtattagaaaaaatctcatctatttctaatatctcatccgtctaaaatccttgtgggagcactctcttgtgatcttaactaccccatttttatggaatctgtagggtggagctataaacttctccaacttgaacaaatcaccaaaatatccattgatcaccggtgaatcagccaagtccagctcagtttctgataccgagtcagcaaggtacgtactacaaggcaagcttagtaacgaaacaaaattaaattaacagaaagtttcagcagaatctgagtaagtagtttcatgcccaaaaatcaaatcataaccacaaaataatttgtagtcactgtgagccggggacgctggatgcgagcaagataaaagggaagatcgtgctgtgtcaccactcgcggaacagcgacacgcccaagacggagaaggtcggggagctcaagagcgccggcgcggttggcgccgtcctcgtcgacgaccttgagaaggccgtcgccaccgcctacatcgacttccctgtcacggagatcacctccaacgccgccgccgacattcacaagtatatctcctccaccaggtactatacgtagtccttcacactatagcgattatatactacctccgttttttaatatatggcatcgttaactttttaacaatcatttaatcattcacctttatttttttttcaaatagaaaaatatttaagttatatttataaaacatttggtaataaatcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacatcctcaagccggacgtggcggcgccgggggtgaacatcctggcgtcatggatcccgacgtcgacgctcccggccggcgaggagaagccgtcgcagttcaacctcgtgtcggggacgtccatggcctgcccgcacgtggccggggcggcggccgccgtcagggcgtggaacccggcgtggagccctgcggcgatccggtcggcgatcatgacgacggcggcccagctgaacaacgacggggcggccgtgacgaccgactcggggtcgccggcgacgccgtacgaccacggcgcgggccaggtgaacccggccgccgcgctggacgccgggctggtgtacgagctcggcgaggaggactacctccagttcctctgcgactacggctacgacgcgtcccagatcaagctggtcgccgcctccctccccggcggcttcagctgcggcgccggcggcaacgccagcgacagcaaggacctcatctccggcctcaactacccgtcgatcgccgtcacggggctcggcaaggccggcggcaccaggacggtgagccgcgtcgtcaccaacgtcggcgcgcagcaggaggcgacctacaccgtcgccgtcgcggcgccggccggcctggacgtgaaggtggtgcccggcaagctggagttcactaagagcgtgaagaagctgggtttccaggtgtccttctccggcaagaacgccgcggcggcgggccaaaggggacctgtttgggtcaataacgtggtcggatggaaagcatacagttcgtagcccattcgttgtcaccatctgagag

SEQ ID NO: 4683 - DNA, 9404 bp, Oryza sativa
atccctaacccccttcccccctcatcattccagcaccgccgccacctctcgcgagctcgtgcgcgtgcgatgccttcgccgtcccgccccacactccgccagtacccagcctcgtcggctggcaggaaggggtcaacgatgcaggtgagccccccctccccccaccccgaccaacctccttcccctctacctctcttccccaaccgacggcctaagtgctcctgccccgccatctaaaacttgagaagtgaagccacgccacatatttcttttgtcggcaaccacagatttcacaaatggagacttccctattgtttgatcgttgaagtgtctaacgggtctagctgtgtttcagagcttatttggtggctccacaaactagatttttttataacgaaaataagagtaaattttagaaaattatagatactttggtcaaattaccttaaaactacagatttaataataaaattatcacaaaactatagattttcggtttaaatccttagcaccaatgttacgtttgggttataaatattcaagttttgcgatcaaattgacattaaacatgtagttttgtgataagtttgttactaaatttgtagttttgcaatattccaacttaaatatgtagttatgtgataaatttagggttaaatatgtagttttgtgatacatcatgttaaatttgtagttttctgataatttggctaaagtaattgtagttttatgagatttactctaaaaataatttacatatccgacttagtatagcataagttataagtttgtatagaacttaaaaatttcgactaacatggcgaggctgagtcagcgtgtgacatgtcacccccacatgtcaaggacctgtcttattggtttccccgctcttccccatctttccagggcggccacacgccgaggagaagggcagcggtcagtggttgggggccgacgaccgacgggaaaggagttgtgcacgcggcggcaccgagctcgagcggccgcctcatctcctctcttcgcttacgactgtgaccacgccctaccccaataactcccctacactgctcaaatagccaccttgtgaggacgccaagaggctcaagataaagattgagacgacgacaatagcaatgcgcacgcatgagagagaagagatggaggagctagaggagaggaggcaactggttctccgttgctctcctagactatcagttgtgcattaggagagattgaaaagaagatgatggagaagacgggacaaagagaatgttttccatcctcggtctatgttggcaatacgatgaaagtggcaaaacatggtaatataactctaaacgtgatatatagagattaaccactttggcaaatagctatataaacatttgataattttggggtaaaaaaaactttcaaatataactatagtgtaaatgagatgtaattatattttttaactatttataatgtaacttatacgtaactcgcatataactaattaaaaccaaccatatttccagatggctagagatggaactttgcaacttgctggtcgagggtttgattcccttttgttttctcctggaacgaatgtcgccggtcataaaattgaaagttttggaagataaaaactgatttgtttttttcctttttgttttggaagataaatccgacggaaacaaaattaaaagttttgaaagataaaggttgtcattggttggccaattgcaaatgatacgccaaacaacattttaacgataaaaaataatttatgattaaaacttttaccaatgtattcttaatgactttaacaccaacgttagaaaaaaaagtaagataacaacatcaaaattaacttgaaaaataatttttagttatgacattagcatatacaactttgtctaaaaaataaatcctaactacgaatctgaataaatgcgtgtcaaggttcgtagttaggattgagttttttatgagacggaaggctagaaggggtacgttttagggggaaaagacgtggcccaaacactttggaggtttttttagcaactacagaggaagcctatgcagatgtgtgggcaatttatttattgttcataaaaagaatactaaaagaaatcatatcttgctatattcattataagagccctagattaatatataatgtttaaagaaaaaaatatttaaatagatcaaagatatgcactaaatgaaaatggctatcatattctaacagaaatcactttgtcttagttatatgtaaacacataagtgtttttttattaggtagatttaaacccagtcacattttgttaagaaagcagctgggttaccaggcgttcatgataggccagatcgttgctatgatggttcatacatgttcatgaacttaatgtttttctcgcttattgaatgtagttttgtgtgctgacttttttctcacaaatgagttgtttgttcataagtataattttcaacgtttgcatgttctctgtaaaattatatgtttaacactcatactaaatccttatattgtttgttgcgcgcatccacttaattgtagggcttgttcattttgctaccattttcaaccttaccttttgttttttgcaaaattacccaaaaagtggctacatttagttgttgtcaaattttagtaagtacatatgaaattttgccaaaatttggcaaccttgccaaaattttgataaccttatctaaatttagcaatgctaaaacttggtaaagttaaaaatgatagcaaagtgaataagccttagtacaaactcttagtacaaactaagagtgaaaggtcaaaaggtataggtttcttcactgtcccaacatcattggtgtttactcatcttggtgtattattgttagatgcatgccttttaaattgtggggtagtgaaatgcttgaaagttgaaacgtgaaagcgtcactcatacgcatgcatactgctattctggcgatttaccagttactagaatatcctgcatagttaatcaataaaaaccattgttttatgtggaatcctatatgcttatatagttcatccccactaagtgtaattaatgttatttctctcttctatcattaagtcacgtcactccaattatttttagccattggatgatagatctatggttcaaattgtcttctttcttctctcttttcgggaatacgcaaggagcgcatttttttcattaagagaaataaaagttatttacaatgataaaaggaaaacaagcaggggaccaatacaggatactatgaaaaactataggaatatctcgcgctaaatttggctaccacgacctcgtaaaggccaaacagcggggatcccgtgattagccgacttccaaagcatggcctcctctgccattgctttcgccacttcggtccaagacctttgttgttgattgaagattcggttgttctgttccttccaaattatccaagtcaccagtgtcacgacttcacgatagtgtcacgaccagtgtctcttctttcttctctcataacaccaagtaatctcaattatttttaggcctcaaaattcataagtaccattttgttttatttttaatattcatatttcatcttatttgtacatattgtgcaacttaatttcccgcaacaacgtgacagagtatttatctagttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgtaattagtgtatgtttaatactccaaattagtgtccaaatatccgatgtgacatggacttggaacaagtcgctggaaatagcaaaactgaacatcttctgtatcaacctgaaattacgcagtatttgtacttcagtactgctagaggcaagatcaacaaagaaagccatgggagttgtggaagcggcagcggcagaggcagcaacattgatgctacagagctgcttgtagttgtagggttgtattacatcacgaggtcatgactcatgtcaaatgaataattgggatcaggataaagatccaatgcagtcataacagagactgcaactttgccagtagaaactcttttccatccttggatcaagacaataacgactgaaaccgacgctacagtgtagttttaaacattatctgctacagttctagctacagcctacaggagaaaccttggtactgtcttttgtgaacagtattcaggaagatttcttttttttttttttttgagttgattcaggaaggtttcggatatcactttctatagccactgcaggtgatcccaattcatctaacacatctcacctcatcttcaaatcaaacacatgctaaacaactttaagtggtaaagttgtatgtagtttgtacacatgtagtaagatcaccgtgggaagctcgacgatagcaaaaaatcccgctccatgttgtatagcttgctagtagtgtcggtattgctcagttgaggtggtagacagtgcagctcagctgaaagcccttgcaaaatgtcaccgcctaacagcctttccagccttatctccacttgcctcattgttggcctctcttcccccttcaatcttaggcatgccgatgctagcgccgcgacttctttcacattttccatgccctccgaaattacctgagggtctaatatctcgtagatgttgtcctgtaccattagcaaattaaaaagtgcaattaggctgacattatctgatgattcaaaaacagtaggcttcttccttgtgagcatctccacgagtatgacaccaaaactgtacacatcactcttatcggtcaatctacttgtttgatagtattcaggatcaagatatccaaatgtgccttggatcactgttgtcacaccaccttgatcaaccggaatgcctcgagaggctccaaagtccgaaacttttgctgttaagcgaccatcaagcaatatgttagcagacttaacatccctatgaattattgatactgaagcggatgaatgtaagtaggctaaagcgcttgcagcttcaagagcaatcctcaatctatttttccatgacaacaatgtagggccttcaacatggagatggtcggaaagagtgccgttcgatatgaactcgtagaccagtagtggaacctgtgtttcaaggcaacatccgaataaccgcacaacattccgatggttgatctgcgaaagaatgacaacttcgtttatgaaatcatcgatctccttacgaaccgtaatattcgatttcttgatggcaacgacacgtctgtctggcaaggtgcctttgtagacagtgccatggccgccgctgccgagctttctcatctcgtcgaatcgatttgttgccttttcgagctcttccaaggtaaacaccatcctttcagcaatcaccttatcaacaagttgcagcagcagtaaaccccggttctgcttgaagaatacggctctcagtttcttggccctccgtgccttgatcatgttcgtcattgccatgcctatcacgaacacggatggaattcctatgccgatggttcctcctatcgccacaaggagagctgccagcagaagatacggtcaaatttctgaaccctgtttgtgcaaggatttgcagagaagattgcaaggataaatttaagttatgaaatgaagagaaatttctatgtactcgttggttcacatcctccttcgttcatagcatcaccgtgcgtcccacccggacacatgcacgaaaacgatcctggcttgtttgtgcattcaccgtagcagggatattcttctggcagagcgcactcgtcgatatctgaaagggagaatttagaaaaattttgtaccattctgttctaaattccactaatcatttgaactatggttggtaagccatagaaaaatatactaaacgaacaaaaataatttataaataaaactattaatagcggtttaaaattttaacggcaaaagattgactataataagaaaactaaaatcaactttaaaattaggttttaaattttagccgcggctcataatctagcaagcaaacgatgagaggctatacttatgcaacttcaagtgtaaatgactaatccgttaaacacacttataagctaaaatattaggaaatgatttaatatcaaactaaatagaagggtgaggcatcgaacccagaacagctagcccaccaccttgtgaagctaatcagaagaccctcagttgtttctccacttacatggttacacccttatactccctccatccctaaatgtttgacgccgttgactttttgaaatatgtttgatcgttcgtcttattcaaaaaaattaagcaattattaattttttcctaccatttgactcattgttaaatatacttttatgtatatatatagttttacatatttcacaaaagtttttaaataagatgaacggttaaacatgttttaaaaagtcaacggcatcaaacatttagggaagtagggagtaacaaattaccttgacatccatttgcaacgtacggattgccttggtacccgttgtcgcactggcacgagtagccgccaagcgaggtgctggtagagttgcggcagtagctgttgctgctgctacaggccgtgtcgtcgggcccatgcggcggacaccccgactttccgatcgcccagtcgagcacggccagcgccaccggcatgccgccgccgcccggtcgcatcgtcgctgctgctgatccgagcttactcgcgttcccgccgaaccactcgttgtccgcgacgaacacgagagccgaatccgattggttagacgacgaggcggaggaggtcggcggcggcggcggcggcccggtgcttgtgccgaacggcgacagccgaacgccgtacgacgtgaggcctaggtagatggaagcctggcagcagccaacgcccgcgcacgagtaatccgcgagctcgccgtcggccgctgctggccaggtggcgccggcgccgccgcagatggtggtgcacgcggcggcgatgtcgtcgccgtccaggaggacggcctgcaggttgcaccccacgacgacgagccggttccgccgctccctgaggcggaacgcgccggcgaggccgcggccccacgcgccctcgcctttggcggcgtcgtaccggacggcgctgctgacgatcaccgtggagtttaggagggatatctcgagcacctcagcggcgtcggcgtcgcgcaggaagagcttcggtgggtggtaggagcggttgcaggtgacggcgaagccggcgaggtggcagccggcgccgacgccgaacgggtaggggatgaccatgctgccgcacgagctcgggcagcccggcagcgatacggttagcgcggttgttgccgccattgttgcagcttggagaaacagtgcagccataccaaggataacaggagagggcgccatggagctgatcgattcagtggctcgatcagcagaagaaatactgaagaatggctcacccaagacgaagagtatatacgtccacgggttttgcttgacctgactgaaggagtgaagccacgccacagattttcttttgttcggcaaccacagatttttcatagatggagatattgatatccgatcagtcactcagtcatcgtgctagatcagtacacgccgcgttttctgaccgtgctgtttaatttgtgactttactagtaacagtatatggggactggattctaatagtacatggggagtgtctagatagttactcccttcatttcaaattgatcatcatataatgtttgtgcaccaagactaaggattatttaaactacattagtcaacacaccatacaaaatatacacacattctcccatgatgcatatagtatcgactaaaacacaagcatacaccacattatacgatgttatattaattgtattatgatgaaatccatatgtccacatggttatataatgatcattttgaaaaaaaaatgattttccttatgtgatgttcaatttgggaaggatcaaagggagtataatgttgtgatgatgatgatgatgatattggagtagtagactactacccccgtttcataatgtaagactttctagtattgcccacatacatatagatgttaatgaatctaaacacatacatatgtctagattcattaacatataaatgaatgtagacaatgctagaaagtcttatattatgaaatggaggaagtatttactgttacatgctagtttgttctagctcatccttgttctttgaaaaacaaatcacgaagttgtgcaagaaaaaaaactcaaaggcttaatcagtgctaaaatctgcgtgaattgttatgattttttgaagagatcctggcttcgtcactagtaagtagttacagatcagataaagatgatgatttagcccaaaaggtgttactgatcacactacttgtactttccgcaagtcatgcactcgatcaaatcggcaaaacttaacaactatatcaaattatcaaccagaagctacgggaccacctatatatttgtcgacaaattttcttctaaaaatttaacatatataattatagtacaatcgtagtgtaattacactgtaacttatatgtaattacactgtaacttgcatgtaactacagtgtaatttgtatataagtttcatgtaattttgaatcattaaatctattacaagatttgttttggtgaggaagaaaaaaaatcacagcatacagtataattacactacgattatactgtaattatatctgttaaatttttgggagaaaatttgtcgataaatatataacaaaatcgttttggaaggcccgtctcttccttcccgccgattccattccattccacccgcgaattctaggcaccgggccagtgcccagtgggcccctcgattccaggcccaatctgacccgtcggatccacagtcgaacgcatctggaccgcccgtctccgcggtgggcccagcccacaacgggagggaggagaggagagaggaggcgactcgctcgcccgcatccgcatgacgcgcacgggaagcggccgaggcgagcgaacgcgagacgatcgagtcggaggcgaaaaggaagaggagcgatcgatcgatcaatcgcgagggggagtgggagcggctgcaggggaaa

SEQ ID NO: 4684 - DNA, 2128 bp, Oryza sativa
  unsure (1)..(2128): unsure at all n locations
atcgatgctggtggtctccttcgtgctcggccacgtcctccgccgccgcaaggtctactacatccccgaggccagcgcctccctcctcatcggtatgtgttcccacccagttacagcattttgggcttgtggaaactgaagaatgccgatcgtcgctgagggtcctatcgattcatgtgtctgacttcgcgatcgttgtgtatttgcgacgccgtgcgatgctttgagctagcgcatttgatgcgggggtgatcgtgtttggtgttgtttactgacgccgaatgaactgtttattcacacgatgtttagtggcgagcagtaacggtgtgagtgtgtgattaggaggaacggcttcgactgtgcgtttatgcacaaatcagacgaacaaattttgcattcacgacgcgcgctgtagtctagttcgagctgtgcttttccaaaatttactgtcgatggttgaggattggttgtaacaggtgagggctttggaggataaaatgaacctttaaaaagttggcatgtagcgcaaacagatgtcttttccttcagataagcgtatttccgttacatttcagtagcttagcttttactgatttctgattatctaagataagtgatgtgacatttgggtttattctagctacgttttatttggatcatccggtggattatcatatactatttgccttggaaataaaacaccctagctaagatggatcttaccattttatttaatagtttgtagagcctagaggtacattgaaaatgttagaatcgtatgacaccatattattacgaaattatttaatagcttttcttgtcagggatgattgttggcggccttgctaagatatcaaacactcaaagaagtattaggtgataatatttcttattactcactgtatacaatttttccctgcaaaatatgacatcgctgttaagtctgaacattttgtggtgttcatttgctttattaattcaggagatggttcaattttcgggaggacttcttccttcttttcttacttcctccaattatattatatccttttttgtatcttgattttgttttttaattacttgtacggaaatttaccatgttttacttgactgaatcttactcagtctggattcagcttagcaccagtaagtgtggaattcttggatcctcttagttagttaaattctactcttcgttggttaaattctatcattctcagctaattatatcatattttttcctgatagaaaccattcttttcaaattttggtgccattataacatttgcaatcttgggaaccttcattgcttctattgtcactggtcttttagtgtaagagtatcttctatattgcctccattcctattcgctgatatttatttcatctataaaaatgtaatttatatttttccatttgtcacagatacgttggtgggttaatatacattgtctataagttgcctctggttgagtgcatgatgtttggtgctctggtgtcagcaactgatcctgttactgtactgtccatatttcaggttccttccatatccctatacagactatatttacaaattttgagataaaaggatcacataatgtccatcaaatcgcaggaacttggcactgatgtgaacctctatgcgctggtttttggagaatcagttctcaatgatgctgtatgcataaccctattattatttaatactagctgtttttttttatttctactgaaatgtgcatatttcttcgtgtctaactacggtttggaaattaaggtggctatatccttgtataggtgagaatgtattgcctgagctccttctgcctatatggctccttctcagaatcctgtcattaacaccttgaacttttcaggagtatggcttcactgagaacaagttcttctggacagaactattttctagctatccttaagtttcttgagaattttgttggttcaatgtcatcaggtactgtaccttaaatatttacaaatgcctttagcagaagaaatttcgagtcgcctatgtattttgctttttccattggatttcttgacttcgcttgcacttatgattatatatgagtatnnnnnnnnnnnnnnnnnnnnnnnnnnnnnnnnnnnn

SEQ ID NO: 4685 - DNA, 5532 bp, Oryza sativa
  unsure (1)..(5532): unsure at all n locations
nnnnnnnnnnnnnnnnnnnnnnnnnnnnnnnnnnnnnnnnnnnnnnnnnnnnntgtccatatttcaggttccttccatatccctatacagactatatttacaaattttgagataaaaggatcacataatgtccatcaaatcgcaggaacttggcactgatgtgaacctctatgcgctggtttttggagaatcagttctcaatgatgctgtatgcataaccctattattatttaatactagctgtttttttttatttctactgaaatgtgcatatttcttcgtgtctaactacggtttggaaattaaggtggctatatccttgtataggtgagaatgtattgcctgagctccttctgcctatatggctccttctcagaatcctgtcattaacaccttgaacttttcaggagtatggcttcactgagaacaagttcttctggacagaactattttctagctatccttaagtttcttgagaattttgttggttcaatgtcatcaggtactgtaccttaaatatttacaaatgcctttagcagaagaaatttcgagtcgcctatgtattttgctttttccattggatttcttgacttcgcttgcacttatgattatatatgagtatctatttgtactttaacatttgatatttcaattccatttttttatgtgcaggtgttggggttggattcatttctgccctcatatcctttattttgacattttctatcagtagagacctaatgtatattttttatttacacaaagtaaaactgataaacttgttacatgtatgtgatggtatcacctagttttttataacatatattaaattagtttaatatctgtaaagaaatgtatacctgtttgcaccctcctgaaaatttatttttgttccaaaacactgtaggggaagcccccacagttaaagatttattaaattgaaaaggaggaaacaattacaaaagttcaagcaaagagttaaatgctactctctcagaggggtttagtctatgtaatcatcctgaattcccactttttgctatcaaaacttagaatactcctgctggatcctcttagaaaccaatatgttattgttgcatgccttgagcattacctttccagggttgacaagaaaattcaatatgtttaacgtgtaatcatctttttggtctatttacaaacgttttccatttactctggagaacaaaaaaggcaacccccaccatgcaacaatatttaggctatgtacatggccagatcaacaacttcattgccaacgacaataagtcgaaaaagaaaattttaaaaaattcttgcaaaaacaaaacaaatgcattttttgaacttcatttttgcttatattatgttatccccgttgagactcaattgtcagtccttaattctatcaaacctcttcaagtatgcagctctaggtgttgagaagtaagtacattccgatttgcccaaactagtaccccacacataaactgctaatttattttttttttcacttccagccttcataatctggagagttgcttgtttgtccttttcccttacttctcgtaagcctatctttgaaatttgttccatttcatgttctctttaaatatctgctgtaaataattgccagttgtttgtaggtacatgctagctgaaggctttggtttgtctggtattgtctctattctgtttactggaattgtaagttagcctgtgacaatattttctctagattttattcttattacatattatagataagcaactttgcaggaagatattataaacatgcttacaagaagtgaatttttatttcaggttatgaagagatacaccttctataacttatcagaagattctcagcgttttacagctcgttttttccatctactttcatcactagcagaggctttcgtgtaagcaagaccttcaagtgcaataatttaacaagtccaaatactgaaactgtaatgcatttacacaggttcatatacatgggatttgatattgcgatggagcgtcaaagctggtcacatattggattcatttttttctcagttgtatccttcgcattgattacacaccaactcttacccatgcttgttacgaatacaataatttcttcttgtttccttaatttttttcccttttgcttatgcatccagatctttatattacttgcaaggtattttcttctccaacggaactgtctatcttttggtctgatgttggactagttgctgagtttttggagatgctttctgtgtatttatacaagcttaagccccatagctatataattgtgccgattttctgatattatcttattttaaagggccgcaaatgtcttctcttgtgcatatatattaaatttggcacgaccggtgcactgccaaatacctaggcagtatcagctggcactctggtatagtggtatgtaattatgtatgcccaaaaatgtcataaaataagtttcatgtttgtactgctaatattgttggttttttctttttcaggtcttaggggggcaatggcttttgcccttgcacttcagtctattcatgatcttcctgaaggacatggcgagacaattttcaccgctaccacatctattgttgttctaactgtaggttaccggttgtaattcttgtgatgttacataatagccacgactatttttatgcaaaggattttgtatgtatcagttcatgctattctatgaatcattctaaatgtctttttatgcaaacattgcaggtgcttctaattggaggctcaactggaacaatgcttgaatccctgcaagtagttggggatagtaatcgctatcgccatccatatgaggcaagtacttacaccgcgtatcataagtacatgcaaaaaacattatatttctctttgtttgccattaggttagttaaacaacgcaatcttatttatttgctggacattctcagcctaaatatcaaatgacattgcagttctatggaggatgcaattccattgcattccatgcactctccccatagggcttatttggatagataggtattacacacaatctttggatggtcacgattttttttctgttttcttgttcataatgaattagatctattcctttttttaaaaaaaaaactaattggttctctcttgaggtgcaacctgcttgttctacgtacaaaaaaccagataatagttatgcttaaatgatcatcatgggttattatttattcaataagagcacttactaacggaccgttggtgttgctgaatgccatatgcaccctaactatgtagctactatccgtccttgtttatctttcttacagctcatggattaacaccatagcattccggtggtttgccagttattgatgctgtacttacaatatgcagcataactttgatgggaacaatgctggctaccctgggcaacgttacggggaagaaacatcaacatcaagcaatttcacaatgaaactcaaagagctccagagaaggtacagcagttcacatttgatattgaagttgtatctactcattgctcttctttagtttgatttctaaaatgatgaacttttcattaaaaaatttcattgtgttaaagtaccaaccagtagtagcctttagttgcagagtggtacttttctataatttattatgtagtattgctgaggagcaggtgatctcctaatcgcttaaatatattttcctgccattacagcacctcttctttcgctttactggacaagcattaccttactcccatttttacctctcaaaacgaggacgataacagtgacggcgatgaggatattatcagtaagaccaaacctgcattccatctttctcttaactttatagtcaagcaatatcaaagatgctttccctcatcagaggcaaagcagtattggcttacttttttctccatccttttccgttcagcatttattcctggtaaataactatatgttctggtaaaacaagcagatgaatcattgaggaatgaggatatgtagaggtcctgcagatttggaggatcatgaactcatgattattgaatgcaaacatgacgcacgaaaatttttcaagagctgcgcattccaatcaagagcaaatgtttgagccatcagccatgtatacgtcacacactaggatagttcgacatgtatgtaagtaaagaggatcataggtgggaatgtaagattcgctaggttatctgctttctttaacgatgaagtttgatgaaggcacttttgctctaatcctatttttgatctgttgccatgcatcttcatggagttcagtgatgaaacttgacagtattgcttttcgtctagttatgtagaatcagcctatgagaatactaggatgtagcttcaaggcatgttttggttgattttctggggaattttaccctaattaattcctgcaaaaatttctattccaaacgtgcacttggcttccggtcacaataaccccacttatgtttttttccccctaatatatcttaaccaagagttcctgtcacgtcaaaatattttacaatatagtctaaaataaattaaaaatatttttttctataaaatgtgttacacatccttttttctttttgccttaatttgatgattttatatgttttcatatttgatttgattgtttttaatattaagaaatctataagaagtacaaatgtttcttttatatggcctagcaccgaatattcccaaatttccaatttccatcagcttccatagcggattggaataagttcgtttgttgttcctcatctttacatcgagtttatttggcatccctaaattgcaatactatactcttcactcttttatctttgcaagaccgttcaagtcaagttctaagataatatagatgtctgttttggctgatgtggcctcacatgtaagttgactcctcacctcttccctctcttccccatctctcttcctctcccctctcttccctcgcagcttgccggcggagagagggctggcagccgacgagcccatctgcatgaggtaccagtggaccacctcccacgaaccaccagtgcccgctcttctcctccgccatcacctgcatgtccagcatgcttaggtcgttcagcgtcgccacggtgtcgatcttgccatcttgggcaggcatgacatgctttgtgagtgcgccatggcggtggaggcctcccatcaccgccctgctcgtgtgccccatccttcatggtcgagggcttgccacgccgaggtaccaatcttcgtcgccgatagaggcatggggtttgttcagattgatgtcatttcaaaccatacaatttttttttgatagagttgttagatatgtgcatccatttagtttcttgtcaaactttggtaaatacacaagaaaacctacaaaaaatttgacaatattgccaaattaccaaaaattgataagaaaaaatttggctacaatctaaacannnnnnnnnnnnnnnnnnnnnnnnnnnnnnnnnnnnnnnnnnnnnnnnnnnnn

SEQ ID NO: 4686 - DNA, 961 bp, Oryza sativa
tattgccaaattaccaaaaattgataaggtttattttggctacaatctaaacaaccccatcgagccaaaggcaccggggcacgttgcgtggtgggtgatcgtccagaacttgagcggtcactcctccaacctcatgatgtagaacctgcaaagtagaggagagaggagatcaaaggaagtaggaatatttcgccaaatcaagtactagaattagagatgcagagggcatatactactcccttgacgttgttgatttttaatcaacgttgatcattcgtcttattcaatatttttaagaaaatataaaaatatttaagtcatccttaaagaatattcaatgataaatcaactcacaataaaataagtaataattacattttctttaataagacgaatggtcaaatgtatctcaaaaggtcaatggtatcatacataacctatgaaaaccttagaatcattttttttctgactacgatgcctcctgctgccttatgatctggtttgaatggttttgcaaaaatcatttattgtactgcagtttaggaatgccaactgaaaatcgacgtaaagctgagggacagcaagtggacttattcctagcggatcacagattattgaaggcccgtgacttccccgagaaaaggcccagcagcaacttagtcaagggccactacggcctcgccggcttctaggttcgtgtagatgcttctagaaccacaggatcccttaaatactctccctcctcttccatctcgcgtcctcttggaaacccctccaaaccctagccgcctctcgtttcttctcgtcctctccacgcccccgagatcttaggagcacaggaggaggaagccatggcgtcggagaccgagacattcctctttcaagccgagatcaaccagctgatgtccctcatcatcaacaccttttactccaacaaggagatctttctccgggagctcat

SEQ ID NO: 4687 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnttgcgaaaggagacaggctgcaaaactgacactacctttcgatgcagtgcaggccgagctcggcagcagcgagctgacgctgaagacgtgccagttggggtcgttcgtcctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtaaaagtcgtcctcctcgtcgtcggcggctcgtcgccgtcagccggccgcccgtgcgaaggaaaagattaggttgttcgccacacacgctgctggctagctactaaccggcgtccgatcaaggagcaccatggcattacacacacggcgacgactagcgatcgagctagtgacgaactggcaacttcaactcccaactcgatccaacttgattgacgagcacgaacacgcgcactacggaggccctggttagatttca

SEQ ID NO: 4688 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnncgaaatggccatacctctattaagagtctgtatcttatcatgccttgttaatcttgactgtctcataatcagccaaccaccttttatattagcgaccgacggcgaagaagaaaggtgatcaccctaacaactagctagctactcaccattttttgaaaaaaaaaacaaagaaaaaagaagaaagagaagaagatgtacgccattatttcgctccggtcaataacccgtaaaaaagcgtgacaatggaataaaagttaggttttatttttagacttgtacatgctgttgaggatttaaaggcaaagactaaagaagacaataaaaaacacatagaataatttaaatttaaacgttggctatggcttactttattaaaaaaaactaaacttagaagagaaatgtgatcccttctaatacaacaaatctcttcatctatttaaatttatggtagaggagtcacgcctctttaacattgatttttttttttggatagtgtgagtaatgcgctaggtacacgtacaccagtacagttagtacagcaacgtacagtgtgcgtctttggaggcgtatacgtatccggtttgatgagggcatggcccatgctagatcggcttggctttccatataaaggacacaggggtttttactcgaatcggcacaacggtgacaccg

SEQ ID NO: 4689 - DNA, 1037 bp, Oryza sativa
  unsure (1)..(1037): unsure at all n locations
nnnnnnnnnnnnnnnnnnnnnnnnnnnnnnnnnnnnnnnnnnatatgaaaatgaattttgtttgttaaagattacatcattagattgagatctaaatttactttcatgtggttataattttgttgctacaaatcttatagtatatgagaaattataagctaaagattagttttggagaccgtgccaacattgaccacaccttatattatgggattgggagagtagtataatacagctatagtcttgaaatatcagagaacagtaaaaggcagtctaagtaaaaccaccctattatattgatttgtcacatcttcagactgtaaaataacaaaagaacttcctttttatttgatcagagggtccatcaaatctgaaacatgacaaaataatttcaaatgtcctccctattgaatgctttggcaccaacattatttgaccttttcacaggcaaccttcctagatgaccaaattgatgttgatcatgctcgggagcatggccacatgcatctctctgaggtaaatgatgatgcacttgtcactttctccctgccatgctatgattctaatgagctttgggacaattctgatagttaaatgagatgtctgtataaagtattactgcattaatgcaaatctggtatgtcgtctacagataatggagcactcccaatggtttagaaacaaagccattgtactgacacatttctcaaatcgatatagtcttgaggtatgtaatcactaacctataaatcattgggaatccagtgtttcctaaaaataatagttgcggattctagactaatctgacccaaatgattattttgtaggatattagacaagctgtttccaaactacagtcaaagttatcttcaaaggttgttgcactgacggaaggcttcaaatctgactatagatagtgtatagaagtaggtcagctgtgcttctcacccttacttgctgagaataacttgagttacttacactaggaattggccattcatnnnnnnnnnnnnnnnnnnnnnnnnnnnnnnnnnnnn

SEQ ID NO: 4690 - DNA, 1133 bp, Oryza sativa
cgtggctagcgggaaccagcgccggtaaatgcctgtccatgggctcatgccgcgtatatcctcttgaaaaataggaattcaatatttcatgattgaggctgtgtttagatgcagggtgtaaatttttagtgtgtcatattggatatatgaacacatatttaaagtactagcaaaagtgtccgtacgttgcaccgggtgattacggagtgtgtatattaaccaaaagtgttgtttggtttagcaaaagtgcccgtgcgttgcaacgggaagcgtacatatcagaaaaatatgcaattaattaaaatacaaattcgctgaaatatttgatatttttaagtaggtatatgtgtataattaaataaatttacaagtaaagtaagtgtgagaaataactataattgtaatgcttctgaaaaaatgagcactaaacatgaacttattctctctttttttcggcccgagggacctaaaatagacttattttcggcccttaccggtcggcccacggccttttgcgcacgcgtgggctcacttcccctccccaagccgcaacctgggcttgagccagaaaagtggcctcactctcgatccctcttgggccgatttcggcccggatgacaccggccgtccgatttctagggttttgatcggacggccgagcgtcgatatcggggaaacaaaaccccctccctctcagccgccaaaaccctagcccatttccctcccctccctcccatttcacttcgccgccctcccctccgtgcccccgagcggtggcggcacccctccccccgtgagcggcggcggtccgcggcggcgccctccctcccgagcagaggcggcgccctccccccgcgagcggcgatggcgtctcccccaccactggcggcgcggcaacgtcctcccccaccaccggcagcgcggtggcgttctccccaccaccggcggctcccggggaggtgatcctctcagtcaaagccacggcggcgcccctcctcctctccctctcgggtcggcggtggcgggttggtggcggccgcgacagatccgagggtgggggcggcggctccctccaccccctctagcctccctcccgcggcagatccggtggcggctgcggctcccttctcccc

SEQ ID NO: 4691 - DNA, 148 bp, Oryza sativa
acacacacattaagttgtacccacatgtcatcctccctctctctcccttatctctctctccctcccttatctctctcttcctctagagcgacggcggtggcgatggccgatgggaacgaggcggaggggagcggtggcggtgggaagc

SEQ ID NO: 4692 - DNA, 18544 bp, Oryza sativa
  unsure (1)..(18544): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggcgccgccgtatcgagcctgttctcccaccacggcgccatcgcatcgaccccggtgcggctgccgccgcaacgaggctgccgcatccagcccgccgtcccgcggccgccgtctcatcgagacagccgcggtcccgtctcatcgaggccgctgtgcaatttaaagaagagatgttgaattgattcattagttacaaaagctacaaagcaaactacgcttctatctatctttcttttagtaagattatctttgtgtatttagatggagtaacaggctcagatagaattggccgccgagggaccgggcgactcgcgcgcatgagggagagtgcgtgcactcgcatcctccccatccttttctctccctcttttcctctcaacctctaaattctcccggttgaatgggtatcatgtactactatttgacatgtctcaatcatacaagacttgacactcattgaccagtctccacaatgacagtactgcactgataagcttattgctactagacatcctggaagctagctctcatctcaacaaccggcaatccggcatggacttggagactagcgagtccctctgggacctcagaatcaattcctagcctgaatcggggaatttcttcttcttttttaaaatagaaaggcctgacagccttccccttttctcatatcagaaaagcagacagatttaaacttgcaaaatggaaaaggaagaaataaaaacatccagggaaacttcgcacacagctcatgatcaagtccatgccggtttagatccaaagtttggatccaaacttcagtacttttccatcacatcaacctgtcatacacacaacttttcagtcacatcatctctaatttcaactaaaatccaaactttgcgctgaactaaacacctaagcattatagggcacgctagctgaaatggtgaaaaatcctgcgtgtcaatggcgcacaccgacaaattaccccttcgtcgatgacgacgacgcgagtcacgcgatccgcctgttcctgttccgccgtgtgcgtgcgcgcgccgcgtttcgtcactcgtcgtcgtcgttgactcgttgtcgtatgcagcggactcgatcggctaagcgctctcgtctggttggctgcagggtggttctaataaatgtggtgtgtctcccgtcctgcgtgtaagtaatccatcatcatccatggtaatagactttggttttgctgggtcaatgcgcattatatattgatcggctgccagtatcttgggttcggcatgcaactacttatgctacagagcactcgcctctgatacagagagtaattgtgtgtgaccataggattgaggtgttcagcactacttcagcggttggcatggttttacagtttgtgtttgtgaatggtagacggtgaatcgggacagattcctggctgccggtgaactgtgactacaaacaaaattatgctcattcacacaattgatcacgtcgtcagttcgtcactgaaaattccctgtactgcagacgttgagttcacaagaagtgaccgatgtagtggacagactcaatgatagcattgatcttgaagatactactagtagtacatttttagtttctcgttctgttgttggcagttaagtaaactagaagtaacaattatgaagtggcttccccaaaaagagacaaatattatatttcttgtagtagtttgcgtttctcaaattatacaagtcatgatggatatgtcgttacttcaatctgtaaatttcgcctacaatttgtagtttgtacttcaatgatgtgatcaacaaggcaggggttgaggaaattattatcttggccctggctagcttgtcaatgcgaattattgatcggctgccgatattttgggttgagcaacaactcgtatacatggtacagatcgctcgccttgatacagagagaaattaagtgcaagtgtgtgacacgtctctcgtcatgcaagatttggacttattcatcagtctccacaatcgtggacagtagggcactgctagatgactgctacgggatctcttggaagctagtagtagctctcacctcaacaaccggcattgacttggcaagtctccctgggaccctaatcaagattagagagatgttgagcagcggtagaggaggagctgaccggttgaccggccggctgaggaagtgagaagagcttaattagctgacagttctgcatcattggcgcaccaacaaaatagtgttttgcccttttgctttctaagtcgcttccagcgtcgtcatcgtcgtccaattagacaataataaagtgattttcggttgtgatgatgcggtctatatataccgggattgatcaacgttgataactaattagttaactaatcgtcaatgtcactagcttctcaaatttgctgggccagggatacagtcagttagtgcattcctctcatctatttaacactcggcccagccccaggcccccagcagcatcacacgtactcagaattcagaaacacacaaccaccaagagagaattaaccaaatgaccaagcttctccactccgcctgccttctcatctgcatttcaggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgtaagtactatttcagtataatttagtaaatctgattttcacaaagttgtaaaaatgagtcacccttatttttattttacttttttagaaactagaaaaaaaatacccgtgtgttgcaacgggtgaaaactattttaatcatattattgttagatttttttaaacaatatatgggatttttattttgatagtattgatatctaatttggaacttttattagaatgatggctatatcctacgttgctattttttatgctttagcaagaattctaaagcaattagaagtccaactctcgtcccaagttaatatgcgagttttttaaaaagatttttatacgactctttatgtacttttaaaagtgaatgaacttagagcatcaccaacagtctatctatctgattttcaaaactgatttggagggattttaataaaaaaaatagctccaacagatcccctactcacctacccaagttttggagttctcttctcccgattcctcgctccgtttatatgcggatgcgtgttctcgcaaaagtcgctcccaatctcgcactcccgcatctctcctcccgttcccgcgtgtgggagatagcgatctttttgcgatggaagaaaaaatagaattttttgttagtagtttaacaaaagggtccattttaagttttagggatttaatttaggctatctgttagagggaggagttttttcacttcctattttcagtttaggaaacccaaaaacaatttttggagggaagattatagataatctgttggtgatgctcttaaaaactgactcaaatacgaacaatgcaccaaaatgtcaacaaaaatattttcaatttttataatagtagagatagagatttatagatgtccataaggggtggaccaaggtttctcataagacctggaccagcttatgggcatgtttgggggagtttctagctgttgcagcttctcctagaatcagaagctccccccaaacagtccagcttttggtccagattttgagaagctgtagttgtagaatctataaaatgaactagaagccagcttgctaccaaccagctgcttctcagaatcttaagctcccaaagcaggcccatgtcatcttggtctaagattagagttgaaatattacggtgttttgttggtccgtccctgcgtccatagattgattgggaatagatattattatcccatttgcttatgttcttttctccaataaaagttggataaacttttggatactcgtggcatgtttttcaaagtgctaaacggtgcgttttgtgtgaaaattttctatatgaaagttgttctaaaaatataagattaatctatttttcaagtttgtaataattaaactcaattaatcacacgttattaccacctgattttgcgttaaacacttaatcttaatctttatcttcatcttcaggagattcaaacacgctagttgtgtccctagttgcagtcgaatactacacctaagtgcgtgaagcatgatattaaataaatttataacatatgtaagtttatgatactccatatttaatattattagaacttttcaaggaaaatctacatatattatttctttttctcttctctactattataaaaattgaagatgtttttgtcggtacttttgtacgtcatccgtgtatgagtcggtttttaagtttattcgcttttggaaatatatatttgtatttgagtcagtttttaagttcgtttacttttggaaatacataaggagtcgtataagaaatctctttaaaaaaactcgtatgttattttgagatgattggactcttaattgcagttcatggtttcataaaaagctatatattcacgcgaattcccatagtgaattttatcttaactaaaccgtataacaataataagattaaaataaccttcacccgttgcaacacacgtgtattttttctagtaaaattaaacatttgagaaattattgataatcaaagtttcgaaggtctgatcagatctcatcttagctaaatgtcaaatatttataataagaggaaaagtaaaaattaagaacgatccggtttttcacatgcatttcaataatgtgcggttattgcatcaattgccattgttgttgtcttctacagtcaactattagctattaggttgggtgggataaaatttacaaactttgatataagtttatagaaaaatatatttataatatataccaaataaatacactattaagacatattttttatggatttaataaaaactaaattgatgttgtagatgtggtgcacttttcttatgtttaaagttagaaaattttgactttgaatataaaactaaaacaacttagaatatgtaacaggaacagagagagtaatttgttaatcatgaaaaaaaatatttgttgcttttttttaacgaactggtaaagatgtgccaattttattgaatatagaagtaaaagttacaattacaagaataaaaaagaactgtaaaaaagggcaaggtctaaggaattaaaagcgcaaggtgtaaagaattgtacaaatttcattgaatattcgttgcttttgatcttcaactaaatagctttctgcatccatatgtaacaaatgcagtatgtaatcgggtgttcgtcagcatgcgacaacaaagtgaacaaactaactcccaagaatggttcatgctctggcgctggctgctgccaggcaaatgttcctaagagcatacagtactaccagggttatttcaacgaaggctacaacaccactaaaatatggatgagcagcccttgcagctacatggcagtgatggaaaccgcagcattcaactttagcacaagttacctcacatccagcgtattttatgacacgtacaaggggggagttccggttgtctacgactgggccataacatcaaaaacatgtacagaatctagaagaaacaagacttcctacgcatgtattagtaacaacagtcagtgcattgacaacctgacgaatgcacaaggttaccctgcaagtgctccaatggatatgaaggcaacccgtacataaaggatggttgcaaaggtactgtgttgcacctttaattttgtgtctgctgcttatgtacacttgtatgtaatgtgacaattctgacccaatgtggtggttcgatttcagatattgatgagtgcctcaacaatgctacttacccttgcaaggggatatgcaccaacacgttggggaatttcacctgctcatgctccccaggaagttatatgatgaatggagattgtatgccaaagaagaaactacgttttgactcagtgcctgtggtagtaggtgagctcctatattctgtaagaactactaccatgtctatggatcaccagtttaaatactgcgtagtgagtagtcataccatacaatatgacaatccaacacttctccctctaaacaacaccagagcttttctgaaataagtaataattaaaaaaaaaacttggttggccaaattttgtgtagtcgcgttggccaacaagacacaactctagcacctttcttcattgcgacattgcagggatagccttaaatctgctcagtattggtccatagaaaaaaaaatgtaattgctggctaggtgatggaatttcatccatatattttccaacaacgtgcaggcgcaagtatcatatctgttgtcctggtgattaccataatgtgtgcttacttgatcaaagagagaagaaagcaacagctcatcaaacaacattacttccgacagcatggtggtctgctgttatttgaagagatgaaatcgcaataaggtgttgcattcaaaatcttctcacatgaagaattacaggaagcaacaaataggttcaatgaacaacagattcttgggcaaggaggccatggaactgtttacaaggggcttctgaagggcaacatggaagtagctgtcaaaagatgcatgacaatcaatgagcatcagaagaaagaatttggtaaagaaatgctaattttatctcaaatcaaccacaaaaatattgtcaaactattaggttgttgtcttgaagtagaggtccctatgctagtatacgagttcatcccgaacggcacgcttttcgatctcatccatggtaaccatggtcagcagatctccctggccactcgtcttcagattgcccatgagtcagctgaggcacttacttatctccattcatgtgcttcaccaccaatccttcatggtgacatcaaatcatccaacatcctccttgatagaaacctgatagcaaaggtttcagattttggtgcttccattctagcaccaacagatgagtcacagtttgtcacactggttcaaggaacttgtggatatcttgacccagagtacatgcagttgtgtcaattaacagataagagtgacgtatatagcttcggagttgttctcgtagagcttctcacatgccagaaagcgttcaacctcaatgcacctgaacatgagaaaagcctatcgatgaggtttctcaatgcaatgaagaataacaagcttgcagatatattagatgaccagatcaagaatagtgagaatatgccatttctcgaagagattgcagagttggcagcacaatgcttggagatgtctggtgtgaataggccatcaatgaagcacattgcagatatcttgacaggctgagaaaggttatgcaacatccatgggcagaacagaattcagaagagttggagagtttgcttggagaatcgtccatggtcagctcaaggtataccagtacaggaaatttcagcatagagagaaaaggtgtcatggagctagattcagggaggtagtagctatactttttttttcaaaatcttggtgggcaatgtcagtattatctacttaaaataatcatatcacagatcttattacagtaaatatgcaatatcatattgttggcaaaattacttgcattgtatgtaggacaacaaagtaatgttggcggctgctcaaggaataccctcaacaatcttggtgttagtgtcgagaagaattgtcattgattattggttatcactatatttcaaatcacatcttagtggtcatagaaacatgcatactgcatgtacagctagtccatgagtgcttttttcagcattccttacatacaagcatgcctggcttgctcacaattggtgacattgcactacactttgtgtgtttatcggtccagcacaacaaggacgcacgcatatcatacagctagtgcacatcgcgcacagtggcacactggcccatcggtatcaacctcccactctcccagcttctgaaatctgaattctacgaacaggaccgagaagtaggtataaatttcagactttcagtagctaccttccaattccagcttttccagggattttccccaggttctgcttctgccagcccgttcccgtagtcatctaaaccacttcaccacaccaaactctgccttgtccaagctgtctaagctaccctgctgtgccgctgccctgtttactctgtcaaccgccgaatgcccccacccgtaaatcgattcagtgcgtcccagctttaggcttctattaccataaggtaaatctagagatcaatgctcactactcagtataagaatcgaaatagagttgtgacttcaataataataaccgcagtcaacaaattatcacattctaaaacagaatataaaactaacacattgagaggacgtgagctagcacacctccattctacactataaaagctactggtataagccaataaggctataatcaaaccaaaacacgccaaaaatgttaaaatgcgtaagcaacgcatgatctgaagcaagcggccgcaccttgtaagtagtcctccaagccgggttctcggtggtgaagggctaccacgaggggttcccctgcacccatcaccgcttccttcggctccttcgccacaggagggcgctggggtttgtgcttcaagatgttctcgcgcccctgcttgaagtggcggcgctgcgttcaggacctttcatctggccggctcctgacagtgcgccctcgcttcctgccgcttcccataccttcctccctctcgctctctcgcgcggtctgctcctgctgcagctgtcgcctttctcactcccggtgatggcgcggataggggtggcggcggcgcgaagggagggggggaaaggttcatggggtttcggagcgacggcgaccggaaagcgatgagggcggctgggcgagaggcggaggtcgtcgatggtggcaccggttgggctcaatgtgggccagcccactcgttgtagaattataagctgcgatgggcatttaactatgcaaaagtacactttacgtcccttatcttgtcgtcgagttttcaaaaacaccctgaaccacaaaaaccggatgcaatgcatcccttaacttataaaactaaagcgcacgaggtcttaggacggtttggatgatggttttggctaacgtggtgcctacgtaacttgtttgactgggtctttatcccacgtggcgttgacgtgacaatttagtctagaaaaataataaaaactatagggcccacgtgtcagttacaccacaaaacaattttaaaaatggtggggcccatgtgagccccacgtgtcatcctcacacctcccctcttctttctttcctctctcttgcatactcttggtcttcttcctcctctttccccctctctaatctcttcctcaccgttccctctactgctcctccacactcctgacatgcccgaatggtggcggttagcttctccagttctcctcaccccaggcgacgacgtcgacttcaagctccacacctgctgccaccatcgctcgctcgttcacacaggaatgacactggtggtgtgtgaaaaatcgtggcatgggcgaggacgcgtgagaggatggggaaggaagcaatccttgccattccacctcttcctcactggacagaggtcgacagggccgtcaggtccaccgggctgggacggtggtgtgtgcgctcgacctcaacatcgttgtcagcgagatgacccaacagcagccactgagggcccaacacgtgtggtagctttcggtagagcgcatggaggatgtcccagaggggagacaggcggcctctgccacattcctcgctgacaaacaactacagtagcgggcctcctcgaaggaggcggtcgatatctgcctccttccttactgacaaatgatagcgtccgaccagctgcaagatttgggcgtcggccagccgacagcagggacgtggggaagaggaaagggccggccgccacccttcaccggaaccgctgctcaagctctgtgccccactaccacctcgtcaagctccggagctcgtccatcgctggcctgtcgacctccggagctccgagaggctgagacagaggtccgtcgaccagtctacgacctcccgtcctttagagggagataagatgggggatagagaagaggaatatagagaagagagttggtgacatgtgggtccacatattttttttaaccgacaacccgctgacatgtggggctatctttttttcccttatgactaatatatggatccccttgtttatttattaaaaaattctgcctataatgccatgcaagcgccacgtgggatgaagatctactctaactagccacgtaggtgtcatataagccaaaaccaccatccaaaccgccttaggacctcgtgcgcactagtttcgtaagttaggggatgcgttgtatccaaccgtactccgtactcatccccgcagcccatcgtgtgacccatcttaaattgcctcaaacttattttggatgagccggtaagaatgcaacatttttcaggtatgcatgtaaaaaattctaatacacaaacgtattataaaactgtttaattatttaattggttgatagtcatggaaaatcaaagatatatcaccatgtggcattcatatcaggtattttgtaaaaaaaaattgtaagaatctttttacatgtatcactttacttttcagcagtatctccgaaatgcaaaagtctactccttgtagtggaaaaactaattctgcacgacgcagccgagccaggacgccgagaatttcatgtaccggccgcgtttttcattttgaccatgtcgatcgagcagtactccgaagttgatacagattacgcagaggtgacaacatatggcgcatttaattaccgcaactagggtgaaaacggtcagaatcagtaaatgacactcgatcgactaataattgatcatatttatcatttaaactggtaagtatcaacattaatacgatacagaaagaaattagtaaaatcaaaattcataaatagccaaaaatggtacgatcgaaaacggtaccccttatacaaatacgaaaacgatatttagtcgaccagaaatttctgtgaccgttttcacccctaaccgcaaccactggatcagcttcatgcatcttcattaaccgtacacctgccactagccctatgaatattggagaaggccgagaccgctgcgaacttgcgagcccctatcatttgttaaggtcttgtttgattcagtttaagattatgataatctgaattattaggagtaagctgaaataaacagatagctaattatgataaatcattataatctataagccagattactataataatccactctaaaggtgctttttctaggggcctgttcatttttataccattttcaaccttaccaaattttggtaaagttgccaaaaaagtggctacatttagtttgctgccgaattttggtaactatataagaaatcctgccaaaattttggcaagttaccaaaattttggtaaggttttttttttgcatcaaagtgaacaggccctagattattgggtgtctaacagctaataatacagagaattaaacagctaacagcttagcttattttatgttggcttattataatccaggttatagtaatctgatttaataatctagattataataattttaagctgaaataggaccttagaaactatataatcccaggagcgtgcaaccatgacccagtcacgccatcgcatttagggcctactggagtacacttttgactaacacaaaggctctttgtcaaacgaagttaattaaaaacgtgaggaggtacatgtgaaaataaagtactgcaaatcacataacatatgtaatatcaatatgtaaattaactatcatcggataaaaaatgaacttgtttatgaattatccacgttatcttgagtaaaactttactaatggtgatgtaaacaaatatcagacacatccatttttaaatttttaggtttacgatacatatttttcccatagggccatatacaagtacttagcattttattggtcaaagtcagcctatcccaacggtaacatctatttccttatattaattagcaaaggatctcgtacaaccctcacactaatcaagctagaagtagcaaaatcagtaagagacaagctaaaaatattattcttgtgttaattaaaaaagataaaattatacccgtcatccatcaaatctagagcggagatattccattacagaatacgtggatttatagaattagaaattaataaatatcactctcaaatataatattttcacgacttaataatttaaaattataaaataataaagttgaattttactggggcgtcagttatgtaagctttatatatgatttaataagggtacatagcgaaaacgatccttgatttctagcattccgtattagataatatatgctgtgtcatacagttcaacgtatgctcaacatatgctgtgtcatccttgcaagaaaagtcaacatttaaatgcctattatacccttacagataccatattaaaaaatagaaaaagaaagtaaaaaacaaacagaaggtgccgtcaaccttattactgtttgttttctctctctcttttttttttcctttcacttttttaagtatatcgtttaaacgttgaccttacacatgcaagtataacatggtatatatgcccatacgggtttaagtcaaaactctctaggtttgactaaatttgtataaaaaaataataatatctacgatatcaaattagtttcgttagatttaacattgaatatattttgataatatgtttgttatgtattaaaatgttaatatattttttataaacttgattaaacttaaaaaagtttaaataggaaaaaaaaattaacgacttataatatgaagcatagggagtacgtaataaaatttaaagtctcatttagacaggaacataccctatgcacacaaaaagtcttctccctatttcgggctcttcacctagatctggctgcacaactcatcaagggtgcagatgatgacaacgaagggatcaggctaatctaattgctcacatgaaacattcgtcggtgacggcgttcacctcctcctctagtgctagctcctcctatttctaagggtgtgtccgtgtgtgcctgtgttcgttagccaaggtaagggacggttatggagtactgcaatgctcttgcaacttgctttaaattaaaaagaagtcctgcatacaagtatgtgtgaatatgtactgtatttgattactactactatttctgctagttgcatttactgtataaaataataataatgcttcttcatcgtacacacatccccctccctaaaaaaaatagagaaaactttacggtattcagccgcccacgtcaacaaaattacgtactatacgcgatacctgcgctgtagaatatctctctcttttttttttttgagaactccactgtaggctatctctctatatattctctatatatataggctagctggagcgctgacctcgcaaacaacgggcacaaccaacaaagatgaagttgcagtatacacgggcagttcttgccagccttttttgtgtctgtctgtcggctgtctgggtggcggcagcaacggccgatataccggcagggcaacgccccggttgcccggagaggtgtggcgacgtcgagatcccgttcccgttcggcatcggcaagcactgcgcgatgcagacgaagtatccgtttgatctcgactgcttggacgtgaatggcaccaagaagcctttctacaacaataacgaggttaccaagatttcggtgcaggagggcaaggcatggatgaagttgggcatatccagtcagtgttatgaccacgtgacaggccatatcctgtacgacagcaacgcaacggcagaattcggtgattcacctttctggctatcgaccgaaaacaagatcatcgtcatcggatgtcaaactatggcttatatggagagcaacgctgtaagtatatatatctcttaagcttatcatttagaggcattttaataagcacaccatgttaagtatcaaacagggaatcggccggggactaggggggaaaagaattcccgaaaactgtcgcaaggccaataccgtcgttaatctagaatttcacttggcaagtgtattctttttttttctcccagccacatgcaaatgtacatactctatccgttttatattataagccgtttaattttttttcttagtcaaactactttaaatttaaccaaatttatagaaaaatattttaacatttttaatacaaaacaaaaatattatcaaaatatattcaatgttaaatttaatgaaactaatttggtgttatatgttataaatgttgctaatttttttaaaaaacttgatcaaatctaaataactttaactttagaaaaagtcaaacgacttataatataaaatggagggagtacttatgagatagaagaagtatatataggagggaagtttttggatgggcagcagtgatccgatatgattttgccaaaaaccggtttctcccaagattcttgtcactatctacacgttttgatcatctctttactttttaagactcgtctattccgtatttccgctcacactatgctatccacgccacccacgccacccaaagtaatagggaatctcatcccctttgatttgtgtttgtcatgttgtgttgcgtttttgttccaccaacctagcaatcaagtggactgtaatatgctgccacccaattttaactagtccttaattcgcgtaatggcctcccatatggatttgaacatctgacaatcctcgaaaatgtgttgtctcaaggcttctaaaacacaattggtagaaatagttattcagctagccaccctctgatttgtagtctatcagaggtctaaattctgttcagaaggagtaaccaagagaataacttgcatttggagggttcccagatttgccttgccccagctgattgtatttggctagcaaattgcgcttgatatgctaactgctaattctcaaaaaaaaaaaaaagctaactgcgcactgtgctattgatccagtgcccgtcagcttccaaattaatgatggtatattggattccttccgttaatgctgtgttgtttctccataagcaaaatcccatactttgtagaagtcactgaccaaggccctccaaatatttccatgaagaaaagaaaaactggcaaatcaacaagaacatcttttgcgctcaagagggagatggattcaaaaggagcataaagcttcatctattcatccttcttctcaccacaaaaactcagcatataaatcaaaagaaaaaccatatcacaaagacaatagaacacataatttacaaataaagaagcaaattaactcaacacgtacaactcacacctttccatgcacaacatttcaaagaaaagttaacaagatctcatacttagtacaagcttgaacacttctcaagaaatgtagtctgaaagtaaaccagcctatacaaatgctccttttttctcatccaaggtgcgacccagccagggtagggggtaagggcgtgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtatagtcatgttgggctgcggacagatcccgagctcacaactgcattacaaaagggaagcggaagccaagacttggaccaaacatcacaggcgcgacttggaaactaggccgaaaccctaaaactcatcgtagccggcttgctcctggaagaactcctcgtcagcgggatccgcttcatcttcttcagcaactaggggggattatttatatagagcaagggtgagtacgggagtactcagcaagccatgggaaataagtgtttaatgtaggcttcaaagaaaggctgttgtttttgcaattgattttatttgaactcttttctgaaacaactaagtgagtgcttctcaaacgacacggatgagacagtgcgtctcgtccggtcggagtatgtgcaatgtatcagtcttttgaattgatcaagattggcacccggccaacagctttcaaacggccacccgggcctggctgatcccatcagccgcagattttccaaacatcaaacccatcccacaacagcaaatttcataaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaagggtcccagaccaacaccagattaggtcccagaccatattgtgccaggaagcccaggggtcctccccgacaccaccccggcgaatccacatgtctcttagcatcatggctctcccgataagctagttactcagccaggggtgtcccattccacccatgtggtcgtacttgtcttatgttcggatgaaattccaaggaaacagtccttaggtgcaagagcgggaaaccgtacacccggtacgttccccggtccgcggttttggaaattcatttagttcgcaagcaccgacccaggtgtcggattttccaagtcttttgtaaaacgcaagttttacccaagatgtttctcagattttaagtttgaaggcgaccgtcgatacccgtgcagagtgcacgattaccgaggcgcaactaggtgggtacaagggaacatggtataacaattacaatggaatggtcaaatgcaacaaattaggtaggtcccgcaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacagctcagcaaacggcaaaaataaagccctattattgacctctaagcgtgccattcgatagatctcgagatttgaggaattttggaagttgaacggagtcaaacggacttacggttgggaagatattgaatttctaagattattggatttttggtctaaaggaaaaggatttatttaaatcctttttgaaaaagaaaagaaggagggagggaaattagacttccctcgggcggctagggcgcggcccgagagaaaggggcggctcggccgagcttaatgggccggccggcccaagaaggcggcccaaggcgcgcgcgcgggcggggaggggagagagagagccggtgggccgggtccatcccgcgtggtcccgggtgggacccgcttgtcagcgactcggctcaccgtgagcgaggtgcacgcggggcgtgctagggtttggggaggaaggcgcggcgcatgcgcgcgtttcgcggaggacgtggtgcgacgggcccacgcgcagcctcacggctcgcggtggaccgcgcgcgcgaggggcggagggaagcggcggaccggggtctgcttgacccggtcgcggccgaggtggcgccgacgtggcgcctacgtggctgccacgcgagccggcgggaggtagacgacgacgccggccggaacggacggcggacgacagcggtgagcggcggatcgaaccatggcgatacaggcgaaggcgagcacaccgggatgttgcacaggacgaggggagacgagccaatggctcggattcgccgggggatgctcga

SEQ ID NO: 4693 - DNA, 3568 bp, Oryza sativa
cgcggggcaggcgcggcaggcgctgacgtcggcggcgactggccggtcggccaccaaggcgcgcgcgcgcgcggcgggcgcggcgatttggccggcatcggcgggaacggcagcgagagcgggagggagggctcggcgcggctcacggcagagcgggcagagagagagagagagagagccggggagggagggggagatgggcctagagggattcggcccatcgaacccgagggaggcaaaatagacttttgcggaggaatttgatttgggaaggatttggattcgggattgaacttgacgatagatcggggatttgagatctgagatggcacggacactagacaacaagcaaagaaacggatttcgcaaataggatttttaagagatagttttcccgctaggcgccacgacggaacgggcgctacagggcgcaagcggagaggcagccttaagcctaaaaaaaataatttagggaccctgccccataatatacatcagtataaatattagttatggtccaataaaaattaggagctactgtacagtatacactacagtttttttaataaaagacttttaaatataatgtagtataatttgagattatattgtaattataatatgattatagtgtaacttatatgtagttgaataaaacgttcatgcaaccggttggctagcagcacgacatccacctcacatgttgcatgttcaacttgtacgtattgcacagattttttttcccctctccgcatgaatatcaaggtgatctgacaatcataaatctgaaggttttggttgaaaaattgtcgaacatttttaatttaattatcaattccggtaaaaatcatagtaaggtattcttgctcaaatcctagaaggtgtagccatctagtattttttttcttctgcgcatgttccccagctaattcaggggacgttgtgtttgtgtccgtggcggtgcataccacatgtgtctcgctgcccggggcaaatctaatgtggattaagcccccccccccccccgccccaatttcccaccctgttggatccctatggggaggagagaaggggaggaagaagatcaacccccctccaaaacctaactagacccaccataatgatttcattgccattttttaatattaaaaaaaagcatgctgcttttataataaataaaatatgcttctctagcttaatttagtcttgtccattgaccaaacgtcgcctcaagtcacctgcacgtcaagggaccaaacaaaccatttccgtgcatagatgaccgactctatagtagtgatatgagtcactatgtgcaactagtgaggttgccaatgcgcattcaaccatcaagattgtcaatattgctccctccaaaaaaagatcgtcaaagtagtatgttttcacaacaagaaaaaaaacagattcacactaccatataagtgtttattctttttttaataaagaaaacagtggcagagttcactacttcttggtctaataatacatatgcaaattccacagtacgtaattggttgcttctcgacatgtaatgggtcaacacctgtaaatggatcttgcttcggcggtggctgttgccagatggatgtttcacgacacatatatagttatgatggttattttgacgaagattacaatgatagcaaaatatggaggagcagccctcggcagctacatggcggtgatggagaataaggccttccaatttagcaccacttccctcaactccgcggtattcatcgacacgtacaaagagggagttccagttgtgttggactgggtcataacattggatacatgtgagaaggctaaaagcaaaaccacttcctacgcttgtgttagtacaaacagcatctgcaatgatgatccgagtggaggtaaccgttgtaattgttcacatggatatgaaggaaacccgtatattaaagatggttgtgaaggtaccatagttactttttcgttattcttcttccttgatatgacaatttcaatcaaacttgcaatggttgcttgatttcaaaatatcaatgagtgcctcgacaatgttacttatccttgtccggggatatgcaataatacaatggggagtttcacttgctcatgccaccaaggaaactatatggagaatggcacttgcataccaaatcggaagtccggttttcttgcacttcctatagtaggttggttcccctcttccgtaatcactagaactaatgataacgccaaccatttgtgcacaccaatatgagaattgttaatatataaattttgcatgccttactagtcattacacatggctagctcatggatcttccataattccatatcttaggccaatcccaacccaacacactagacatagtttccataaactccacatcataaaaaaaactagtacaagacactgctctttcaatgcaaacaccattgtttcatacttagatttaatgctacttatctcatatgatgtcttggatgttgtgtaaaaaccatgcatgtctcatgcaagacctggtttccttttctttcctcatttattcacttgccacatcatctttcatcctaggtggtagcttatttaatgctatagacaccattctagtcattgggttgggactggccttactagtcattcacacaagcttttatgattgtgtaggcacaagtgttggacttgtcatcctagtgatcaccataacttgtgcatgcttaattcatgatagaagaaagctacagcacatcaaaaatcaatactttcgacggcatggtggcctgctacttatgaagagatgaaatctaaacaaggtcttgcattcaaaatcttctcgaagaagaattgcaacaggcgacaaacaaatttgatgaacatcaagttctaggccaaggaagcaatggaattgtttacaagggacatcttaaggacaacttggaagtagcagtaaaaagatgcatgacaatcgatgagcaaaagaaaaaagagtttggcaaagaaatgctaattttatcccaaatcaaccacaaaaacattgttaaactattaggttgttgccttgaagtggaggtccctatattggtctatgaattcatcccaaatgacacactttaccatctcatccatggaaactataatggttggcacatccctctggttactcgcctacggattgcccatgagtctgctgaggcacttgcctacctccactcttgtgcttccccaccaatcctccatggtgacgtcaagtcgtcgaacatcctccttgatagcaacctctcagcaaaagtttcagattttggtgcatctatcctagctccaacagatgagacgcaatttgtcacactagttcaaggaacttgtggataccttgacccagagtacatgcaaacgtgccaattaacagataagagtgatgtatatagctttggagttgttcttctagaacttcttacacgcaagaagccgttcaatcttgatgcgcttgaaaatgagaaatgcctgtctatgaggtttctctctgcaatgaaggagaataagctcagtgatctattg

SEQ ID NO: 4694 - DNA, 15124 bp, Oryza sativa
  unsure (1)..(15124): unsure at all n locations
atatttcagggtttgatgctggttttgcttgtgcttacttgaggtgcttacttgaggttggcttgatctgtcaaaattgatgttggaacgtaacacaccgtcccgatataaatacagttgtaagtttccgtatttaatatttgactgttattcttatttaaaaaaattgtgattagtatttttattgttattagatgataaaacatgaataatactttatgtgtgactatttttttataattttttttaaataagacgtatgtcaaatgttaaataagaaaactcacatccgcacttaactatatttagatgcagccatgcaggtagtacattttttttgccgtactgctcccctcaggcaagagcattgaaatgtacaatgtgtcaacaattcgttagtcccctcaggctgtgttcttctccctgttttttcaacccacatctctcgttttccgcatgtatatttttcaaactgctaaacggtgtgatttataaaaaattttctatatgaaagatgttttaaaaaatcatattaatctatttttttaaaaaaaatagttagttagcacttaattaatcatgcaataatacgaattttattttgcgtgctaggaaacccctactcctgaacacagcctaaaacagagtaggatatgctgagtattgaacgtgcccaggtgcgctacttctatacacgatgtcgtgaaggcaaatagctgaagcctaaatgcatgaatggccgccaccaccaccgccaaccatgatgacgcagctagtggcggagctagaaatttaaccctttaaaatcggttactactagtttgtatttaaatggagtcatttctataattttttgaatttgtacatgaaagttaaaatttgtaggcagcggcggcgccggcgcccggccatcacgcgcaattgcctgggcaccatgcgtacagcaacacactgctccaatgcatatgcagcgtattactcgttaaccatatacttaggccatgtttaattcagcttaggattattttaatctggattattaggagtaagctgaaacaaatagatagcttattatgatatacttcctccgtttcacagtgtaagtcattctagcatttcccacattcatattgatgttaatgaatctatatagatatatatgtctagattcattaatatcaatatgaatttggaaaatgatagaatgacttacattgtgaaacggagggagtattattataatctataagccagattactataatctggtgagccactctaaaggtgcttttcttagattattgggtggcaaacaactaacaaacagataataatttagagaaacaaacagctagcagcttattctatgtcggcttattataattcagcttatagtaatctagttctataatctagattataataatcttaagctgaaacaaacataatcactttgtctcgtaagttctaatgaagattaattagatgaataatcagattatcagaaaacgagatagcaaggaccaaaccatcaagctgtagttataaaggccaaagcaatacaacctactagcaccgatgttcaagatgacactagctttaaaatctaaattatcagcgataatattaatcttgtctaggcttcaaaaaaatttaaagatctgccaccgtttgtagggatgtttttcaaaaacgaccccacagattgtgcatggatccgacacgcagccaaacgtttagcgtgtgtcaagcagaataggggattcaaggagatacaattgcaggattaccgtgctttggtagggaaattggaagcaaaagcggctggagggcgctgggggattgtgcttccagaggacctcgcgcccctgcttgaagtggcggcgctgcgtgcgcccgcgctttactgcctcctcgcatggtcccttcctccctctcactctctcgcacgggctgctcctgccgccgcctcggtcactctctctcccggcggcggcgcggacgaggccggcattggcgtgaggggaggagttctcttgggtttaggaacggcgacgagtgatgtgggtggtggcccaggtgggagtggcgctagttgggctggaatcgagacgctaggtaaggaaaaagtatacttggactcccttaactatcgtccgagtatgattcacaacctccaaccacaaaactaggtatatcgactcttccaagtatcaaaaccggtgcaaacaatgtctcttggtggttttggagatggttttggctgacgtagcgncccacgtggcagtcttgactgagtctttatcctacgtggcgcttacgtggcatcaaaataaaaataaaaataaaaaaatatgtgggacccatatgtcattcacacacacacacaaaaagtgggacccacatgtcatcctccctctctctgcgttatctctctctccctccnttatctctctctccctcaagagcgacgncggtggcgatggccgatggaaacgagcgnaaggggancggtgacggtggaaagcgacgtcgncgncggtcgcggtggcggtggggatgaggctcgccgcctcgagaactccatccgcctgctctccccgacgctcgtccacgcgcgtcatctctggggccgccgccgctggccgcgtcgacctcgtcttctagttcttccgcttcgcctaccgccgcgccggcttcaaccccgagccgtccaccttcgccctcctcatcccgatcgtcgcctcccaccgcatgctcaaccacgcccgctgcctcctcctcgacaccatgccctccttctccattgcccccgaggaggccaccgtcgccacccttatcgccgcctacggcaaggccaacatcccgcaagaatccgttaagctcttccgatgcccccaccgcaccgtcggtttcaaccggcgcaccgccgctccagccaagagaaaggccgggggagagagagagagataagggagagagaggggaggaagaaggaaaggagagggaggatgacatgtgggtcccacaatacttttcttttgtgtgaatgatatatggctcccacatatttttttgattttgtttttattctaataccacgtaagcaccacgtaggacaaaaactcggtcaagactgccatgtgggcgtcacgtcagcaaaaaccacctctaaaaccaccgtgggacattgtttgcaccggttttgataattggcggagtcaatatacccggttttgtggttggaggtcatgaatcatactcgagcgatagttaagggagtcaaagtatactttttccgtagactaattttctatgggaataagttcatatgaggtcccttaacttgtcaacgaatctgattttcattcttcaaccggaaaaccagatacaacgggtctctcaactgtcaaaaccagcacaaaataagacccaagacgatttggatggcagtttcagctgacgtggcccttgcgtggctaatttgactcggttttcatctgacgtggcatataaagcaaaatttaacaatttaaaaaataaaaaaatgttggacctcatgtcggtcaaataataagattaaataatagtgggaccacatgacagtgggtcccatttccccacctaatcccctcctttctctatctcctccccatcttctcatttgtgagacggctcgccgccagtgccgagtcactactgcccaagaacccccgaccttgacctcaatccgtcgcgggcggatctggcagcccctcgccggctgttgatttcgccgcccgatctagaggacgagcacaccaccgccaacttcatcacgcagcccaggtcttcaccaattccatcgccacctgcagccatgtccacctccggctcccttagcgtggcccgctggcacgcccgcgacagggctcccccttctctacattgctccgacggcttctgcgacctccgcctcccctaacgatctcagccccggcctcgcctccctcatcgacacccttgcgtcggattggaccgacgcttccgccgatgccaccgctgctactcactgacgtctccgcgcgcacctgctcgcgctggcaacgggaagcgcaagaagctgtcaggctgcgtcagtcgcatccgtgcccttaataccaccgtcgccgccgtcgaactccatctccgtctcgagcgtggcggcgatggagggcggcgcgttcttggcgcgcgcggcggcgatggcactggagttgtcgtcctcgtcggcggagcctgcggtcggggcgctccgactcctgcagctcctgggccagcagcgtgagaagccacggtcaccaccacggaggccgcggaggacgacgacccgttggagaggaaggcggcggcgagggtgtcaccgctgtcggttcactccacctgccgctagcctcgctcgccgaggttgttgcccgcctctccccaaaagagatgaaacgtgaggataaggaagaaagagagggaagagggaagaaaggagtgaggatgacatgtggggcccacgtgggccccactatctttaattattttgtgtgtggagctgacgtgtgggcccgtagttttttatttttctgatcgaattgccacgtgggacaaagatctagtcaaactaaccacgtaggtgccacgtcagccaaaagcgctttccaaaccaccgagggatctcgtttgcacctgttttgacaattcagggccagttgtatctggtttttgggtttaaggttgaaaatcggattaagtgtaaagttaagggaccaggttgaacttattcctttcctataggagcacaagttggccaaaagggccgaggcacgacggtccgacccatgggacggggttttggcttggcccaacctttggattgtgcttggccctttgcctcggctcgatgggttggcccggcatggcccaattcaacgatcagagagttaaatagatgaggaagtcaaaacagacttattctcgcgatgtaagtcacagcccaaaaagatgagggatgcaaaaaatagacttattaaggccatataagaggcagaccaaagagatgggggaggaggcaaaatagactttttttctaaggagaagcacgatgcgctttcgtgcctttgggccggcccggcacggcccgagtcttattgggtcgtacctttgccgatggtgcaacaagtgggtaggtccggggcagcccaacgtgtaggttaggccgtgtaagcccgactaatctcggcccaggcccaggcctagcggcccatttggcatatgtagagcacacgcttgccatctgtaataactgtattgtcgaggagcttgttattgcgcgcctgggcgcatgccccaggtaccgcgcgacgtaccccctctagtccctctagtgtgtagtctaatataccatacgtatgtatttacatataaattttgtagtatacacttccggcacctataaaactatgtctttgtgtagtagtgtttctagcaatatttttctttttatgcacaaatctcgaggcaatccgatagctataactctgaaagttttggaagtatttgctgaagttttctagcaatttcgttgacattttagtcctatggttcgatttttttttagcacaccggagatggcctgagctagctgatggctacgggacctcttggaagctagctagctctcatctcaacaaccggcattgacttggtattataagtctccctagtccctaggaacgaagagttaatccaagccaaatcgagggagatttgttgagcggtagagctgatcggctaattactgagaagcgtagtgcccgagaggcaactaggcaagctagctgaaactccgtcctttcgatgatgcgcgatgcacctgttcctatgctgcaagtcttgctacccgcttgatcgatcggttcgcgttttcacggacgtgcgtagcgacggaaattagcggaaacgaccctgctttatgtgcgtaaatacaccacgtcgtcgtcaacgtccacgaatgggctcggctgggaccgagtctgggcgtctggccacgaatagttctgataatgcggtgtcccatgtgatgtgattgtgagcgacctcgcggtctatcggcattggtcaggtactctcaatcgtcaacgtcgatatagctagcaaggggcagcgtatgtctctatttaacacgcagcccagagaattcagaacatgtacagtacaaaccacacagacaacgaaatggctaagcttcttctctccgctcttttgatctgcatttcagccatctgggtggtagccgcggccgacgtcccggcaggacgccgaggctgccagacgaggtgcggcaacctcgacatcccgttcccgtttggcatcggcgatcagtgcgcgatccacggtggtttcggcctcgactgcaagaacgacagcggcacttataggacattcattgggccgttcgaggtgactaagatctctgtgccggacgccaaagcctggatgaagatgggaatctcttggcagtgctatgacccggtcacaaaacagatgaatgattcgatggttgggcagaacttcaccaacacgccctatcgattctcatacgaggataacaagattttcgtcatcgggtgcaatacaatggcctacatgagaggtgtttcggtaagtatttcctttatttatgtttatgctttcaacctttttgacgtcaaaattggaaattttaacaaatacttgtatctattttgcttatgttaagtgactatgcttccagatcgttacataatttcaatctcaattcgtagatcacaagataagctgattttttacactaagctaattaattaacatctgtgacttaattatgcagtatgtcataggttgcttatccacatgctcggatgaaccaacaaatggttcttgctctggcgctggctgttgttcggtggatgtcccaccagacctaggctatgtcgaggcttatttcaataaagattataacacctctcaaatctggaactacagcaggtgcggctacctggtagtaatggaaaaggctgctttcaggtatagcaccacttacattccctcaataaacttctggaatgactacaacgggactgttccggctgtgatggactgggtaatcagaagggagacatgcgaggaagcgaaaagggacatgagttcatatgcatgtgtagcgacaatagcgactggcataattcaacgaatgggcatggttatctctgcaagtgctccaaggggttcgacggcaatccttacatcaaggatggatgcaaaggtctagcttcttctatcctccacctcctaaatgatcgatttgtgtatatatacacttaaaacttttactcaataacatatacatttttgttttgtttcagatatcaacgaatgtcttgataatactacttatccatgcgctggactttgtcaaaatacgatggggggttacgactgttcatgccatcaaggacaacataaggtggaggatgtctgtgttccagatcagaagaatcagaagtcctcttgggagatgcctgttgtaggtatgtacgtctagcaagattaatatttttgctaagatttacatattgattatcttattagtgcattagttgtaatattgagattcacttacttttaaatgttaagtggtcatctgttcgtcctagtattgttgttggctaacaaattatattcggcaactaggtgcaagtgttgggtttgtcatacttgttatcatagcaacttgttcgtacctgatccacgagagaagaaagctgcaacacatcaagcagaaatactttaagttacacggtggtctactgctgtttcaagagatgaattcaaatgaaaggaaatcatttacaattttctcagaagcagagttgcagcatgctacaaacaagtttgacaaaaaccaaattcttggccatggaggtcatggcactgtttacaagggacttctcaaggacaacactgaaatagctgtcaagaaatgcatgacaatggatgagcaacacaagaaagaattcggtaaagaaatgctaatcctatcccaaataaaccacataaacattgttaaactactgggatgttgccttgaagtacaagttcctatgctagtgtacgagttcatcccaaatggaacactatgtaatctcatccatggcaaccatggccagaacatttctccagttactcgtctgcggatcgcccatgagtccgctgaggcactagcctacctccactcctacgcttcaccacccatcatccatggtgatgtcaagtcctccaacatcctcctcgatgttaacttcatggcaaaagtctccgactttggtgcttccatcttagctccaataaacaagtcacaacttgtcacgctagtccaagggacttggggttatcttgatccagagtatatgcaaacatgtgagttaacagataagagtgacgtttacagctttggatcttatagaactgctcacaaggaagaacgttttcaaccttgatgctcctgaaaatgagaaaagtttgtcaatgaggtttctctctgctatgaaggagaacaaacttgagaatatattagacgatcaaattagcaataacgagaatatggagtttcttgaagaaggtgcggatttagcaaagcaatgcttggcaatgtgtggtgaggatagaccatccatgaaggaagtgcggagaagctcgataggttgattaaggtaatgcaacacccatggacgcaacaaaatccttgagaaatggagagcttgcttggagaatcttcttacattataagctcaggagccttgagtacaagaaatttcagcatcgagaagaaaggtgtcaaggacctagcatcagggcgtaagctggaatctctttgccacccagcatacatcatatcaccatgtcgtaccgcgtcgtattgtatcatagttttcacttaccctagaaattcagactcagttatgttcattattaattattttttgtgtaaaaataaaaaaatattgtttgtgtacacctttagtctttatgggactgtgtttcatcatatatgagaataagaagcaatcatacgaagtcaagttaatgttctatcactgtactattttccccaccgatttatgtgattctgtctaccgtgtggtaattgcctatggtacacttggtttcagcattttcttgaccaaaccttacaagatatgctgacccatgcatcttgcaacccatcctaaccaacttctaaacccaaaaaatgttgtctcatcgtactcggttgcgcattgacaaaagctgcgtttggtccggacattttcagcaattcgatatgtaaaaattaagttgtcaatgctgtgttttaattataaaagctgtgtttgaagcggatgaaaataaaaattaagttgacacgcacaaaacgagaaagtcattaactaagttttaattattacaaacttgataaatatatttgatattttaaagtaacttctaaatagaaaggcacataatacagtaaaatctgaatcttaaccgaaaataatagagctacagctcgcaatggaaaatgtacctttgtagttttgcacgcaacggagcatcacgcggaattcaccgttcgaagttacaagaccctgtgggctgtgaaacagtcaagtcttccatgatactgagcggagcgaagagaaccagaactgtcattagagaagaccgaccctgtgaagccccccaattgtacccaagacccataaacatcgctcgccaggtcgccgagaaattgtgtgatatggacgaggccaggttttctcaggtgaacgcagcctgtttttactcaatttcttggattaaagcagggccaatgtgatgtgaacggtggccgattggtacagttagactatcagccacacaaatttaacggatcaagtttattcacttatcaatgctgctatcacgcatgactgccaagttacgtcagtcgttcgaagtcttccgttgctatgtgtagttaatagagctggagatcgattacgatggaggaaaaacattttgaaaaaaaaaaaggtatatgcactctttcttttcgacgtaaagacccgggagtcagtcgtcgtccataattcttgggatatacttcatttatgatcaaatatacactttctgagatcttattccctctgccctattttatgtcctattttaagtacaacgataagttttttttgcctaactttgatcgttcgtattatttgaaatttttttataattagtatttttgttgttatgagatgataaaacatgaagaatactttactcattactgacttatgtttttaaatttttttaaaagtttttttaaataagacgaacgattaaaattgggcatatctggttttgcggttcgaggacgttttttatcccgataataagttgagggaccttcggtgtactttttcctttcccatgggagcacactctctagctataataactggattgtcgacgtggcactcatttggattaaaaacccacacaaactgtcacaaaccaagaaagttactgcaccagttagttcgaatttcaagttgttgttctaaatcatatccatccgtcgcaatttacttatagaaaaatgagtaaagtacacggccggtccttaaagttggagcgatgtgtcacttaggtccataatctaggaaaatcgtcatttgggtccgtgatcttgtttaagtgaatcatttaggtccaaagcgcctttgaccaggttgactggcttacgtggccgtccacggtgatagcatatttgcattttagccccccgcatcttggctctcccatatacgatccaaccattctcccccaaatcctcctcggctcctcctgtgtgatttctagggttagcgattgcaacggcgattgggtggcggtgtagatgtggcggcggccgcgaggacgacaacgacgatgagggaggcgcgtacggcggcaacggtaagggagaacaagcgttcgtcgtcctcatggtgtcatcagcggccgcgtcggcctccacctccgcgacggtgtctagctcggtccccgtggggctggcggctaagaacctgaagtcgatgcacaagggcgcgtaggacctcaacctggcgttcccgcatcaccacggccgcgccctgcagtcgccggagttcacagcgttcccgagcttggagagtagcaacatgtgcaaccccggaggcaacatggcggtggcgaacggcgttggtggcaggggcagcgtgggtgcgtgttctcggcgatggagttgctgaggagcattggctgctacgttcctctgcctcagatggggccgctagggatgccggcggagtatgcagccgtggggttccatctcggcgagttccgcatgccgccaccgccacagcaggagcaacaacaagctcagaccgtgctcggtttctcccaggacacgcacaacgcgggtgcaggcgacggctccggggtgttcggcgggtgcagctagtggctcatgcatgcacgcgtggtggtcagcaactgacaacatgtggagatagagaaatgagatagagacagggggagccaagatgggaggggggctaaaatgcaaacatgctgccaccgtggacggtcacgtaagccagtcaatccaatcaaaggcgctttggacctaaatgattcacttaaacaagaccgcggacccgaatgacgattttcctagatcatggacctaagtgacacctcgttccaactttaaggaccggccgtgtactttgctctagaaaaatagaaaaaaaagtttgggatccggagttaagggcttgtttaagggcttaagtttagaaaaatatatatatcaacgggatggctagacagaggattaagggcttgtttagttagaaaaaaaatttgccctacatgtcacatcagatatacggacagacatttaaagtattaaacgtaatctaataacaaaataaattatagattccaccaggaaactgcgagacgaatttgttaagcctaattattctgtcattagtaatatttaatatagtaccatattgtcaaattatagtgcaattaggcttgaaagattcgtctcgcaatctcctggcgaactgtgtaattattttttttttacatttaatactctataaatgtatccaaatattcgatataacagcgtgaaaatttttttttaaactaatcaggccctaatacgagcaagacaaaaaatagtctttttagctggtgcaacacttgtctactccaacctccaacttgttccgggggaatcacacgtctcactgtctcagtcacacaagacttggactcattcatcagtctccacaatcgtggaccgactgctactgtacctcttggaagctactccagctagctagttgctctgatatgctctgagctcaacaacagcggcattgacttggcaagtctccctgggaccctagagttaatccagccaattagagcgacatatactaagctgaccggctgactgagtaaagcgtgcatgggcgagggcgagtatttcgttgatggaccatcctgaatcctttagacgccacgtattataaaatatagcaatcgggataaaagacatattttagtagtatgaaattgaacaagaacctatctattatattattaaaggcatagaaaaatgagtctccacgttcgctctcatggtctagaaattctcacattaatcaaagaaaaagaaaaaacagtgtccatatataaatataatttagaaatagctgaaattcagaattaaaaaataatgaatattagaagaggatactagagtccatatagaaataaaatttagaaatagttgaaattcggaatttaaaaataaagaatattagaataggagactagagtccatatagaaatacaattaggaaataactgaaattcggaataaaaaataaggaatattagaagtagagtatagagttcatatagaaatacaattaggaaataatagaaattcggaattaaaaataaggaatattagaagtagagtatagaatccatatagaaatacaattaagaaaaaaaaagaaattcggaattaaaaaataaggaatattagaagtagagtatagagtccatataggaatttaaaactaactaaaatttgaaataaacataataaaattaaagtagagtttagagtccgtataaaaatataatttacaaataactaaaatttgaaattaagaaaaacatgggaagaagagtttaaagttaatataggaatacaatttagaagtaactgaaattcaaaattcaaaattaaagaatattaaaagatgagtatagagtccacatagaaatacaattagaaataataaaaaatcagaaataaaaataaataatattggaagaagagcctagagtctatatatagaaatacaatttacagaaaatttaaaattaaaaaaaagaaatattaatagacgagtctagagtcaatgtaggaatatatataatttacaaataattaaaatttgatattaaaaataattaagaactaacacatatataaaatactatatgaatattacacattaacattagtagtttcgtaaagttattgcaaaatttaaaattatgttattattttaatatatttgaataatataataagaaaatatatatgctattatatgagagaaaatataatgatactatcatgctagtttagatttatagaattaaattatatcaaatctaatactagtttaatatattttagaatgtttgcctttaggggttgtatttttctcctgctatatttaatgaaaaagcgtaatctcgtgtggtttctgttaaaaaaatatattttagaatggagagtacatgacaacagactttaattcctcgtgcgtgtgcctagctataaggaattatgtcatttaaattttttttaaagaagtagcaaaaggatatgccatagtataaaaggtgataggtggaaggataaaataagacaaaagttgataggtaaagaataaactattacacaagttgatagatgggaaaataaaatactatcttaagattacaaaatcccaaaaaaataaaagggtaaaattatttatatacatggacgaaagtatcatatcgggaatgatcaataatcaaccaccagcttttattaatcacatactgcagggcaagctgcccagggacagtaaagcggatatctctatttaacacacaccgcgtcacgccccagcaaagcacacactctcctgtctcctccagtctccacacacacacgcaatgactaagcctcttccctccaccattcttctgatctgcgtttcagccatcgggatggtagccgccgacgtccccgtggctggacacccaggctgccagacgaggtgcggggacgtcgacatcccgttccccttcggcatcggcgatcactgcgcaatccaccatggcttcaacatcatctgcaagcctgtcaacggcaccaagaggcctttcaaggggtcgtttgaggtgacgaaaatctctgtgcgcgatgccaaagcctggatgaagatgcggatctcttggtagtgctatgactcggcctcgagcaaaatgaaggaatgggtggatttccaaaacttcacctacatgcccttcaggttctcatacgaggataacaagattttcatcatcggttgcaatacaatggcctacatgagaggtgtttccgtaagtatctcctcatatttatgctttgacgacattttgcttatattaatatactaggcgctcagtactgatcgttacataatctcatttaatttaacgtcatagatacaaattaacatctgtgacttatgcagtatgtcataggttgcttgtccacatgctccgatcaaccaaaaaatggttcttgctctggcgctggctgttgttcggtggatgtcccgccagacctgggttatcttgaggcttacttcaataaagactataactcctcagaaatcagctacagcagttgtggctacgtggtagtgatggaaaaggctgtgtaagt

SEQ ID NO: 4695 - DNA, 5658 bp, Oryza sativa
  unsure (1)..(5658): unsure at all n locations
actacaacgcttgcttttctaagtcaagtcgtcgtttgtcctagtattgttattggctgacaaatttatattcggcaaccaggggcaagtgttggatttgtcatacttgtgatcatggcaacttgttcgtacttgatccgcgagagaagaaagctgcaacacatcaagcagaaatattttaagctacacggtggtctactgctgtttcaagagatgaattcaaatgaaaggaaatcatttacaattttctcagaagcagagttgcagcatgctacaaacaagtttgacaaaaaccaaattcttggccatggtggtcatggcactgtttacaagggacttctcaaggacaacactaaaatagctgtcaagaaatgcatgacaatggatgagcaacacaagaaagaatttggtaaagaaatgctaatcctatcctaaataaaccacataaacattgttaaactattaggatgttgccttgaagtacaagttcctatgctagtatatgaatttatcccaaatggaacgctatccaatctcatccatggcaaccatggccaacacatttctctagttactcgtctacggatcgcccatgaatcagctgaggcactagcctacctccactcctacgcttcaccacccatcatccatggtgatgtcaagtcctccaacatcctcctcgatgttaacttcatggcaaaagtctccgactttggtgcttccatcttagctccactagacaagtcacagcttgtcacgctagtccaagggacttggggttaccttgatccagagtatatgcaaacatgtgaattaacagataagagtgacgtttacagctttggagttgttcttctagaactgctcacaaggaagaacgttttcaaccttgatgctcctgaaaatgagaaaagtttgtcaatgaggtttctctcagctatgaaggagaacaaacttgagaatatattggacgatcaaattagcaatgaagagaacatggagtttctcgaagaagttgtagatttagcaaagcaatgcttggcaatgtgtggtgaggatagaccatccatgaagaaagttgcggagaagctcgataggctgattaaggtaatgcaacacccatggacgcaacaaaatcctgaagaattggagagcttgcttggagaatcttcttacattataagctcaggagccttgagtacaggaaatttcagcatcgagaagaaagttgtcaaggacctagcatcagggcgttaagctggaatctctttgctacccagcatacatcatatcaccatatcataccgcgtcatattgtatcatagttttcacttaccctagaaattcagactcagttatgttcattattaaaaaaattttgtgtaaaaataaaaaaatattgtttgtgtacacctttagtctttatgggactatgtttcatcatatatgagaataagaagcaaatcatacgaagtcaagttaattttctatcgctgtactattttccccactgatttatatgtgattctgtctaccgtgtggtaattgcctatggtacacttggtttcagcattttcttgaccaaaccttgcaagatatgctgacccatgcatcttgcaacctatcctaaccaacttctaaacccaaaaaatgttgtctcatcgtactcggttgcgcattgacaaaagctgcgtttggtccggacatttttcagcaattccatctctaaaaattaagttgtcaatgctgtgttttaattataaaagctgtgtttgaagcggatgaaaataaaaattaagttgacacgcacgaaacgagaaagtcattaactaagttttaattattacaaacttgataaatatatttgatattttaaagtaccttctaaacagaaaggcagagaatacaccgtttagtaactttagtatgcaatcgaagtaaaatctgaatcttaaccgaaaataatagagctaaagctcgcaatggaaaatgtacatttgtagtcttgcacgcaacagagcatcacgcggaattcaccgttcgaagtcacaggaccctgtgggctgtgaaacagtcgagtcttccatgatactgagcggagcgaagagaaccagaactgtcactagaaaagaccgaccttgtgacagttctggttgccgagaaattgtgtgatatggacgaggccaggttttctcaggtgaacgcggcctgtttttactcaaattttttcttggattaaagcagggccattgtgatgtgaacagtggccgattggtacagttagactatcggccacacaaattgaacggatcaagtttattcacttatcaggtcgctgtaaatttccttgtactgttgtacacactgctgagaccagtagctaggctagctcacagtagttcgcctgcggaggtttttccctatgtgccattaaaaaagatggagcatgtctatctaccaataaaaagttcgagcctccctctatgtcatcgtcgaactttattacgccctccacaccattccgtcgctattctgttttggtttaactgtttggcagctctgacatgtaggccgggcggaaaaaaatgtctctattgccctttcttcttttgagtgcgagagagagagagagagagaggggggggggggggcggttgagtgcgcggcgcgccggcagcctggaggaggacagggaggcatacatgcgtctctcagtggtgtcgtcgtcgaaaaggggtggtggtggtcgattcctccggtttcttcctctcactccttccccctttctcccacgcgcgagcgcacacaagcagcggcagccagcgcgcggtggcgcggcgacgaccgggcacgncggcgcctggtgcttggcgcggcggcacggttgcagcagcgtgggtcaaggtgagggagggcgatgcgggtccgacggccgtggtggcccttcggcaaaatggaggaggagacggccggggagcaccgtcctcggagcgccaggcaggaggcggtctggcgccggatggggaggcagccggcggtgtctctgcctcggctcggtggacggcggcgccggtgaaagagaagactgtcgtgcagggcgacgtgaccgtggaggtggagctctccgcggagtcggcctggccgtgcgcagcggcagcactcacgcgggccgatttgtctgcgggcgcggtggaggacaggcgcggcgctggcgatcgagcgggcggtggcgatgttcgcgctcgccgcggagtcggcgcgggcggcagcggtggaggacaggcgtggcgcggacgggatccggcgcgcatcgctcagctcatcggccctggcgtcgagccgcttgagctggccctcaagctccagctctcctccagtagcgcggcgagctccccgtgggtggcgccgacctcgccgtcgatcttgcggtcgacggcctcgagcagcatccggaaggcgcgggcaagagacgcctcgacgtcggcgacgagggcgtcgtacccggccatcgcggcctggtcgatcggctgcgccacgcgccaggtgaggtcgccaagcaaccccatgggcaacaaactcatttggctgcgccgttacccactgttagaaaaaaaacagatggaatgatgtggagggcgcgataaagttcgacgatggcatagagggagacttgaactttttagtgacacagaggcaggcatcattttttttttaatagcacataggtaaagacctctcgctacagtggcaggatagaattaacatggatgacaacaggggagatgaagcggttgtcactcaatgctgctatcacgcatggcctacgcgcttaagtcacgtcagtcgttcgaagtcttccgttgttatgtgtagttagtagagctggaggatcgattacgatggaggaaaaacattttgaaaaataaaaatatatgcactctttcttttcgacgtgaagacccgggagtaagtcgtcgtccataattcttggaatatatttatgatcaaatatacatttttcgagatctttattactccttctgtctcattttaagttcatgtgtataataatgagtttttttttgcccaattttgatcatctgtcttatttaaaatttttttataattagtaattttgttattatgagatgataaaataggaataatactttactcgtaacttatgtttttaattttttttttcaaaagttttttttaaataagacgaacgattaaaattggacgcagaaaattatacttacacttaaaatgggacttagtctagaatctcacgagcgagacaagtttatccccctctgaattctttttccatcgccacaagcatatcctacccatcatatttaaggaggccgctgccgaaattcccaagcacaccaaccaaaacgcacaacaaaccggctacctaaggagtacggacaagcaagtgcagcatatggagcgtcatcagcttcttcttcttcccggatgccttcttctctaccttggcgccatcgctacgcttgccgcggccgacgtcgcaattccggccggtggccagcctccgggctgccggacaaggtgcggcgacgtcgacatcccctaccctttcggcatcatcgacccagacaggccagactgcgcctacagcaggggcttccagctgaactgcacgtccgtgaacggcgccgcgaggcctatgtttcacaatatcgaggtgaccaacatctccgtgcccaacggaaaagcatggatgaagacgaacatatcctcccagtgcttcgacccagaaacaaacagaaccttgtacgatgacatatggaacagtttcagatattcaccttactggctgtcaaacgaggacaacaaacttatcgttgttggttgcaactcactagcttacatgcgcagtacctcggtaagtaatttttgcatattttatacattatcagtttcttaaggaataggaaaggttgatattctttttaatcgcaaatcatgacctcacaaccccaattccgaaaacagagcatctttacctcattcaagctagcccactgtacttggtgtttctcagccactcaaaagttatagaatccataaaataaagtagagttaattacactttgggctaggaatttttaccaaagtttcactttggacgagggataaagttatcttatcactttggactagataaatttacaaaagttttaaattggaccacccttcttctccatcaatcttccctccttttctctattaagcagccgcgctatggaatctgagggatgatcaagcaaagtaccaggattccttctctctctgctctgttccgagcttgaggaaccagcaaaatcaagactggtggtagctggctgctgtagctgtcgcttgcaagctcaatacagtgacttgttctaagctcacatgataaattaagggaaaaatggtagaaatcaagcagctaaatcaatgagtaaagaaatcaaggtcaggtggaatattgattggtttattgtgttgcgggtaagctcgctaatgaaatcaaggagtggcaaacaaaaaagtggtccaatgtgcaatagaaggtaagaaaacctggaccaaagtgaaaacgttagatataacctagtccaaaataaaacacaggcagggctg

SEQ ID NO: 4696 - DNA, 10237 bp, Oryza sativa
aaactagttcgacttgtcataacatacatataagtcgaaattcccctcccaaaaaaaataaaaagaacttgattgggtggattttgtgtgcgaccaactatatcactacagggcatgttcggctgcaaggtgcagctgccgaacaggcccacaaccaaagagggcttagagcccatttccatatgaatcacaaatgaactctatgttgaagacactaatcctagttctactatgttaagaaagctatctgttttgcagcacttgttttaacaaatataattgcaaactctcatggggtcgtgctgttatttgcagtttataacccgccaatccatgcagtacgtaatcggttgctcatcaacatgcgacaacgtagaccttaagaatggctcatgctctggtgctggctgctgccaggcagatatcccgaaaggcatacggtattaccaaggttatttcaatgcaaactacaacaccactgcaatatggaggagcagcccttgcaactacatggtagtcatggaacttcagcattcaactttagtaccacttatgtcgactccacagtattcagtgatacgtacaaggggatggttcccactgtcttggattggacagttgaatggaaaaaatgcgaggaagcaaaagagaacagaacttcctacgcttgtgttagtagcaacagttactgtgtcgatgccaccaatggtcgcggttatcgttgcaagtgctctgatggatacaagggcaacccatacatcacggatggatgcgaaggtccctttccggccattttgattcctctacccctgcaaattaagagatgtagaaaaagtattatatttttaagtctttttttggcagatatcgacgagtgccaagatgctcatccatgcacgggaatttgcataaatacgcaggggagctacacatgtacatgtcaacgaggaaaacatctgattgacggtgtttgcaagcagagttcctcttcttggattatacctgtcataggtccgttacactcttcagcgtctcaaaaaaaaaggagaaattgtacattgacaccaatcttgaacataatagcgcattacagtaaaaccaatctgaacatatagtaggaatcaatcatattattcatgttcattaaaatttaaggttgaaaaccccggaaatgctttcaaatcatcattttggagtaacatcactttggaaaccatgcaggtggaagtattggagttgtcacccttgtgactattgtgacgtgtgcatatctcatccaagaaagaaataagctacacagcataaaacagaagtactttcgacagcatggaggtcgactgctatttgaggagatgaagggtactgcatttaaaatctttacggaagaagaattgcagaaagccactaataatttcgatgaaaagaaaatcctaggtcatggaggacatggcaccgtttacaagggatttctaaacggcaacactgaagtagcaatcaaaagatgcaagacaatcgatgagcaacaaaagaaagaatttggtaaagaaatggtaatcttatcccaagtcaaccacaaaaatattgtcaaactattaggttgttgccttgaagtggaagtcccaatattggtgtatgagtttatcgcaaatggcacactgttccatctcattcatgatggccacggcaggcacatctctatatccacgcgtttacagattgctcaccagtctgctgaagcattggcctaccttcactcatgggcatcgcctccaatcctccacggggacgtcaagtcatccaacattctccttgatggtgacttcacagcgaaggtctctgactttggagcctccatcttatcgccaaccgatgatgcacagttcgtcacgtttgtgcagggaactcgtgggtaccttgacccagagtacatgcaaacatggaaattaacggataagagtgatgtatacagttttggggttgttgtcctagagctactcacgagaaagaaaccattaaattttgacgggctagaggatgagaaaagcctatctgtgaggttcctttctgctgtcaaggagaacaagcttgaggaaatcttggatgatcaaattaagagcgaggagaatatggagattcttgaagagattgctgagttggccagacgatgcttggaaatgtgtggtgagaataggccatcaatgaaggaagttgcagaaaagcttgatagcttgagaaaggttttgcaccatccttgggcactgcacaatcttgaagaggcggagagcttactaggagagtcatcaattgttagctcggaggttgtcagtacgggaaatttcagcattgagaagaaatctttaataggcctagaatcaggaagataatcgctaataaccttgttgtatatcatatcccaggaaattatataggtatactccaaaagtattacatgtataggtaatcgtcatcatatatggaatgattcatacatgttttatatgtgtagctcaaggttgcatcattggtaagatccaaaggggaggttgtgttcaattgctattgaagcttacctttcaaaaatctatgtacaatagtaattgatttgatatttgacacacattttctttttatagtttgatcaattctcatactgctaacaaatcacgacaacatgtacttttcaagaggttaggatccatatgctttgcaagtttatttattctcagaaatagcttatcagtaaccattcacctgcacatatattgaacaccaaggcctgccgacatactataattagatctcctcataagaaactaccgttcattataatcttgcatactccaataatcaagagagtggcataatatactttgcttgtaagccaaccgcttaaacattctattacccataggtcaatctccatcagaccaattgaaaaaaaaatagttttattacccataggtcaatctccatcagaccaattgaaccaaagaaaaaaaatagagcaactatgtgtatgtaaattgtttcatagcaaaacaacattacctcacaatggcatcagtcctacagtggctggtaatggcatccgtattgggagcatatactcctgaaatcaaactatttgtcccacccttccttgagaatcgttgtctgctcctgtaagaagtatacataaatataaatcagcatcttaaattatataaaaaaaaggattaatctgaaggcagtttctgaacaaaccgattgtatcctactccaattaacatagactttttagagaaatattaaaacgcttaatttaaaccagaactataaatctatactctaaccaacaactaaaaaaagggttggtactccaaccagtatgcagttatgcacacgagggttgggatgggagcattggacctcgggatgctgcatcaggcggtggcggcaggagattaccggaggacgggatctaggcgttcttccgcgcctgcttgatgcggtggtggcggcgccgcccttcctaccgccggtccgcccgtctctcggccgccgcatcgattgatgatgaggggaagaaacctgcggctgcttgggcttgcggtgcgaggctgcgaggtgaaaaagaggccagtgttgatgggctccaaaattcagattggtggcactggtagcccaataggacttttgtttcggtaattgggttttacatggttctgtagttcgaattgggcctcgtggtggataacggataactggcccgtacatcagcagagctgttgatgacgaggcaaaaagtccagtttgagtccctcagatataggtcgaatctaaagtgcatccctcaaccgtaagaccgggtacaaagactccttcaactattaaaactgggacaaaatgactcctaagatagtattgaaggtggttttcgctgacgtggcatccacgtggcagcttagtcactaaataaactaaaaaataaatgtggggcccacatgtcggtgtcctttctttttctcccctctcttttttttcgaccacgtcagcaatacaaccctccacaacaacggtgccctgcactcgctcgatccgccttctcccccttcttcagcatcggtagaggcggtggtgccgtgcactactacaagaaggatttctccgtgcagagcttttgtccatctgtagccaagtgtctgcacccaaccgcacccgtgcggttgggttaagtggaccgcacgggataattgattatcccatgcggtcaaattataccgcccgcacgcaaccaaaaaaaaaagccaaacaaaaaatagaaaaaaatcaaaaaaaaaacctaaccttaaccctagaaacacccgtcgctgcacccggccgccgcccgagctcgcggatccgggcggggggcggtctcccgccgccgagcctgccactcctgtcgcaccgaaggagaaggagaaggagaaggagaaggcgcgagagagaggagagaagggggccgggggagagagagagaggggatagtgaggagaagataattaaagggggacagagaggagagaggggcggaggggagagagagagagaaggaaatttgaaattttttgaataggttgagagggaatggatattttcctgtgcgggtggattaggaggcccacatgtggaaattgtgtatttttccgtcgggcatgttaaaagggacgcctgccaaaatcgattttcgcgtgcggcctcttaaggatccgcaggtaaaaataggaggcccgcacgtgaaaataggagtgatttttacagacgcacatgaaaaagctccgcacgagaaaatgggaggtccctgtctagaaaaatcttatgtgtagtagtggtggtaggctgcggctagcagaccttcgcgatgctgccctctgcgacgttgccgtcacggaaggcagggtgattgttatccacctagccttgcccacatcctgatggccctggacttggatgtggtgtaaggcggtgcagatggccttgcacttgtagcggcactcgtggcagcatatgtgcgaggccgttgtagcgccggcagcgcagtacctaacagctattctccggcatctccagggccatttgaggtgatgggcatcgtcgacaccctacgtgcacttgtgcttgctttaggtaatacaagctttcaatcatatgatgccataaaattttgtttggtttggttggttggtcaaggtgtttatgactttagttgcttcagttcatccacaccacctgtactactgatgaagaaaagtacacacattactttccaatagtagagagctaccgcaaggcccacgagatgaaatgagatgaaagcccaccaccggcacccgcctctcccctaccgccgctgccgtcgatcaccgttggttgctcccgctctccatcggctccaccctctactacaccctcctcctcaccaccttccctctccccttcccctcctttgccggccggttgtgtgcaaagtctgggaccacgacgtcaatccaacgccccaagggatgcgagtgtgggactgcagcgtcgcgaactgtggctagctgtagccagcgccatcaccgtccttgtcgatgccagagaagggggagaaggcggattgagtgagcgtagggcgccgtcgtcgcggagggccgtattgccgatatggctgggaaaagaagagagtgaagaaaaagaaaggacgccaagtcgccgacatgtggatcacatgaatattttttttactttattgactataggcggccacctaagtaaaaaccactttcaacgttgtctttggagtcattttgttctgattttaatagttgaaggagctgttatatctattttacggttgagggatgcactcttgttttgacctatatccgggggagccaaagtgaactttttcctcatgacgagggagaatatccggtgaaaccatcggtgccagggagaattcataaaaacaatgcctaaaagatttctaaatttataaaaccaatactatcaggtatagtcataaaatgtattcataccagatcttacctccaaactcaacttctttccttttagagagaaaaagaaaagccaaatttcaggtaagtagtactccctctattccataatataaggcgcgcacgtattttaagatttaacatttaaaatatttgaccaacatttagtataatatgaaatgaattttatttgttaaaagttatatcattagattgacatttaaatttactttcatatgattatacttttgttgctacaaatcttatagtatatgagaaattataatctaaagattaattttggagaccgtgtcaacttttaccatgccttatattatggatgaagggaatattacgttagtattcacctagaaatttatctttttattactccataataaggtgaattgaacttgatatttgataataatgtatttcatgcatgcactctagaaaattttttatgaatttataaaacttttaagtttggtttttatggattttcacttatttgattatttttaccggataaatcccctcgtaacacttttaccatgattgctttgtgatacttaattaattatggtttggttcctggagaaaggacctgcatgccttatcgtcctcaagatgtacgccgtgccattttcattgctggttgtgtgtaagctggctttggagggcaagcagatcgatgattgcgacaatatagaaattcaaattagcatcagcgacgacttgttcccaggctcatatttttttattttccacgtgcatacttttcaaacggcgtaaataatacgcttttttttaaaaaaaatctataaaaaattactttaaaaaccatgttaatccgtttttaaaagtatttttaagctaatgcttaattaattatgtgctatgcgtgttttgctttacacgccagagataaggagttctaatcagtagggatgcaaatagatcgatccatgaatccactcataaacaaaattagtgggtaactcacaaattgaccggtggattacccaataatttagtctacaagtgagttcacgtgataactcatttgtattcctaggtacggtaaccagacctatacttatttgatctataagtgatttgcagctcagtccacttacattactaccaaccagccagcgctagtagcaatttgaagatttcatatgtgtgtgcctattgtggtaacatgcaatggtcgatgaatatgcgaccgacaccggctagctagttcatgtacatacccaagttgaagccaagatcttctagaacgtggtattaacaaaacaaaggaccccataccatcaggtgagtagggtcgttttcgtgagttaagtgcacatgcatattgacatagtcttcctttgagggctcactagtcattaaatatcggcttaattaccggaaaatctacaagtttcccccatttcgtacgcgacaactaataatttcatggaatgtgaaacattatattgcagtttctcgttactgagaaatattagttttttttattaattttctcctaccccaatctatgcactcccgtcaaatccaaatttaggtctgaagcgtgtggctttagaaaccattgcatcaacttgccaaactaaagcatcaagcatggatcgaccagaagcacaaataactaggtgcctatttggtaaagttataactcctaaatttaacttcaggagttgggtctgtagtgaagttgtgaagctacctaaacccagctccaactctctattacagttgcctaaacccagctccacctcttttattttgtgagaaagctccacgtagctccactcctattctaggtagccgaaattgtttggctaagctctagctccagaaaaggtaaaactggcgttggagctggaactttgccaaacagactcaaggattctcacactaacctttccaaagagtaaattggacatatgaatttcacacagcataattcactccgacggtttttcaagctagtgtgcacagggaccctatctaatcatagcactttgaactatggcagtgtttagttcccttcaaactttcaaaaattttgtcacatcaaatgtttggacatatgtatggagcattaaatgtggacgaaaaaaaccaattgcacaatttgcatgtaaaattgcgagacaaatattttgagcctaattacgccgtgatttgacaatgtgatgctgacggattaattaggcttaataaattcgtctcgtactcccttcgggctgataatacttgttattttagacaagggtgaagtcaaactttagaatctttaattatcaattatttttaaaatatttgtcttttaaatatggtgactacatgtatagattagtcttaaaaagtactttaataaaatcatatatttgttaacatttttatacatattataatagaaaataatggtcaaagttattttttggagaccgtgctcttgtccaaaacaataagtattatcaacccggagaaagtagtttacaagcagaatctgtaatttgttttgttattagcctatatttaatatttcaaatgtgcgtccgtatatttagaaaaaattaacacacgaactaaacacgacctgtaatggactaggtatccacttgcatcaaaatgacacgtatatttgatcagacattaatgcgtttctcttcaaaaatgtgaaaaaataaaggtacatcaattctgcacgtagccgatcagtagcaccaccggctagcagtatagcgcgcggaattttgtgcagcgtgtcgatgtcatacgcaatgtctttttttttcctaaagaaagtcagtacaaacgcaggtcctcatacatatactcacccttgtaaacataaatacacacatcctatccctataaacattttctaaagactagatcagtatatcttgagaataatgaagtcatcactacggacatctcgttgtcgataggtacatcgtctataactaaaataataattagtcgtaactacgagcacctgtatcaagtcatgcactgtctttgatagtgttaagcatacaaagctcttccaactaagtaactttacctttttaaaaatttaccgaaaagttacatattttttttaaaaaaaattagcattatagattaagatttaaaatttggaactgaaatttctaacatttcgggtccatcgagccccccccccctcccccaaaacacacccaaaaaaacgagatgattgcgggtgattttttcgcgtatttagaaaaaaaatgttcctatttaatcaaattttgttcaacattacaaataattttgaaccgaaatttcagctatatcagtacttatagaaatagagaaaacaaaccgttataccctgctccagatatttaagtacatcacttcgagataccaaaattcatacgtcgatactttttcaagtatcgtaaaatttgcccttccaattaccatagacctgtcactatacatcaaagtatcaaacgaccggttctgcgaagcctccctggtgtcatttcaataacaacatgcatgcatccaacataagcagagagagtcttatttaggccagtgcatgcacccaaccaagcaacccattttaatataaagctacggcatcatatgccttggactgacacacaagttcttaatttgtcattagaatatcacataagtcctttcacttgcttgctctttgtgtacatctttcgccggagcagccagagccatcgccatcgccatcaggccgctaatggccagccgcccgccgcttcttctgcagtactcgtcgctgctgctgctctgccttgccgtctcggcgccgccggccgcagccggcaacgtgccggcgccggtggcggccgtctcgaagccgggctgcccgaccaagtgcggcgccgtggacatcccgttcccgttcggcatcggcgagcactgcgggctcgaggcgccttacacaaactacccgttcaagttcgactgcaagcccgttgacggcaccagcaagcctttcttcaggggtatggaggtgaccaagatctccatggaagacggcaaggcctggatgaagatgaacatatccaagaactgctacaaccagtcgacgggcaccagggaggacaacaccaacacaacatctgtgagcttcagccgctcgcctttctggatatcggacagggataacaagatcatcg

SEQ ID NO: 4697 - DNA, 3900 bp, Oryza sativa
  unsure (1)..(3900): unsure at all n locations
tctccatgaaagacgccaaggcttgnatgaagatgaacatatccaagactgctacaaccagtcgcggggcaccaggaggacaacaccacacacatatctgtgagcttcacccgctcgcctttctggatatcggacagggataacaagatcatcgtcatcgggtgcgaaacgttttcgtatatgcagatcaataatgtaagtatatgcccataattcgtcatctggttgcattagatcacaaatactcaaatgtgttcataatatatggcctttaaaatacatgatagtctaaattattattcctttatatatcaaggacgacttaggatttgtcatgtgagaatattattagtttctccctttcacatgcatgtggaatgcgtgtggaaaatttgaccgctgctatttcaagttgacttttgaaaacgatatgacaatattttcctttaaaagtactttcaaaatattataaatgtgctatattttgtgtacattttaatattagtaattaataatcaaagtgatgtattggtgattgtgtaggtatccaaaacaacacttacttgtgaattggaggtagtgtgtatatatgagaaattcagagcataagtatatataattttgtagtggttggaagttggcatgtggccaaatggctgggtggtgtgattgtaagcctatcaatgtttaaatcctacatttcatattagtgtccatcgacattaggagtaaggagtacatatgagcatattcgttcaatggaaatacatgtgcctacctacaattcagagccttttgatacttttgatggagtatatgaaattgtgaatacaaacatactcttggtgtgtttagttccttggccaatttttttttaagtatacagcacacatttaaagtattaaacataaactaatagcaaaacaaattatacattccgtctgtaaactgcgagacaaatttattaggactaattaatccgtcattagcaaatgtttattgtagcatcatattgtcaaataatggtgtaattaggctcaaatgattcatctcgcaatttacatgcaaactataaaattggttttttttcgtccacatttaatgctctaacatgtgtccaaacattcgatgcgacgtttttggcaaaaaaaaaatgaatctaaacacggcctttctcaaaattaaagggtgtgcttgaaaatcgtgtcaattcccaaataggatgtgtgtgtgggggggaattatttggatcattgtcaaatcttgtattaaggtgtatatataatacgtaacatgtgcaggttttaacaggttgtgtgccctcatgcagaaacgaccccaaggacggtatatgttccggtgaagcgggttgctgcaaacttgatttccccaatggcacatggtactatagtacttatttcagtaaaagaaataataacagcagtccttgcagcttcataacagtgatggaaaccacaaccttcaacttcaacaaaaattatttcaactccactacattctatgacacatacaatgggttagctaaggtttccctagattggatcataacaatggattcatgtgatcgagtcaaaagaaacactacttcatatgcatgcattagtgaaaaaagtcgttgtgttgatgatccaaagggaggttaccgctgcaagtgctctgatggatatgaaggcaatccatacgtcaaggatggatgcaaaggtatagtcatacacaccttcttatgcctgctgcctatctttgttacaaatgtataagataatgcaacaattttaaccaaatgtgttgatggtttggcttcagatattaatgagtgcctcgcaatgctacttacccttgtccgggaatatgtaagaatacgttggggaatttcacctgctcatgctaccctggaaactatatgatgaatggaatttgcattccaaatcagaagtctggttttcctaaaaatcttgtaataggtgagttgtctcttcctataagaattaaaatggcatgtgagatcgatatacatttatgtttttgcttatacatttgtgctatatttagttatttactatatagtagctctatcgttttcctcatgcagatatagaaaaatataatcctaatttacaatgcctctactatatatatagttatatgtttaaaaatggtattcgttctggctttcaagtttaaacaataaggtgtgtatgcataattaatgtatttttcattctgaagctagccctcatttatctacccttttactttagcatttagtatacattcattcttgcaactatatctcttttctagatattcctaatattaatttgtacaccatagcaagaccagcaaccactgatgaatcatgcatgcatggtgtgtatttttctatagtaagaagaatggacacatttttgatcatgaacatttcatgttccaactaatgatgaaatcctcacgaactcctcaagttgctaaagaaaaaaataatttagtgaatcttcctctgccaatgccgatgtggcatatgtgggacttccttggggctagcataaagggatcaactacacattccaataatcttttcatagcaattctaaagttttctattatatatgcaggagcaagtgttggggccgtattactagtgattatagtaacttatgcatgcttcatcagagagaagagaaagctacagtatgtcaaaaggcggtacttccgccaacatggtggtatgttgctattcgaagagataaaatctcaacaaggcatttcattcaaaatcttctcagaagaagaattgcaacaagcaacaaacaagtttgacaaacaacaagtccttggcaaagaaggcaatgcacctgtttacaagggacttctcaagggaaacacggaaatagccgtcaaaagatgcatcacaattgatatgaatcaaaagaaagaattcggcaaggaaatgctaatcttgtcccaaaccaaccataggaacgttgtcaaattattgggttgctgcctcgaagtagaagttccgatgcttgtctatgagttcattccaaatggcacattgttctctctcatccacgggaaccacaatcaacacatctccttggatactcgcttacgtattgcacatgaatctgcagaggctcttgcctatttacactcatgggcatcaccaccgatcctccatggcgatgtcaagtcctcaaatatcctcttagacaaagattatgtagcaaaagtttctgacttcggtgcttccatcctagcaccaactgatgagtcgcagttcgtcactctcgttcaaggaacttgtggatacctcgatccagagtacatgcaaacatgccagttaacagataaaagtgatgtatatagctttggagttgttattctagaattgctcacaagaaagaaagcattcaaccttgaaagccctgaagatgagaggagcctagccatgaggtttctatcagccatgaaggaaaaaagactttctgatattttagatgatcaaatcatgacgggagataatttggagtttcttgaagagattgcagagttagcaaagcaatgcttggaaatgtctggtgagaatagaccgttgatgaaggaagttgcagacaagctcgataggttgaggaaggtaatgcaacatccatgggcacaacaaaatcctgaagagatggagagcttacttggggactcttcttacgagatcaacaactcaacggttgagaatacaggaaatttcagcatcaatagtgaacttcagtgtctagaatcaggccgttaaattggagtttgttatattgtgtcataaatgttatagtgtatcataggtggaagcacgtatggtatcatatatgccttgctgtatcttgggaa

SEQ ID NO: 4698 - DNA, 6708 bp, Oryza sativa
tatattcgtattcttggctctggggtttttctttactagcaaaggacatgtgtgttgcaacagaaaaatcaataaatcaatggaaaatattagtgaacagaaacaaaggatgtcaagcgtggggaataattcaccgcttataaacttttctaccacatacacaccatatcatagacttttaatatttctcatgaattgggaaaaagaaagtcaaattttgtcacatgacactcaaagtttgtgtaattttctactagacatcgcaaaagcgtgtcacggttggaggacaccaaaaaactcataatttgctatagggcacttttaacccaatcaaagagaatttttaaaaacgagaatacccctatagccaaaaacttctaacctagaattggagtgttgatggaatatgatatatgctagcaatatacttcggctgatggaagatttagagttgcataatttttattttttaaaatccaacactaacttagaagcttgtggccccaaaagcattctagtctatttaaagaatttttccaatcgagccgaaagtgttcttcaggaaattatcaaaatttgagggtatcatgcagccatagcacacttttctatgtctgatagaaaattacacaaactttgggtgtcatgtaataaaattttccaaaaagaaaaaggaagggaaaatagtgatgcagtgacaacctacacggtaggagtccatgcaatgatgcaaacggagtcaagtgctccactgaagagcaaagagactaagtagagtagaaagtgtcgggctctctgaggtactaaggtatgtcgcaaacgtgtgcagtcagacgtgtggggtgtaactgatatcgtgcgaggaactatgaagtcatatgagacgacggaaatatgttagattttttactagtcgagataaaaagatttaccaaatcctagctttacattggatggatgaaagtgaatattgatggatcctttggatgaaagtgatcaatgttgatggatcctttgaggctagccacaaaaaagggggtgttcagggaaacctatttccgctgcttgcacttatctgaacaggtgttgcaacgcactggaagctgaattgttggcgatcagaaaagggattgttctagcgcttcaatggaccctagctatgcccgatcgctttggaaacagattgctttctagcgctgcaattgatccaaacaaaagagaagaatttgtcagaattggctttcttagttagagaggtgtgtgaccacatgaatggaagtagggagatcttgctcgggaaaatcactgaagtcaaaactttgttagccactctttagctaataaggctagatatgaagctttttcgaattcttggttagattctaattgtgatgagttagcacagattgtaaaagtcgattttatttttgagtaattgattcctttcccccacaaaaaaagaaaaaagaagatgggaaccacatgcgtgcctactaatcatgtgtggaattgaccgcgccaaacccgctatgccaatcccggtccgcttttcgcctcttccgaagcctagccggcccaaccgcccaaatacatgcacgtcagcacatggtccatcatctcaccgaccggcaaaacctgcaccccgaagcccatcaaccgtgtaacttaaagtataagcccaaagacgagcgccccatgccgtgcaaaagcaaaccgttggtcctcgcccgtgaaaaccacttccgccacagcgaagccgaattcgtcaaaaacccgcgcgccggcctttgccccaaagttggcatcaatcgcttttgctcatctccttgtcccgtgcaggggaaccacgcatgcgtcgaccgaaagcacaaacctgtacatgtacgcctgtgtactgtgtacgtatgcatccatgggggccgcgtacgctgagccgtgcgcgtacgcgttgcacacttgcacccacacgtctacgtactagtggccggtagcagcgtagagctagaccgtttccacgagattttatcccgtctccgtcaggccgtcgtcctcgcagccctggcccatcccggtgaggagcgtagggctcctcaccgggagaccgcgcaggcccacctttgccggttcggccgggggccctgggtgagattctaagctctcggtgtgtggaaggctcgcgagaatggaaaaagcacaagacacgggcgatgtatacaggttcgggccgctgagaagcgtaataccctactcctgtgttctggtggatctgtgtatgaagaagctacaaagagctggagagccagagagctcttactctagaaaccctcttctccccttttttcctctcgtgggatctactctccagatcctccctccctttctaagtgggcaaggtcctccttttatatctcaaggggataccacatgcaccatctctctcttttgtgtggggacttatcctatcttttcataaatggacggagatttgtatggttgccgtctgaatgaccttctaatgggacggcccatacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcttgacgggatggagcgaggcatgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcagggagacaaagaggggggcggccacatcaccctcgggcccgacccccccgagggggtcaggcctcgtgggtgattgctcctgcccaagcctctagtcatgatactcccggtcccatgtcaccgacagtagcccccggtgttatgccagggcgatcgccctcctcgagggaagcggtcgggcgtgacgccacttcttaaggcctggtgacaggtgggaccggtctccacagttgggcagaaacccaacgatcgcaaatcacgcacatcggcaatggttactcggctgccaataatgagcggtctcttcaagactgccacattactcgagtagcacgcgaatcgggacgagccggttcgttttgcctggagatatggtgatggcgcttttctcggagccatcagaatagcgtatagcatcttctgggcctgagggtatcgggttttggcgtcccggagggcctcgctaacaaagtagacgggccgctgcacctttcggcggggccgatcctcttcgctaggggccgcatctccagggcgctcttcatccgagaggcagcgcggggcgccctcggcttctgtgccgataacctcggggtcagagggcgacaggcgcggccttcccgtagtggccccgaggctatcctgagggtcgggggcgcctaacaccgtcggacaagcaggcggagggccaactccggccgtcgggggccttgggccgccgttcggcttgggggcctctcggaccctgacttctccccgtgggcagcgctggaagagttcccttccggaaccgaggacggcgcacgcgcgcaggtccgggacgccgccgaccacatcgtccacagcttcgagggtacggcccctcggctcgcgttcgccctcgactccgacgaggagggcggtgacggtggtgcggacgacagcgacgacaaggctggtgacccgggcgcgtcggagtgagcccccaggcccccgccaatcttgaatagctttttctttcttcttccgaggccttcgggcccccttcttgtatagactaatttaatctgcaaccaaataaagaggaaatttctatgtcaattctatttgttgtgtgtatgagacgaggatggtctgtgccgcggtccttctgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccaattcccccccggagttcaccacgccccggggcacggctcggttctgggccccgtttggcgattttagccgacccgagcccccgaggacagggtcgagcacgagtgtgctaattcaagccaagattcttcaaaaggaaacaatggcacagacacagtccttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccggaaccggaggggttccaggtccatgcctcctccttacgagccactcggtccgcaagctaaaaaagctccgcggtagtctggggctctttagaggcaatcttttcgagcatgcggttgtgccgcacaccccccctgaacacgtagatcaccgcgtgtgcagggatgcatggtatggtgttgcggacttgacagaaccgctgaatgtatgagcgaagtgactcatcatcccttcgctggactgcatgtaagtccgcttctttacctgggcgcggatatgtgccttgaaagttcatggtgaactgttggcacagatcctcccaagagtggacggacgcgggtggcaagttcattagccaaccccgtgcctgtcccttcagggccatgggaaagaaattcgccatgaccctgtcgtcacccccggcggcctcgatcccgatcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccgccgccgctcgccgcgccctccgccttgatgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagtttggagcgcgccctgggcgtgctgccatcgccgtagacgaggaggcgacgctccccatctcgccgcccttccccatcacccgtggatgtcgaagtcgcggatccttcgaccctctcgagcgcctcctcccgcctaggactttggcgtgaagggggcggtgaagtacgagctcgacggcgtgggttcggctccccgtcgtcaccgctaacactcggagagaggctgtgcgcctttgcttgttcggccattgggctgaacagaaaaagcttggcgcacacgaaagagtgcgagagcttagaagaacacacgcagaaccccctacctggcacgccagatgacggagcgtggggctcctcaccgggagaccgcgcaggcccccctttgccggttcggccgggggccctgggtgagattctaagctctcggtgtgtggaaggctcacgagaatggaaaaagcacaagacacgggcgatgtatacaggttcgggccgctaagaagcgtaataccctactcctgtgttctggtggatctgtgtatgaagaagctacaaagagctggagagccagagagctcttactctagaaaccctcttctccccttttttcctctcgtgggatctactctccagatcctccctccct

SEQ ID NO: 4699 - DNA, 15020 bp, Oryza sativa
agtgtcagaccggtcacaaatcggtcattcttgtccaccacggtcagttaatcaatctgcatgttcgcccttcttcatacaatatcttgcttgtaatggttaggatgaagcctggcatatatctgaccgggactaacgtgccatctccaggaggtaacacgccggctccggctagggacgagtgcttggaggctctcatcttgacgggatggagcgaggcgtgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcggggagacaaagaggggggcggccacatcaccctcgggcccgacccccccgagggggtcaggtctcgtgggtgattgctgttgcccaagcctctagtcatgatacttccggtcccatgtcaccgacaatctcgatcgtcgatcgacgtcgtctcgctcgtctacttgcacgatccctgcaccggatgcaccgcaccgatgagatgtgtgctgtcgttggctaagctcgtttgcaccctcaaaagtaacatggatgtctgcatgcatatgggccgtgtgtcgtcagaaattcagaagctgtacgtacgtacctgtccagtgctgttcctggctcccgaatagaccgtacccgtgcttgctttggcattttgtttctttcctggagaaagttcctggatgctatttctaagctgtgtgacagtgcgagctggctcttccagtattgcgacactcctgcaggcaagttgtccaagttgatggttgcaaaagaaaaaagttctccaagttgatgtttcagagatattccttcaagttgagaatgggatcggctagtatggccggtttgcctgggccaatctttatatagctttgtagccttttatatttatataatcaagttactaataatcgaaataaatagttgaagtagtgatatggtttgatacagggcatatcacgaggaatcagatggactacttgtcgtgatctttcgaggccaagataagtttcatttatcaagatagtgcgaaacgcactattgctacgatcgaattgtttcctttgttcccggtcatgggttgggggaccagaaaagtgcagtcatattctcatatgggcggggacagtagtcacagcctcacaggagtcctacccaagattttattggtggttaacttgttgttcggcaaaacattaggaaagcatgactaaaacgccgactccattgtgattaattattaatttatattgtgatatgaaatgatctagtactacatttgtgaacaacgaccataaaaaagtttgaaatgaaatttgtgtttgatatacacgtacgtgtagctaactttttattaatttaatactccccattttaaattataagtttttttgactttggtcaaagttaaattgtttgaaattcaaccaaatttgttgaaaaaactagtagcatttttaacccaagaaaaatatattataaaatatattcaattagcgatttaatgaaactaatttggtgttataaacattattatatttgtctataaatttgattatacttaaagtagtttgatttttaactaaagtcaaaacgacttataatctaaaatggagtaagtagccgacttgattgtttaggagttttcttacaaaagaaaaggatagttgatgaattcattagtcccattatcataccttgtaagtattctgatccgtttcaaaaccatactaaggctgtgttcggatgcgccttttcccaacccctctctctcgttttctacgcgcacgtttttcaaagtgttaaacggtgtgtttttttgcaaaaaagtttttatacgaaagttgcttaaaaatcaaattaatccatttttgaaaaaaatagcaaatacttaattaatcacgcgctaatggattgctccgttttccgtgatcactgttccggatgggaacttgttatagcgaacacagcctaattgtcttgttgaaaaatactaagacttgaatatatgttaattgagttttttcccatgctgttgttaaacctatataaattggaaacctttttataagaaaattcccatgttaaaatatatctagcagttgactattagttaggtggatatatgattctagatctattgaaaattattgttaaaaatatacagtcgaaaataacatgaactctttaacttttactttgtctctgaactgaataaaacatgatcaatatcgtggatccttccgttgatttttttttcaaaaaattagaatcaataaatcaagctgcacctagagttttccagcacaaaaagctttatatcgcatcatctttcagagcaaagatcgaagaggccagaacttgtgttgcaacaggcgcaaagcacctcttacttatgctgccatagtattttactacatccgtcccaaattagatgtcattttgatattatactttcgtcttattaaaagattagtgcaaatataaaaaaaataagtcataccgaaagtacttttgataataaagtaagttacaataaaaaataaataataatttcatagtcttgtaaataagacgaatggtcaaacgttaaaaaagaaaacttaaagcagcaagtattgtatttacttcttgtacagttttttcttaattgtacaagtaactttttactcctactttttccaatgaaattggcacgtttgtgccgggtttaaaaaacagttgcacgtaagttgcactctcagttattgttttattaatttattttacaatttaaaatggatatttagtaagtcgtaactaatagatcatagaatccttatttggctataactctggaacatagccaacatatttattgtatgattacaattatagtatttatactatcaataataatagcatgtataaaatcaggttgacaagattattcaatctattatacgaatttacgtatcatgactattgtataagaagttgcttatccatgttcattactagtcatctctaccacttctcttcacatttaattagatacacatcatgagttatcttaactcatttgttcaagttagtataaaattaccaaccattggatcaatgagtttcttgttcttatttattaatcctctcttatgctaagacatttgattgtgttagtataacattatcaaccgttagattaagtggttatttatccgcattcattagtcatctctacccctcctattcccctttaactagatacacataatgagtaatcctaatccatttaattatgttagtataaaattgtcaaacgttcgatcaaatcctaacctatttgattatgctagtataaaattatctatcattggataaagagttacttatctgctttcattagtcatctatgtccctcctctccacctttaacttagatacacataatgagtagtcctaatccatttgactatgctagtataaaattatgaacagttagataaggagttacttatcttattcattggtcatctctagcccttctctctccacctttaactagatacacataattagtagtcctaatccatttaattatggtaatatgaaattattgactgttggatccaagaggtactattcgcattcattaggtctctcttatcctaatccatttggttatgttaatataaaattatcaaccatagattgggttactatcgggtttatattagtcatctctatcccctcctctccgcttttaactagataccaatataagtaatcccaagtgtttgatcatgttagtataaaaaccaatagttagatcaaggagtaaaatatcaacatttgttgactctctcctccctaccttttaatacttatatatgtagtaacaactcgtgatgaggaatacgaactaaatgggagatcgatgcagtacaatcaaattgcagtatctaggttaaacaagcacgtaatattttgattttatattagtacatattcatttcctatatttttcttcaataaaatgatgctttaaaaaaaaaaaccttgaagcaacattttcatccgataattttaaatttcaatctttacacaatgctaaatttaacaaatcccacagctaagacgtggggtattttctactgttgttgtacactatagtaggcctagtgctactacaccacttggagagatagaggtgacaacaaggttttttttattagtatgtttatctaccctcccatgcatggcagacaattctatgggttactaaagaaattgtgtaattggttttagcatttggatgattcatcaagagtgtaaaatatatctcttcatatcaccttaattgtttttagtcttttgatgatttagcaagagtgtaaattgcacatcttcctcctaaaggcacaccatacaacctaatcatttataacctttggataattgataaagttacaaaaatatataaacatgcacacaaaaaaatagtatagtaggtaagaaagaaaattttagaactcatatatactatattatcacacaattctcccacaacaacacgcggggtacccatctagtagtaatagaaaacacatggtaaccccatcaaactcaaacgaattattaaaataattagattttttttcataaattttgtgtgcttttcacggtttaccgtaataccaaggttactgcttgataaccgctcttactgctagggtgtggtaacccgagaacatattatgtgtacacaggcttttttacacatcgtgcgcactagctaacaaagtttaccaaaaatcattgaaaaaaatttacatgtactttcaatagtattacacttatgtgtaaagttttaacctcatatttgttatgttttagccgcaaaagaataaaaatttgacagttttaaaggttataaatctgacagaatttttttatgctacgtgtatattataaatgtgaatatgagacattacaaacaatactattagaagtatatgtacaattttttataaaaactttgataaaatttattagtcattatgcacgatatatacacgagaagacttgactcggcctcttacgataaggtaaatcttactctgttgtatagctgtgccaaagcctatgcaactatctttatctttgacctagtgtggaagagtctcaccattgattatgtatttattcttatttattatgtttatctacttttagctacttctatcttttattcttatatatcattaaatatttgtgcctttatttttcctaataaagaatggcactaaaatactacgccttctttttccaaccggaaaaagaccccaagtcaccatcgttttttacaccgctgctctccatttgctccccatgttcccatgattccatcccggttcctgggtcaacatgaacaaaaatcaaaatccacaccacacacaccatcgtcaatcacactcaactcgcggtcatcacacactacacaatcagtgtcccatagctaaaaggtccttttgattatgtttttagcttattaactacacgtaaaataaataaacatgattaacatataactaattaaatactcattccatctacttttgatagttatatttcatcttgacacacagaccaaggataaataagtctacttatcatccatttaaacatgttactagtcattcctcgtaacaagcgattcattaatatttacatttctcgatgcccatgtaggcagttttgtgtggaagaatggagattaacgcattaaattcgagaaaatcattaagatgataggtgttggattgaaatatgtctatcaaaaataatttttttagatttagaaatatgactgtgaaaaatagatggagggattattaattaataaaaccctaaaattagatttatttgatttttttaaatatcttctatatatactcattctattttaaaatgtctaacgccgttaacttttcgtgtagcgtttgatcatttgtccaatcaaaacatatatatcatatattttgttgtgacatgttttatcattaaataaaatataatttaactcacatttttacatatttatactaaaattttttaataagacgaatgatcaaacattgtacgaaaaattaacggcaccatactttttcaaaaaaagtaatataaagttttcataaaaaacgcaccatttaacggtttgaaaacgctctccctaaaaacaaagagatagccaaggctagtactccttccgttttataatgtaagtcattttatcattttccacattcatattaatgttaatgaatctagacataacatcaatataaatatgaaaaatgctagaatgatttacattgtgaaacgtgaagtagctgcttagaacgcgccccaagtcaatgcccccctccttccctactccctatcaccggatgcacccgtgctgatatttttgacgcacgcgctagtacgctacggtcagcaccattcaccaacgccgcacccgcatgccagcctgcgccgcgcccggccgtactctaccctgtacaacagccaaaccacctcgcgtcctcccgtccgtccgtgcagtgcaccactggccggctgggttcccctgcaccgcgcggcccgtgtgtctcccaccctcccgtctcgagtctcgactcctctccccgtcccgacccgacacgtacctccccttttctataactacccaccaccccgcccgggcgctagtagtacagagcagagcacagcagaggagatcgagcagagacagacagacccgcaggcggaagcggaggcagggcaggcaggcagcagcaacaatcccccacctgcgcgtgtgcgtgtctgtttcggtgcttcctcctcctcctcgccatggcgctcctcctcctccgacgcggcggcggcttcgctgcggccacggtcctcgcggtcgtcgtcgtcgcgctcgtcctctcctgcggtggtggcgcggaggcggccgtgagggacctcagggtcgggtactacgccgagacgtgccccgacgccgaggccgtcgtccgcgacaccatggcccgggcacgcgcgcacgaggcccgcagcgtcgcgtccgtcatgcgcctccagttccacgactgcttcgtcaacgtacgtcctcgtatcggtgatgcgattcgaattcttccgtttctcctcctccgccgtgccgcgaaccgatctgccctctcgcggtcactcttcgtgggtttctgtgtgtgtgtgtgtgtgtgttttgtttttgtttggtttttctctccatctgatcgggcgatctgccgtgatttggttcgtcgtgttcgagcaggggtgcgacgggtcggtgctgatggacgcaacgccgacgatggcgggggagaaggaggcgctctccaacatcaactcgctccgctccttcgacgtcgtcgacgagatcaaggaggcgctggaggagcgctgccctggcgtcgtctcctgcgccgacatcatcgtcatggccgcccgcgacgccgtcgccctggtacgtacacacacccccttccgccccggcccggcgggtccacgcccactctagtagtagtactagtagtactacgtttctcttccattttcctcgcgtttccgtgcaaaatccgctgctccggcttttgcctctccccaacccggcatttccctcctctcaggaggcacccagcctcccccaggcaaaagacaaggaagaaaagtgccaaatatctcgatcgttttttgtcatggctggctgcccgctgtgcgatgcaacgcctatgcgtaacgaacaaaaagttagttcatctcttcgctgcatggttggtcacccccaacccaggtggcacaacacagccctgacctcgttgacgaaccaacgagcgattgagaatcgcctcgcctgggagtaaaatccggcggttggcgctctcgtcatcgtgcgtacggtggccgtagtcacgtgtgtgtcacatgccgtttcatatgaacttgaaatttggattactccgcatgaattccattcggaatcatccaaaacaaaggcgtgtgtgcgtgtgtttgaaaatcatagggactgacgaaaatctccgaaagaatcagtgacccgaattgtcaaaaccatctttcgttttcctctcccttatcctttcatgtgcactatagtcctatgcccctgatagggacggtacagtgcatgtacccgtgctccctgtaaccaccacactgaacatcaagcgggggcaaggttgcatgaaccgtcccctcggcgtgcacaagacaagcgcgtttgacgtagccgccgtgcagcgagccgggaaaggccggacggtgggggagctaggggccatggctacgtacgtgaagccgaacggccggagctgcagttgtatagtcctttttagacttttccgtgcaggcgatcgtgtactgtgtcggggtgctgtcaaaacttgtccttgttgatggctcatcgccgagggaaggaggaggacctaggacgaagacaaagcagcattgctttcgcagtgggtcacgctgccgatttgtcactatgctagattgctagctagccatgttctttttgagttttacacttttcacgcggttgacatggagccgagtatgatttatccttccgttgcattttcattttctgacatttgataacgtaaacagcggctcttaactgtactagtaactgaactgttctgtcatgagtgggccgtactaatttggatgtaagcaaaacacataatgctcttattgtcattacgatcttgggttgaatttgctgttttgcatgcaaatgtacaaatgtagatacaaataaatgatcatacgttgcaatcaatatccatgtctgcacaatgctgtaacattggaagatttgggttgttaatttccaggttcgtttggctggtcagtgaaattattgacttgatttgactctctctcctcctttcttgtgtctgtatcacagacaggtgggcccttctgggacgtgaggcttgggcgcgaggacagcctgacggcgagccaggaggactcggacaacatcatgccgagcccacgcgccaacgccaccaccctcatcaagctcttcgccggctacaacctcaccgtcaccgacctcgtcgcgctctccggctcgcactccatcggcgaggcccgctgcttctccatcgtcttccgcctctacaaccagtccggctccggcaggcccgaccccaacatggaccccgcctaccgcgcggggctcgactcgctctgcccccgcggcggcgacgagaacgtcaccggaggcatggacgccaccccgctcgtcttcgacaaccagtacttcaaggacctcgtccgcctccgcggcttcctcaactccgaccagacgctcttctccgacaacgccgggacccggctcgccgtgaggaaattcggcgaggaccagggcgccttcttcagggccttcgtcgaagggatgatcaagatgggggagctgcagaaccccaggaagggagagatacgacgcaactgccgtgtcgccaatgccccggcgccgccgcctgtggagccggaggtggcggcgacgtccaaggcggtggtcctggtggacttctgacgaacgagctgctagtcccctgactccccagctgttggtgttcgagaggagctgctcagatatgagagtgttgtggctattcatatatgagtttttggtccgatggcaggtttgcacctacctgtaagcttgtgatttcagggttacccgcttattgccgattattgaatggtgataaataactgagaaatcgagctaatgatcattgcctgatgtggtttggtctctcctttctagtatgagtgataaggctaagccaaaggtggcatactggcaccaaagaccgggtctggttaattctcggtaatgcaaagttaactaggagtacgtagtagtagttcataaatggagaggtctattccaaacagtgggcagcttagaaaactagtggtagccattgacattgcgtagaggagcacaagagcaaaactgtcaaaaaagcattccaacaccaactggtaaataagcatggtagaaagacaaaccgacaacacacatgcataatcgtatatacaagatggcgaggtgcaatgtattgtccatgcaaatgctactttaagaaaagcagtgagagctatctgatctgatactctggaaaagcagagatcagctatctaattatacatgctgtccatgtctattgtgagctcggggcctacatatggggcccctgcaacacggaaaccgtcaggcaagtctgcctcttccagtactgcaaaacctgagagaaagccatcacactgtcagaaatctcaacagatcatcattccacggtcacctgtgctgctatgcaaattagggaccttctatcatcatttgacaaaaaatcctttaatattttagaccgcccgattactttatgttgtgtactactcccttcgtcaaaaaaaaaatctaaaactagatttgacatattctaatacaatgaatctagatatatgtactagcctattaggttttctatgggacagagggagtacaagacaaccaaaccttcaaacccctcccttactctctctttcttccgacttcccctcatcgccactaccaccaccatcgccgctgccacccaagcttgtcaactgactagaagtggtcaacaacatcggtaagatccctaagctagcctcttccccgcttcctctcctcaccttgtcctcaagccggctacccctgtgccgccatcttcccgtggctccccataactggatccgccaccacctcctaactttgttctacatttccccaccagcccaccggcccactatccacttccgaccctgtagttttggcaataccgcggtcgccttgctgcccacccgaactgttgcctcctaggttatcctctaaaactaacgaacttctctaacctaggactctaatccgtaagttctctatcaaagtttggaatgttgccagtgttggaaaagatgaggagatcatcggggcttaaaaaaaaagacaggagcatgaaacgtgaagcacacccaatgatccaaaatatgtaatatttgaaggtattttatatcgaatgaaggttagcgattcctatgcatgcatgttgtgtgcgtaccagggagagaggggatgggaatgtcggagaagtaggtggacggccggccgaggtcctcggcgtagggcggcgctagcacgtcgaggagcgcgcacggcgtgacggcggtgagggagtggatgttgccgccgctccgcgggaacaggaccgacgccttgcacggcgccttccgcatctcgtcgacggcgaccactcgggctaaaccacctgcatgaaaaatactatattcctgtgagaatttcgttactgtctcttcttgagaggattggtggacttttggatatcttgccatattggaaagcagtgggatggcgtcacttacttttcttttttttttcttagtataaaaacggcaatttctgatactactagtagtgcagttgtttcattctatgtacactgttgtttttccaacagcacgtggcttgggcttccaaccgaagtaagctagtagtaattcaaaaattaatcgacagaggctgcaagtatccaaaaagttattccagtttcaggcgagagctatcttttgcaaattccaaaccattaaaaactgtatcaagagtagagcagtggacagggagagataggttctcctgtttatattgctgaaaaaaaatgctggtttggtgagacatcggtgggatttggctatctgaaaccgtcttttacaaggattttgtagggaggtattaatctcatcctgcttgtaaattatcagagacctttttctgtccttgatcatagccaggtaacctcaaactagtatatgtaggtgagacaaggaacaaatgttagatgcagttgacaacttgacatcagaaaacgatcgagtttttttgtcgattgatcatcagcgagcgaatcgacggcaaacaggcgcatgcattcgcatgcagctgagacaaatgcttactcttccttgggcccgagcacgggggcgcgttcgcccagtcgtacgacttgacccgcatcgagccgtagagaagcttgctcagcaccaccatttgcgggtggtcgtgcagcggcagcgtcgcgccggccgggaagcagaacacgccgatctgcacgtacgtacgcagccgcgcaacaccgccaccagatcgagcgtcaaattggtaccatctcacccttttgcgaaagtgcaaaaaaatactaagaaaaagtgcatcgtctgcgcgattgcgcgcgcgtgcatgcgtaccgagaaatcgtcgcactcgtggatgtgcacgtaggtgatccgggtgaacgcccgcgccgagagaaaccgccgccccggcgggctcctctcgtcgtcgtcctccgaggacgacgacctctcgccgccgctgccgccgccttcgatcccgacgtccgccgcctccatgccatctgcaaaatcagcaaaatgaaccaacacattaattaatttgcacacgtatgaaccaagatgcaatgaaagataggagtataacgtaccgagcaggtcttgcagccacctgatctgcttgagcgtcggcaaccctgctttactccccgacgagaagacggcgtcgcacgcgtcgtacagccgctgcaccttgctctggtggtcgtccatggccacgcgctagctgtgctgccacaggaagcgaagtgacccggctggttttaactttcacacatctacactacacaaaacaaccgagcaacctgcacttgtacacacgtatatatccagcgcgtagtacatacgtgcgaccgcagaaagctgacggtgagcgcgcgtggcgattgagagataactgtgcaaatgcaagtgtgtttcgtgtagtgactacgaagctttctacctagcttcgtgacgtgcgttcgtgcgttatgaggcaggaagaattcaagaatttcaaggggatcgaagggtcgcgagggcgtttaccggcggtacaaaccgtgggcgattcgactttacagggggctggctggctcgctctgcacgcacgcaccggtaggcgagctgtgcgatctcctctgctcgtgtacatattgtgtggcttgatcgatgcgagagtggatcctaaatcctcgagaagatattttctgtttatatgtatgtcatttaaatgactatgaaaaaaattaaaaaatataataagataattaatatataataaatcactctataaaaataagttaaaatttaatttctacatgttacaacgaaaaaaacaaattaaactatgaccagttaacgtatattcacagtcaaatttatttttttcgctataacttgtagaagttaaatttgaccttgcatatttgtgaaataatttatcacatattaatctatctttttaatttttttaattattttcatgacatgcaaataattagagattagctagagttaaaaatagttttccgttgatacggtcatcacgaaactactgttcgcgatactaaacaatcggcgaatgcagctgggtaaataggaacttttggtcgcatggaatccggacacggccacacgggccattttatttttcggtttttccatgtgggcgtcgctgttcggttctgcgaaaagagtttgaaaacggcgtaaaaataatgtacgctaaattcttgcaggggattgattgatctgaagaggggcagacgagcttggatgcttggttgcctggttggaacttgctactgcgggtcggttattttatatcgatcggcatgcaagattacaaaaccatgggaacgctgcactgtgcatgcttatccgttaagcatgcggcccaggctgggataatactactcacagaccgggtcgttcttgggcagcagtttaatactagtagtatattcaaaaaagattttgagtaaaaaattcagttttagcagcaagccattgggtgcagtcgtgcagagcggtttatacgctctggagctggagcaaggtcgctgccctgtttgcagttggcatggcggcgatcgatcggagcacaaagttcatccatcggacaacagattgacccatgatattacgccatgcaacgcaactccaagaggacaaagacagagaaccaagaaaccgaagcggaagacgagaacaccggcgccgtgtcgtgcgcaaccactctgcggctcggctccgtcgtcgccgaccgtttccgattcacgcggaagcggcaaaacgctctccctgccgcgccgtctcgcgttccagccaagcgagcctcttgcctcgtcccgcgcgggggttcggagtagcttttggctactttataaccatccgattacgggtgcacggtcgcagatcgtggcttaacttaacacaattgcgtgtatttttgcaaaacgtggcattggttggcgaggcaacggcgagttggtgacgctggcaacggtttccggctccggcggacggcggcgagctgctggagtaaagtggtgtgtttgcaatccccatgttcccaacccctctccctcgtttttcgcacgcgtgtttttcaaactgctaaaccgcagcttttcttgcaaaagtttctatacgaaagttgcttaaaaaaacaaattaatccattttttaaaaaaatcagcaattatttaattaatcacgcgataatagaaggctccgtttcccgtgatcactgttccgattgggaaccgcttctagcaaatcctgctcatgctt

SEQ ID NO: 4700 - DNA, 4764 bp, Oryza sativa
caaaatggcattttgccattttgtaacactttttgccattttggatctaaacactagtagcaaaagttggtaatttggcatttggcatttgctagtccatagtagtaaattgtgccaaaaagtgctttgggaccactccttctctctttctctctctctcactttagtgctagaatggcaaaactttaacatgcatctaaacaccaactaatacttttgcaatgccaaaacttttgccaccaaaatttttgctatttgccattccaaatggatctaaacatgccctaactaatctgaaattggacagacgtgtttggacaaaactctgaatttgatagcggcaattagtgcgacatgtatatcagaagttcagaactaagagcacccgcaatggtaaaataaggtgctctctataaaatatgtacatctcagcaatagactagattaatagtaaaccacctcaatagtatgtctacatgggtatctatagctctctaatccattccctcatttttctctatagactatctctaggttagtagatagttgtgctctctctctcttcatttaatctctttcaagtagaaaaatatgctgatatggatctcttgtagagagcctatagataaccatggtgggtgccctaagctaaaattcctctgaaatcgttgaaacctgtgtctcatccacattctttcatcaaagcgtgcgatataatagtttcttatcacggtaaactgaaccaagcgagagtcagatatttcccggatgaaccatcactccgtcagttcgtcatcagcggaagatagcaacaagcattgcagcaccaaagtctaaagatcagaccacgtcacgatctgccggcgacggtgggaattggggatgcaggaggttcaaaagttttgcaaacgaaccctcttttccaagtctatttgcccattacaactcctaagggggttcggaaaataaaactccgaaccccattggttattttccaaccattggatcacatgtagtcctcctctgacctctcttcttccccacagaggcgcagacacgctctgtctctcagtcttgagacaagtgcgaccgtaaaatcaatctatgattggtgaactacttatctgaatgaatttagagagtcgtatttaagacaaaattatatatgaaacatagcaacagcaaatagagcaacgagtactttttttttccgaacgcacaaagggattacgcgtcaatatattagaagaaaaatagttttaattacacaacgcaatcggccaaacaggcctatgccgggaggtgggggaggaaaaaccaagaggctactgctaaacataggctactcaaaacaaacgagagatagaaggctgagccacgctacacttccagtaaaccccaaaagctgtaattcttctggaatcgtagaaaattgtggatcatctctaaagcactcatcaaacatgcattcttatctcaaaacactgaaacaagcgacagttacatactcaaatgaaccatcactccatcagttcatcgactgaaacaagcatgaactgcaagcgaactcacgatctgcatcaccagcggccgtagccgacggcggcaatgacgacggtgggaccggtgaggctgggaggtgcggaaacttttcaaaacgaaccctctttttcaagttatttacgcgttacaacttttcccaaggggtacggataagaaaactccaaaccccttgggtgttttccaaccccgcagaggtgcagacacgatccagttctcatcaccggcctcttcgattccaaaggttccagaaacttctacaaccataggtccctcgtcgcaatggaggttaggagacttggggcatgcttagctccactccctgtcgctatgttcgttcgctctatcgtcagccttggccagtggtggatctattatgggggtgggggcttaagcctccactactaatatgtaagtttatctagtttgttcagattcccctacaatttatttctagattcgttcctcggccagttgtcctgccgccggaggacgccgcccctgacgtcaataaggaagaaggtggcgtacatctggtgatcaaccgatgggcacggttacatggtgggagcacggaaatatcatgagttttcaagcaccggtgggcacagggttttcaatttcaaaattggtttttataccgggggtcatcgaaatttcagaaattttgagccgaaattatttgaaaatttgacttaaatttgattaaaatttgaccaaatttaaaaaatataaaaaaaagagaaaattttgggcgagatttgagcatgctggtggggggtgaaatttctgaaccaaaatttcaaaccctgggtgggcggtggaattgaaaatctctcgaatcaacatcagaagcaacgtaaacgtgcgagagctgacggcatttgcaggatatcctacgtagattttgatagtttggatattgcagcgtcaaatcaacatcagaagcaacgtaaacatgcgagagctgacgacatttacatgatctgctgcgttggttttatctgatgtatcatgtatggataattggatattgcaatgtcaactagacaacggaaagctatggtaacatgcgagagctgatgggatggcgtttacaagtttatctgattggatattgcaatgtcaaactctataataccccttctgaaagcaccagggttgcagaaaaaaaaatcaactctgacctcccgagggatccatctggtcttctctctgtgatgtgtgaacatgtatggaatacaacaccagtagagttgaaaacctctccgagaagagtttaaaatggcattcacattctgtgtacatgatatttcatccgttccaaaatactccatgagcatattctttggaaaaattttgataaatgaaaaaaaaaacttttagtcatttcaatgatcaaaatttgaaaaaaaaaattgagagcatggtacaaacacgaacactcacatacacatgctcaccctcatttctatgaatattttgaattttgagttacttaaattcctgagcatcaggggcggcgccaggaaaattacaaaagtagggctgaatcagtgtatttcaattagacacaatatatgttcaaaatttttatatagaattcaaaggggattttggcccgagcctagggctcataccttaactgccctaggcccggctccgccattgccgagcatctcattggctaaaaacatatagattttcatgcattgaaattagtgtcctagaaatatttatatcatggtataaattttaaatcacataatatttatatagttaaagtggatggactaaatgatgtcctagcattacaacggtggcttctaatggcagtggtctgagatttggtgattgtgataagctgcttgtaaaaaatgttaccgcccctaaccccccggcctagttagggtgaaacgagaagccaagggcccatgagcccatcttctcgcgtctcactaagaaaaaggcccagtacaacatacaccaagcccgtctcatcgctcgcgtgacaaaaaggagaaacgagctgccattccatttccagctgtgactgaccgtgaggcacagacatgcttcccactggtatttccagaggtacttcatagttccttcccagagctaacaccttggatccttattgcaagactatctcaaagcaaagttgtcagatgaaagtagatgatcccgaaacgtcagcgatggatttcagtactttacgaactataatcaccaccagtgtagagaaagaacatcagacaataatccagaacccttcattcaggacaaacaacaattacaaacgttgggtgcactagacaaatgtgcaacgcaatgcatccgatggtagtaaactaactctcaaaatattgggctaaccctaaaaaacaatttgccttccggggtactaaaaaatgcctcttccagcttacaaactgtcctctccaccacaaaccgaaagaaaaggaaagagaagccctacactgcctagatcaaaagtaaggaccacctaaccaaacttgtacagatgctcaatggagatgaagcagcgaaaaatgataaatcattcaccctctccaagctgcagctgctgcagcagcctgttcatactgaatcatgctccgtttgctgtataaatacgaacaaatcaacaaataacttgattatataccatggaggtatctacagaaggattgagttgttgctcctgatcatcatttcttattgttgtggacagaatgtcggaaatgaaaccggtcgctcacaacaaggttttctgcaaactcaaggatgggggccatgatggcttcagcatttggcgcgactgattctggaagactgggtaggcagattggtatatgttcaccattctcctcagggtgaaaatagaatataactgctcggcagaaaataaacctgcaaattaaaagaaggaatatgatttggcacaatgcaataaatatggaacaaaataatgtcttggaatgcaacatggagagttctgattatgtacaggtatggtgctgtaaaaccatccttccactgttcccttttacacctccatagacttgttcacaagcccaccgcggtttgcaggaaatatcgcaatggacaggagctcaagttgtgtactattaactagtcatgttaaataaccactttcatgttttggaagaggtcaagatactatcttcaagcgatgat

SEQ ID NO: 4701 - DNA, 16189 bp, Oryza sativa
  unsure (1)..(16189): unsure at all n locations
aatgcatgactttttcactatcgataacaaggaatagtggatatcttggaaagggaatcagatcttctggataaagattgtttggacctggtaaagatacagtcatgtcagaatagaaaatgcatactgtatcaacctttcaacaagaaactagaccatcagtctagtcggacactaacctagtataccataaaaagtgggcttaattgaactatatcattacactgagatataattccagaaatcaaccctacaagaagacagatgctttacctccacttccacggggaccaagccatagatgattatctgaattgccattggaatttggcttatcgatgggatacacggaagttgcccttgcatatgatgagcttgaggcatacttttgagaagtaatgttctgctcggaaaaacctgaaattttgatcactaaagttagaagggtaagaacctaataactactcaaaacaagaatgttactagatgttttacagagtcagatcaagaagggaacctgatgctgatagatagacaagtaagatgctatcttgagaaagctcctcacagactgtggctagaacctgaaattacgaatttctgatgtaacactacaaaaaaggttcaaatagcaaaagaacaaatcatatggaccatcaaactcgtgaatgaataaaagtacattccaatggattgcaacaattaaccccattgtcaatcagcactgcaacttggcaaagctgaaatattctcacatttttccatttgtgtcatgagaaatggtacagtatactgccaaataagtgggtggttccaccaccaaataaattataatgtgcagcagcagccgatctaactatgacaacatccaggcatgatgaggacttgcacagacttgctaacccaacacaaacgtcaaccagacaattgtattgatataaagctaatgacattgttaaaggggaaaatacgcatccagttcactggatggtgagcataatatatcatttcaagagtaatctcctaaaagaagatccgtgattctatcaagatttgatttccatcttatgtaaaactgagcttcaaagagaacaacatgcataaacaacctaccgctagaagatgagatactgtaggatgatatatgattgccttttgaggatttgcaggaagatttccatcagatatttctgatgataggtggatatcaatcaggccagagggtccactctgatcacttatagtgccattttctgtaagctctttggcagcaatctgataagacccagtgggttcccactccagacactgtagcattctgaaagtgtccagagttagttctgtgaacttcacctgcattacatattacaaaatgtcaagcttgttttcacagtaagataagtgggtcaattattgatggataatatatgtgacctcgtttctgtgatagcttgtcaatacagcttctttcagtttcagtactctttttgaatggaatcgtgcaataggtgcaaggttcgacggaaaagagtcaaacaagttgtcatatctcagtgatctagatcccttgtatgctccatcagctttcaagaatctcccaagctcttgaagcacttgtttccattccttgaagttggttttctaagaagtatgaggtcacaaagttgttatggaagaattaaatggcaaggtgttttaattagaaaggatataaatatgtgattctctattgaaatatataacattgcaagaaaatgggaaatatgtaacaaggcactcatgtcataggctcctaaatgctaagctatcgttttagcataacattcattattcaaccctcaaacaacatatcatttctcaattaagcactgacaaaacaatgtgatatatatgctattgaaaggtaatagagcttgtgaaattgctctagttcatacactttagtacgtagtaactttaaaattatcaaaccaactaaagagaatgattctactttagcagctaaaactgtaaaccatacatgattcgaaatccgttatcctaatgaaatgtacgactcatgcaatgcaatatcccaaatccgaatggtaagacgagcattgaacagtcgtattacttcagttcaccacaaataaagtaagattttaaattttaagttacatactaccagaacgaatttgccattttaaattacatataatcgaattgggaaataaatagaaacccttgattaagcagcagtccaggtcaaaattcccaatcagaattctttatacagaaaaaaaaaagagcactgtacatatcacttctatcaaaatttcaaaaccaagcggcaaaacaaccttcaaatcaacaagttcccactcttcttcactactctaatctagaagttaaaaaggtctccttactccttaggtttcctaaaatacaaaacagcaagcgcacaaacttaactcggggttcccctattcaaagcacgagaggagctaagcttcttacggggtatgccgacttggtctcctcgacgagcgaacggaggcgggaagcgaggtggtccaccggctcggcccgccgcatcagcatggccacgacgaggaagcgcgcgatgaaccgcagctccttgtaccggatcaggaggccctggtgcctgtagccgccgcccaccaccacctgcgccgcggcggcgaagtacccgcggctgtagatggcctcgtagaacacgtaggcgccgacaagcgagcgcggctcggcggtgcggaggtagcgcgcgtagtaaagctggccgatccgggaggccacctccccgatctcccaccgccgcagcccggccgcgacgagctcccgccgccgctcctgctgcaggcgccacagccgcgtgtacgccttgaacgccttccggctgtggtggtccaccccgccgccgtagagcggcacgtcgcgcgcgcgcgcgaacttgcggtccgccgcctccgtcagcgccttgaactccctgtacgcgccggaggaggcctcgccgtcggccatcgccggcgacgaaagaaggcgcggcgcgcgggggggctattcccctcgccgatttggtcgaatggaaaagggaaggtggtggtggtggtggtggtgggnaaacgggcgagaaagagaggagagagagtgtgtgtgtgataaaaagggggagtttgttcgagaagagattaaaaaaagtattacgacgagtacggggtgagcagcgcagtgagctcaagctgctgtttgttacagggacgctgtaatttaggtgcctaattgggctcttattagtcaatcatttgcactttgtttaatggcttgtctgcctctactcactgctttggttccacagtgagaaattacccggtatgattttgatttggacactaccaaatctatgtaactatgtttgatttgatttcttaacaaaattttatgttaggcatgtttaattcccaaacagaatttttcgtgttatcacatcgaatgattggacacatgtatggagtattaaatgtagaaaaaaaaataattacacagtttgccaggaaaatgcgagacaaatcttttaagattaattgcgccatgatttgacaatgtggtgctacagtaaacatatgctaatgatagattaattaggcttaataagttcgtctcgtaattttctagcggaatctataatttgttttattattagactatatttaatacttcaaatgtgtgtctatatatccgatgtgacatgcagggtaaaaatttttaacaactaaacgtgaccttataatatgatgaagggaggatagattatactatatttgtgtatgattttgtgataatatttgaggatagaaatgaatgaattaactattgtaaagtttaaaagttgtataaagttttttaataattataatgtttaaccgtttagactggccataataatctataaattataggagaaaaaagtgctaaattttgacgtggttggggcattcaaaggaggattagtaagctgaaacaaattaatcaattggagaacttatgtccgagtacgtaggctgcattctcccccacagcctcgaaagcgatctcaaacgaagaacaagtccacgttaattaaagtgaaaatgaaggtaaccagacatttgaccacccaaccgtgaacgctttcaatgagaacacgacaccgttcagtctcgtcagctcgattcgatagggatatccatttgcggaacacttgacagttgacactgataatcaaaacaaatggcaggagcagccgggctgatgagtgacgacctctactcactgctttgtaaatatgaatatttgtttttttatttagtaaagattaataaaaaaaattcagtcattcaggtgctcatatagatgaatggatagaatacgtgtgtactttaatataggtgaaagtgtgtatgttgtaagcgactgtgttggtattatatttccaaaaagagttaaccatatcggtgtcgtgattcaattttaaattctaagcatttaattggctaaaaatactttgatttcagtgtataaagaaacttatattagagcaagtttaatagtatagccaactactaactccaaatcatatatatctaatataatagcacattcatacaatagttaactatagaaatatattacatcattaatatccggttatacctctcatacacaaataatattttagagtccgtgttgcagctagctataaatatgtaacccgctttcttctctctcttcacttttcttcttgatatgtggttatagctggcttatagccttctattgtacctgctcgtagataccatcagaaaagaaaaacttatgttagataaaaaattaaaattttaaaatgcttatttgaatacaatgagagggattcaccaattgtcctatagtttagccgcaacttgctgcccatgcctagcctagcccccacctccgcttacgccggccggagacggacgcgccgatcgcgacacactggttgaagtggtcgggaaagcttcaggcgatcgcgccatcttcgtacactttgccttgacgttggttgttccatgtcattattccctagctcgcgggcaggtgggcagccgttttcacgcctcgtcattttccggtgaagcagcggtcaattagcactcgctccgctgatgagacgcccgttgcaacctccaactagcacaactggtagtctcctttcctctacctaactgaaatgcaactgccaagaaatcctactagtagtagtagctgtctactgttcatgttgttctccattttgtgtttcagtacaaaaggagcccgagttaattcttgcaagaatttcatactctgctcgggctgagaccgcagtaaccactggagtactcaccagttaacgaaagagggcatctttgctcgattaaagaatggcactttcacttggtatcattctttcacttgccatcattctgctggaggtagaggattcagtgttcagtgcagtggcctctgcctctctggtcggcgcaatcattcggcgcaagtctactcgccccaattctttacagctggagtacgtgcaacctgcatgcaagcattcgccccagcggctcgcttggaacaggttggctccgcgttgccggcctggactgagcaagtgtagcagaagtagtacgtgtaaagagcaattaacaattggtgatgcagtggttagcgattaagtaatctgatcatgggaatcttaatctgaacgggtttgtgctgctggtgttctgataaaaagctgctgttttgcggtgattagttagggcaggattagcttagcttagctgctataggcttttggagctggtcccaagggatgcgaccatttagtagaacacacatcaagacataaaccatgctttcggcatgatttctcccgtaccggagtactcactataggtcacatgaaaaaaagtgaaatggagcggtgattggtactgtgcgctagctagctgcatagatgcacactgtgacacatatgagatagcttttcacttcctaatttcttgacgagctagctatatattgtacgtgcatgtatgtgcaaacccatgaaggagactgtgccctagttaaaagaaagaaagaaagaaccctcagcttagttcatgctactaatagtactaatgctactaatagtattatatgcacgggtctcgactattagatctgtctaacaaacaccttctccacttgtatagtactcccttcgtttcagaaagattttatttttatgtttctgtgttcgacgtttgaccatttatcttatttaaaaaatttataaaaaaatattaacaaatagtcatgtataaagtatttttcatcttctatcatctaataacaataaaaatactaatcataaaaaaaatttaaataagacgaagagattaaaagccaaaaaatagagcctttatgagacgaagagagtagatatttatgcacctcaaataataaatctattcaatgtaccctggcccttggggagagctagtttttgctaaagaaggtgaactaaaccgatctgttagttggaagggacaaacataatactccctccatttttaatagacgacgctgttgattttttctcacatgtttgaccattcgtcttattcaaaaaatttacataattataatttattttgttatgagttgttttatcattcatagtactttaagtgtgatttatatcttatatatttgcataaaatttttaaataagacgaatggtcaaacatgtgagaaaaagtcaacggcgtcatatattaaaaaacagaggtagtagttgaatagggtaatatggtgttctcatgtatcaacactaacctataaacggatgcctgcctaaatcgatgctctttcgataaatgaaaagtacaaatagcacattacattgctagtaagaattgtgttgattcttcaattaatatactctacatccgatccgcgtcatccgctctaatgtataataatttttaaatgccgagatacctagctaaaagttgttatatttgtatagttttatttgaactcctaaaagttgatatattagtacgattttgtttaaactcttgtgttcttgatgaacttaaattgttctcatgcgtaaatatcactcgcctctaattatgctttgcattttggtggggaatagaatatcagttttcaaactagtgcaactatggccctatttggtagggctccaaactctaactcccagctctaaactcctacaccagttggagctagctcctattagcgttggagacccacccaaaagtgtttggtaacctttaactccaaatctgaaaaatatcaaaaaaaaaagaaaaaaaaaggaatccccgctatcgatcggctgtgcgtcgctcgagcatcgtctatgcgcacaccgcccgccgcgggccgtgcgccgccgagcgtcctctccgcgcgcttgctcccttgcaccacctgcccgcccgcgtcggcgtgttgcccgtcgcaggccatgcgccgatcgcccgttgtcccgctcgcgccgaccggccccgtcggagcaccgtcgccgcctgtgcgtcgtccgccgcccccgtcgaagcgctgccatcgacgccgccgccgctgccgcctgtgcgtggcccgccaagcaccgctgcccgtgcgctgtcgctgctcgcatcgcccgccaccaccgttcgcccgcccgccgccgccgcaggagcgtcgccatcggcccgccgcctttgcccgcccgtgggagatgaagtttcggggaagagagcggggggaggtgaggaggagagtttgggggtagttcaatggtatatttttaaaaatatgttaaaaaattaaagggtaatatgtcttttgggttggagtggagttgtagagcagtaaaaacttatctccacccctgtagttcattttttaggagtagctccgttaactccaccccaaaaacagagaatctggaccgtttggcacagctctggctctaggtaagttgaagttaggagctagagttgtgccaaacaggccctatacaagcggacaagtggtgttaaacacatgtacgctaaggctgtgctcgttagtctggcttcccaacccacacagcatgcacggaaaacggagcattccattagcacgtgattaattaagtatttgctattttttttcttaaaaatagattaatatgattttttatgcaattttcgtatagaaactttttgtaaaaagcacaccgtttagtagtttgaaagcgtgtgcgtggaaaactagaatagggagttgggaaccaagagttgcgaacagagcctaaggccctgttcagtttgatgccattttcaattttagcattaccaaaattttagcatagttgccaaaattttggcaggatttcttatatagttaccaaaatttgacagcaaactaaatatagccaccttttgtaactttaccaaaatttagtaaggttgaaaatgatatcaaaataaacaggccctaaatgctgttaaccaaaccacctcccaaaagcagcaatttgccccaaaattttcggagttccacacgtgaataatcacttcttcgtttcaggcaggaccgcatggctgcatgagcatgaaaaaccctctgtcgtgatctcaaagaggctccacatggaagagaattgaagtactcctactagagactgtgtagtgtgtacacactgtacacggtacacctcaaattttggaccaaatcggcgagatgcaggacaccgtgctcctactgtagcgcatttaacaacacgattcccattgtctccggcgccttcctgtccgtctgtgtccttcttcccatggaccagccggtcctacagtctaaccatgcttcgggtctggctggctcaagctggctggcaatggcaatggcaaaccgtgcgctgcctggcgcgcgcacatatctacatggagactcgtgacctcgcactggaatttttcggggcctgggcgtacgccgactgacacggctggattttttcttatcgtttccatgctcttgactttgatgcatgtcccttgtacaccccctcttctccctggtgtttccatgttactctatgcctgcgcctgagtactttagggagtagtagtagtactggattagtggagagtgggagtacgagtagttcttcattggcccccgttcgaggaggaaacaatggcacgtgaaattgacagccgggggggagtcgtcaaggtgagccgttcgtacgtagtatagctgaccgctgacctgactactagtcgtacaagctgctcctactacgttctgtcactggtacgaggacgtatggacggacggagtagaggagactggagacggagacacggagtttggccgccgcgccagcgtgtacgggctatatgaacgagctattccgcccgtgctagtgctacggtgtgcgtgcaccgtggaccgtacgtgccatgcatggaacggcaggaggcagaggcgcgccacgcggcggaagagatggggttttggctgggcgccttggcgcggcctcgctagcctcgttccgtcacgccgcggcctcaagaatacagcagctagctaacacacatgtccgcttgcggcgcaacgccgcggggagggccgggggccgtttggagaggcggaccctgcgtcgtgcgcgcggcgatgtcgggggagcttatatattgtcatgtcaggtcgacacctatcgtgttgggcccgtttgcctccaattggagagggtccagctttgcgtcgtagtactcgtacgcatactagctacggtagccatagacaatgaaaccaaacaggaccaccacacagccagtcacctcatgtcctccgcggtggcctgcagccggctaataacgcgccgatggggaagctacaattaactcgcgtggacgtgtacgcgtacagcgtactactcttcttcgaaaattgtctacactcgtctaggtcgtccttacctgtcagtacttgattcaactccaaccatgcatctcccatctcttcccgtaagatgtactcctactctgtacagtgtactagcaatccactaaaaccctaaaaaccgtggcaacatgtaatgccttgacgacctggatggcaattgacaagtgccttagaaaaaaaaaatccttgtccagcggcagacgttcgtacgcccgtgctcccggtggcacggcaactcgtcgcgtcaaacgctctgccatcgctgagagattgtccgggcctttttgagcaccagaagcgccacggagttcgctgcttccgaaccaacatgtcacatgtgagtgacatgtcgtagtcgcatcaaaattgaggcccgtgccgctgtcggcgtagcggcccagccattgtacccgtacgccggtgaggagcgcatgcttttaggttcagaaaatggctagtgttttttgtgcaggcactcgtgtttgtgtttaactttggccctgtttgaatccaatggctattttttagccctctctcaaatagcctaaatagccctaaaagatccaaaagggtgctatttgagggctatttggaaatagcccacccaaaaaaactatctcacccaaagggtgctaattggagctattttgagtggggcccactgaaaagtgtcttttctctctcccataggctcacgggattagaaaacgcgacctcctctctctctctctctccgcacgaccacgcgcgcgcaggcgcggggcattttcgccgccgccgcctccactcctcgccggcccccagcagcgccgccgcccccacctcctccccaccagcgccgccggccccgctccttgccgaccgtcaaccacgtcgccgccctcccccacttgagccaccaccggcccccactgctcgatttgttttcttgtccatggagggtggtggcttcgatttcttctccgaaccccactgctcgatttgttttcttgtccatggagggtggtggcttcgatttcttctccgaaccccactgctcgatttgttttcttgtccatggagggtggtggcttcaatttcttctccgaagatccaaatccaagcgtctggccgtcggtgatcggccccggccatgctcctcctccccatgccggcgtggatgcgttggatggatcagtgcttatgcaatggaatgagcagtacacgcctccacagagcaatttgatctctcttttttaaagaaaaaactttattgttttctccctttatgctacaagcatacgagatagagcactgtcctagtgatagagcacaacagcatggcatatgcagccggccacaccaagacacatgcacaaaagatctagtggagaaagagagaaaatgggtagttatgattgggaaagtgtactaaaggtcaagtagctcttgcatccaaacagctcaagggctatttcattgaagggctatttcttgagctaaaaaaatagctcttaaaataactctcggctactcctccaaacagggcctttgtgtggttttcctttctttggtgctttgccaattcgtcaaagctagtgggggcgatcaaaggatgaggaagatggctactgcctttgtgtgctttatcaaaagcgatggatccagtatccactacgaatctagtctaggaagaaaaacaaggcagagcaagtcaattcaggaaagggttaaaaaaaacgaaaagaagagcaaagaacataccaaagccggtaggtccaaagtgcaaagtccaaactttatgtcaaaggtgggcgctgcttttcttcgctagtgcagttttttcagcgtgacaactctgtaattcttccacggagaagaattacgggtccacaggccgtgccgattgggataagcaacccaatgcgcttaacagaccagtccgcgtatcaattattgcatgattctgttcaattttgcgcacacttcaacattttttatcatcttatcaaaccataattcaaacacgaactgaaaagtctacttgtcttggcattcaaaacttacatatgtcatttgcatgtacagtggcgtcttacttcttaggtggtgttttgcaaatgggaaagggaaatgattttcaacccatctttaaattctaaccattcattctccctcttatatttaatcctaacccttcattcattttccaatcctaatcccaccccccatttcccattattcaaacacgtccttagtgtccaaaacatcttacgtataataagaaaaaaaaattatctcaccttgagacagagtttgtcaccaaattatagagggggaataaaacagacagcatatgtcaagttgtcgaccaccaacgagtgaattggcagtttgacacagcatgagaaattttagctcagcccatgagatcaacctcccttccctgggcctgtatactttgccttgggccgtcgcttggcgtgagatcaatgaaggcccgctacaagtaatgaactcagtgttgcttgcttaaagttttttttttttgggacgcatggcattagcacccgttaaactatcaccatcgacgttccacgtcaaaccaacacaacttataggccctctgcaaggctggtacacactcactctctttttaaggcaaatggaataacattatggtgcacaaattgaatcattttcattaataatttgcatgaaacatttaagatttttcataaaatagtatgagattttttacaacgttgtaaaaatatatacattgactaacataaaaaatatcaaaaacgaaaatttcggaacaaagccttgatactttttttatgttccggtattaccgatatcactatcgtttccatttatgttatttcgattctatttaaatagtaataatagcgtaactggtttgaagattcctattaccatactcgacaatttccattgcctagaaaaatgatcctaaaatgtttaagattgagcattcgacacaagatggaatattgggtgcattagggactccatgcatttcatcaccatacaacctccaatcttatcttctcttccctgttacctcgtgctcctcttgccctaaagtttgcttgcgcagctccgtcactaggaacgatctcacaaacgacgctacaaagggagaaggagatgcggagggataaggaagattgagcgatggcggtggcttggccattggctcaagtgcgatgaggcgaagcacaacgatagttggctacgatcgaggagcttgtcgatgaggaccgccatgagttccaagaaggtagcatgaccactgcttcctgtgggtagacatgcgaacccccgtgccccttgctccacggctttgccggttgtcatgtcaacaagatgttggttgtgacctccttgataaggcccagatacgactctggtgggtagaagaagaaggtagtgtagcttttttttatatagtttgacgatgttgtaatccattatttccttttgttgcacctagctgcgttaagatgttccattttgttctgaatgaatattgaacatattgatatatttgtgttgtaatatatagttttcaagtgttacacctagtgaaaacttttttatcccagcgatgaaacattttctcgaagtgatgaacattgaatttttttttctccaagatacaaacatctgaaacattttgttaaagggcctgtttagatccatttgaaatggcaaatggcaaatggcaaaaattttggtggcaaaagttttggcattgcaaaagtactagttggtgtttagatgcatgttaaagttttgccattctagcactaaagtgagagagaaagagagagggagtggtcccaaagcactttttggcacaatttgctattatgggctagcaaatgccaaatgccaaattgccaacttttgctactagtgtttagatccaaaatgataaaaagtgctacaaaatggtaaaacttttgccattttgaaggatctaaatagggccaaagtaattttcactgagcggtaaaacacgcaccttacaccatacgatattttgaagatccgacataccgtatgtaccatccgtttcatcacgctgtaaaccaaaggttaaagtgttaaaccacacacggtagggctgccacgtagtcacgtagatatatgcttcttgtccatgtaatccccggcacgtctcggcccaccgagcacgaggcgacgggcctccatccgaggatcgtcacgttgcctttcagattccgtggcccacgcaccaccaatgagcccacatcaccgcacggagaaaaggacaggagacggaggcactgccccggtggtctctccctgcccgtgggacccaccacctcccgggcccacctggcactgtggtggatagccgcttgataggttccgggcctgacgtggactaccaaataccaattgccatggtccaatatggggtccgcgatctgggcctgcattgattcggccattaaaaaaggttatcgtctcgtcgacgtttttcatgggggcccaattcgctagtaggttgaggctgctgtcacgccagcatggcctcgtccctctggttgacggtctcaattttgtcactttcatgttactcaagaagaaacccaagttttcgtttttgcaaaaagttcacttactttcctatgtaaatgagtgtttattgaaatgtttagcaagactagtacaagaggttatagacacttacagtccaaaaaggagagaaaaatccgtccattagcgtccggatagtgaagtactaccacaaacctcgctgaaaatgatcctgattctaggagattgctgacagtactcgactatacaaagcataggataatctgtccgtctctgttacctccttttaactatgataacgttgcttttgtaaggttcagaaagtcctcatgtctgtatccttaaaatatatatcgtatggttttgctaattttatatcgatcggccacaaccacaagtatatcatggccacaatagttttatatactattatatcactgtttatttggttcaggttcttaatcgaagtcacttcaacgtcatgcgaccgtgcttcacgcgagctctataaaatactactgcaaagcacgattgtttatccatctaggtttcacatagctaatctatatttctgtgcaccgagatctaaaatattccaattataaaatgcatgggccacaagaaatctaatgctggtaccttgaaaccagtaaaaatgtttctttctttttaaaaaacatatgaccggcttgcagatgtagtataaccggatgtacatctcacaacttgacctggtccgttgcacgaacgtcgctgctgaattgctcaccacgtctagctttcaccaaactcgtactttccatccccgtttgtcttctctatcgcgatagcaaagcccgtactccgtgaagaacaagcaaaacgagatgagtatatcgcgatcgcctgatacaatcacagtgtactacgtgacactgtgacaggttcaaattcgtgcggagcaaactgaaaatgtcactgttccttccaccactagtagtagaagggtgtgtttacttcgcaaattttttttgtcatatcgaacgtttgaccggatgtcggaaagtgttttcggacacgaatgaaaaaactaatttcataactcgcctggaaaccacgagacgaatcttttgagcctaattaagccatcattaatacatgtgggttactgtagcacttatagctaattattgactaattaggtttaaaagattcgtttcgcgatttctatccaaactgtgcagttagtttttttatttatatttaatgctcatgtatacaaaaattcgctgtgatgttactagaaaaaaaatttaggaataaagcaggccgaaaccacagtacggtactagtaagtctgattattactccatgctgttacagaaccgggaggatctgcttcgagaaacgaacaaacgcagtgacgttcagatcagcgagtctattttactctctctgccgataattatgccgacaaccgcagtacattctacctgctacaattacaaagccaggcagtagcagcaacaatcgacaccggaatattccactcggtgtggtcggtggtcaggagcaccaaggcaaaagtcgcgag

SEQ ID NO: 4702 - DNA, 1152 bp, Oryza sativa
atacaacaaccctgacgaatcatcgaaacagatggcactgaacgctgcacgagctgctgtaaacacaggcagtttatgtcgtactctctggtgttccggctcacaataactagctcaccgtaccggttgttcctgcgtagtactcctactacaaccagctgcagtagtattgaaatctactgggagttgtgcacagggtttgtaaaacccccgataacagcatggttaccgtgcttatcatgggttaagtacggtaaaaggtaaaagaaaaaccgtagtaaccttcttaaattcaaataaatttaaaaaataattaatgataaattttacacggtttcgtgctgttaccgtccttaccgccggggcgcggtaactctagtcccggcggtttgggaaactctggttgtgctctgatcccatcacatcgccatggtgaaatcacaagcttttgttccaagttccgaaagggaacgacgctttcgcggaggcggccggagcaggcggcgccgtggccgtggaaagcgcgaagccaaagcaggtcgacgtcgtcggatcgctgtccgcgaggcgagagtcccggtcagtgaagaagaagccaacggctgctcctcgtggccgccgggcccaccgaacagcgacactgttcaggccgtgggccgttcgttgagtcgtccccttccttgctcagccagacttcctcaaaaagtcctaattaccatcctactgctagtgacatatttatggtccattttggatggcatatgcttacattagagctcagatgagtttaagtagggaagtgagagctagaaattggagaggtaatggagtagtaggattttactacactgcagtgctacagctaatgtgcgcgagaattggcaaaagagactagagaagtacgtagaggtccattttttttacaaaattgcagataagaccctgctttcctgcagaattctttattcccccaggcatagtgttttccaactctctctctcggctgcggttacgccggatttgcttcagttccagtgctccgtgggctcggcccaccacgacgacagcggcgggggctgatcgtcggcgaagaacccgccgcacggctcgtcgtcgtcgaggaaccccgtctcgtcctcctccaccttgagg

SEQ ID NO: 4703 - DNA, 1310 bp, Oryza sativa
aaccgaacgacatcaccgtgaattcatacagttcgtatcgcgtggtgaatgcggtcttcggaatatcttcttcacggatggcaattggtgatatccggaacgaagatcaatcttggagaatacagtggcacctttaagctgatcgaacagatcatcgatccggggaagagggtacttgtttttgatagtaacttcattgagagctctgtagtcaacgcacatcctcttcgtcttgtctttcttttccacaaaaatcacaggagcaccccagggggaagtactcggccgtatataccccttttctttcaactcttccaactgtttcttaacttcggccagttcatttgctgccatacggtagggtcgtttgtacaggggagtggttcctggagcaagatctatccggaactcaatctctcgattcggcggcataccgggtagttcttccggaaacacgtcttcgaactccctgacgatggggatttctgacagtccaatctgatgaagttctgaacttctgacagaggttgggggtgcaaagaaaacaaccggttgttccggccctcggtacagagtgacagtgcgtctcgtgcaatccactactccttggaattgagccaaccaattcatcccaaggatcacatccaagttcttggtgtctagaagaatcagatccgagggaaaaggaatcccctgaatgtccatagggacggcagggctataatactttgctgtcataacccctccaggggtggtgatgagcagagggttcctaagcctttctaccccccattgatttcttcccacgaatggcatagatataaacgagtgggaagctccagagtcgaacaaaattgtagcagggatggaatgaccgaggaacgtaccaacgatgacgtctgaagttgtcagcacgtcctcggccgtcacgtgattcacacgaccccgaatgacatccttcccccgttgttgcagcgggagaagcttggccttgctgacgccttggctttgggcatttatccgcaaagtgcccgggctcgaagcagttgaagcacagacgctgctgaccttgagcgtccctgcggccttgaccagccggcacagttggcgtaggaggacggggcgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaaacgg

SEQ ID NO: 4704 - DNA, 787 bp, Oryza sativa
cgatgtagccagccgtgaagaagatagcatcagttggcgttataacaggccagccgtgcaggcggtgacaccagtcagcggcggatgcggcggccggtcggtgaagacgtagacgccaaacaacggcagcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcagacggaaacaccagtcggcagcggcggaggcaagccggtcggtaaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcagcggacaaggcagccggtcggtaaagacgtagacgcccaacaacggcggcataaaggccagccgtgcaggcggaaacaccagtcggcagcggcgaaggcaagccggtcggtgaagacgtagacgcccaacaacggcggcataataagtcagccgtgcaggcggaaacaccagtcggcggcggcgaaggcaagcctggtcggtgaagacgtagacgcccaacaacggcggcataataagtcagccgtgcaggcggaagcacca

SEQ ID NO: 4705 - DNA, 9822 bp, Oryza sativa
aagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccaatcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagtgtcgaaacatgaattcggcaataataaaagggggtagcgcacgagatctaaaagtggatggatgcggagacaagggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaacagctataaagaagcttgtatgttgtgaataaagaaatttccatagtattgggcatacgccatgcgcacactgctttaacagatgtgcttaagtccctagaagacacatggttccaccacacctggaaatatatggcatatgtggtataaaatccgagtaaataaactcataaaggattcaccaaccgcctgaaaaatgaccacaatatataatcagcctaagccataatattggtcaataaaaatgcacacttacgtggcgaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcatcgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcggcagacagatcaactaacaatgaagatgaagaaaatagttgacgacgacaaacgcaaccgacatgatgaagatgatgatgtcggcgatccagtcaatagcagtgtcgcaaccaatgataatgacaaagacgctcatcagcatttgcatagtaggtcaaccgtgaaggtgaaataataagtcggcgaaaacataatcatccattagcaacagcggagatgtcagggccgatgaagcagaggtgctggtgatgatgtcagtgacaataatccatcaaattaatgttatggctgttgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttggcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaacaacatggcatcgcatgccgagatgtcgaggcatgatgacaaagttgcattgccgtgatgaagtgaatacgagtcggcggcaacagaagcaaactggtagtgaagatgcgcagttgtgaagataaaagcaccagtcggcggcggcataatcagtcggcgacagaagatgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgccaaacaacggcagcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcagacggaaacaccagtcggcagcggcggaggcaagccggtcggtaaagacgtagacgcccaacaacggcggcataaaggccagccgtgcaggcggaaacaccagtcggcggcggacgaaggcaagccggtcggtgaagacgtagacgcccaacaacggcggcataataggccagccgtgcaggcggaaacaccagtcggcggcggcgaaggcaagccggtcggtgaagacgtagacgcccaataacggcggcataataagtcagccgtgcaggcggaagcaccagtcggcggcagacgaggcggccggttggtgatgttctgactgatccattcctggagtgtaagagataagcttaaagccatgaatcccttttatgcatgtctggatctggatcctgcagaacaaacatataggatgagtagtatctgatataaatataatactcgagaaaaaatcaagtattttaaaatattgataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattacatctcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtcgtattccctcggtggcagcagaagtagccgatgtgggaacgaaacagtccatcaataacaatgaggacaccagtcggcggcgacgaaggcggtcgacggtgaaagcgaagatgcccaccaacgacgacataataggctagccgtgtcggcagagacaccagtcggcggcggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggttggtgaagacgtggacgcccatgaacggtggtgtgaccaaccaaccgtataggcgaggacaccagtcggcggcgacggaggcaggccggtcggtgaagacgttgttgctatcagcggcggtggcaaaggcaagccggcggagtggactcgcggccaattgaccgaatagctgggacgtctcgagtccatgaccagcatagatcacctagcaaagtcgaagattaaatcattcaactcgccgagattgatttcctcgaccggactcactccgagacggagaaaattggtcgttggtgttgcactgtgtcactaggactaatcaagcaatcgacactgagatggtgaggcctccctgcagcagtagaagcagccagaagaatcggccagccagccaaaaaaacccagattgatcaaattagtagcaactacagaaacaactcaataagtatatatgttgatcgatgcatgcatgcaaatatgcaacatgggtttatccatcctcttgcaggtgctgaacgtgcatgcaagtcaaccctgtaaagaaccaatagtctttgaccagggccagggcgagcacacagcggccggctggactcctgacgtgatgcagtgcacccggcggcaactctcgcggcgccatgtagatggaacagttcgccatgcacaaaatcgatgcgatagcgatggtgtgcccacgtgcgctgttgagcatgtcatctcgcaaaacaaatcatcgatcaatctgttgttagaaattaatctaataataaaataaattggagcggcaaacccggatgaagatcaaagatttgacgagccattgaacacgttgaaattgatctcaacgtttcttttgaagttaattccatcgcacttctcgacgggtaatacgacgcaacccctacctggcgcgccaactgtcgaaacatgaattcggcaataataaaagggggttgcgtacgagacctaaagtggatggatgcagacacaaaggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataatctccacacaaagcaaagcaaagaaaagacggcatcaacactgtgattgcaatttagcaattatgtagtactgttaattaatctgttttttctccataatttacctctacagaaaaaaaaaaggatggtgagggaggggtggttggtgaaacactgaaaccccaaaacggatattaactgaaagaaaaaaacatggaattgaacaattttgcaggaagcgtcacatcagctgccgctcccctccgccgggtcgtcgtcgcggcggccgaggaggagggccgcgaagctggcggcggcgcagagcgcagcgactgcgttgccctcgcgcagcaagacgcggagcgcgagccgcgcgatatcggccgtggcgcgccgcccctctgcgaccagcgacctccgcggctttccggcgaacgcgagtagcaccaacacggtgatccatgtgatgagcatggccggcgccgccacggctaacgcggctcccatcgacaggagcccgaagacggcaccgtacatcacggacgcgtagaaagccgccggccacgccgcgacggcgccagccccgccggccgcggagtagtaccaggcgcgcacggactccaccaggcgccacgacgagcagagcagagaggcgtacacggcgaggaagagggccgcccaggtgcgccgcttcctcatggctcggaggaggagggaggtcaaggggggccatgccgacaagccccatggctcggccacatcctgatctgccatggattgaccacggattgttgattccttgctaggcgatggtaattcctgaggttttgtgggttcgattttgctgggcatgcttcccttgcttttcctgggggtgggtcaaggcctcaagggagagtaggagcaatggggaggcatggaagggagcctgtctgtctgaatcgtcgtttgcttttacttttcctttcctttcttttctgtccttcgtttttttctaaattagtactccttttactccatattataattgctttgaatatattttaacaacatattcgtttttttaaaatactactatatttattaaaaacttaattaaacataaaacaatttaactggaaaaataattaaatcgaattataatatgaaccaaagagagtaataccagtcgttagtctgtggcatacatggaataatctcattaaccataacattaaaatttcaatcgtatgctagtcctggccgctaccgccgctccaatcgctgccgctttgcaccaccgccaccactagctccgccacccctcgccgcacaccggcctttactccatttccctgtatcctcgccggaaccaccatttcactgtgaacccgagctctaccaccgctttgacgactccggtagcacaccaccgccgccatagccgttgccacgtagcgcctccaccaccatcatctccaccgcgccccactgcccctcggccgtccctccgccgtcgcagttagtcactgaagcgccgccgcctccctctgccctgagctccgctggccgactccctccgtcgccgcgcctctcggtgaaccgccctccctcctcctcctctccatttattcccctccttccccgtttcccgtgccgccgctcggtgctagtgtcgtcgccggcggtcgccatttggccacgcgccgccgcctcgagttggtcggcgagccaacccgcacccttgccatgccgctcgtgttggtagcctgtggaccaccccgtggtcttggtccatggtgcgccgcccctccccttttggctgacgtgtggggcccacctttggtggactcggtccacgcccgccccactgctgagccaataacttttgttttcctttaagaaaaatatataataattgcgcaataaatcaataataattctagaaattcatttaaatggctcgaaacttctaaaatccatatctaattcatacaaactccaaattaaaccattcaacttgcaaaattcatctaaaattgagctctacatgtttgtttactttttatgtactgtttacttggtttttattagagttttttcctcgttttgcgtgccagcgagtagtttccgtcgttttgaaagatcgcggttgtgaggaaaatagttcagaagatcaaagtgaagaagcaaggcaagtcacacattctccttgagcattttcatcctaatttataaatgttttatcgtttgcaaataaaaattgcatgtcttactaattgcatgtgatcagggtttacctatctgctcgcttttgccatgtttacttgatatctatcctttgtcaaccttgggtaataaatcgactagctcatgttacttatgtgacctagctagaactatatgcttagccatgcttaattaccactagctcatttgatgggataattgcagtattagacctttcagtatcttgacgagctgcgtgctcgagacatctggccatatttcatggtcgtaattatccaactaaaatgcgactgaatggtgggttgtgggtgcatggttttgctagtcgcacccatggcaattaaggaccggttcgcttgaaacccttgaagacacacagtgcttgccacaagcgggaataggtaactgcctgacttgaagtatagctgtcacaccccgaagttctcctcccaagcctaaatttaatttataaacaaccccaagaaaatgcaggtgcaatcaagagaaaaccctaagaaagtaatgcaaataataatcggatttggcatgtggaatttttcttgagttctacatgtcgaaattcactaacaggatttttagtggaattttcagagccctagaaataattttaaccaattaaaattgagcaagcaatattttaattccagggaaaatcctttttcctttttctttttctttttcctctctttttcctccttttttcgaatgggctgccggcccattctctcctttcctcccccctccctcccccctccctgctgggccggccgcaggccgaggcccagccaagccgcgccgccctcctctcccggggtcgccgacaggtggggcccacctgtcgggtccttcccccaccttccgccgttcccgccgcgccgccgcgcccgcaaccgccgccgcgcccacgcctccgccttctccgggccacgtcagccacgtccgcgcgtgcgccgcatctcccgcgcccactcccctctctctcccgctcgcgcccgcgcccgagatggccggaattcgagttttgaatccccgctctctgttctccaccactcccccacattgaccggcgaaatcccgc

SEQ ID NO: 4706 - DNA, 6717 bp, Oryza sativa
ctcttcctctcaaatctctttcttttcgttctttaggtcgtcccggtcgccgtccgccgcgtgtcgacttccctccgtcgctcctagtcgccggtcgccgccgtccccttcggtgaggactccctccccttttctttacttccccgattccccgtgcgtcgccgccgcccgcgctcgccgtcgcctttggtcgttgccgccgtccgctgccgccgctttcgcgtcgcttttgcgccgtcgcctctgccgccggttgtcgtcgccggcaacgcgttcgcgcgtgcgccgtcgccgctagccatagccggccggtcggctttgatgccgagccgagccccgcggccacctccaccgccgcccgtccgattggcccgagggcgatctgggccgtcggtcccgtggaccggcggtggaccacccgcgtggtcccggtccacggtgaaccgctccccctgagccgctgaccggtggggcccgcttgccggcgccgcgccccctccgtgctggcgtcagccctgggatttattgcgcaataaatgatttaaggtttttcttgtatagtaataaacacagtgaatcttctaaaattcataactaattcatccgagctccgtttaagcccactcaagtctcagtaaatcaagaaaaatgtgtagaatccattaaaaatggttttgttctctgtttcagtagtcttatagcctgtttgcaatgtttgctttgtttgtcgctagattccggttcctccgacgctccggtgtacttcgaaatagtcgccgaggtttctccagcagcagagcaaggcaagtcatgcttgtcatttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctaggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtggggtgtgcttggttagagggggttatgcgaagggtcctgtcacggcctctttccggtgtgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtactcttatgaaattggatagtttaggtggatggttgggcctgtcgcaacgtgggttagcgttggacagtggatagttgatactaattaattattacaactatttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaagtttctccgaggagtaggcttcgtccgtgccgtcgaggatgcctgtggagtggtgttcccgctgcagttttagtcatggcttagctcctgttgtctttcttttcttccgctgcatttttgtaagacttttatgatgtttgtaagacgtggatctgaatgtcaacattgtcgtttgtgtaccccggctggtcctggacggggaatttaatgcacattctgcttgaaattctattcgggaatttctgggcgtgacaatagctttcctctggctaacgttcctaggctagggtgggcgtgatggagttgggtcggctggggtgttcggttgatcggcttccggattcactgtggcacgagggggggctgcccgttgcctgctgggggcgggggcgaaacctgaggtgtggtgcgattggttagagggggttatatgaagggtcttctcacaatcactcgacgtggtgacctgttcatcatgggcacatgatgacactgtgacatgccggtggattgtgtcttgtgggtacagttgtgcacctctggccagagtaaaactattcgaatagccatgcccgcggttatgggagatcgaccagattcaccgtgattagtctcacccctagtaaatcgactcaatgcacttattagttcaggtgggaatggttgggcctgttcaacatggtgtagcattgttcagtggagatttaatataaccttaattactctattgttttactgttttgctcaataaaatgctttacaactgcctttatgcaaatagccacaagccgtccttgtatccccttgcacgtctgcatcattagtgtggcttgctgagtacggtggttgtacttagtcttgctatggttcccccttttcagaagtgtagtgcttctgagctgaagacgaagttagaggaccaaggctcagaccccagttgagttttgcctgtggagtagagctgaagccccgctaggatcgccttttccgctgctgtcattctatctcagtgtgaggactaagtgcctcttctgtaagtattttacgctttatttacgtttggatatgtatatttacttgtcgttttgtgtaccctggctggtcctggacagagatttaatacacaaaatagtttggaaatttgggctaaatttctgggcgtgacaacaagcttgccagcaaatgattggcacaaagaaagagtaaacattccgtagtttacaatgacattaatgcacatgttgacaagagtcaatcaaatcccactcacctctttgctgcccaaaattcacacacactacacattagcgccacaaatacagacaacagttgttcaaaatttaaaacttgatgctcagaaccagcccaccattttcactcccttgctctcactcacaggtataaaaaccaaagctctcaattatactcatattagcaacctattacaccaagagagaccctcaactaatccatggaagaagaggaatatgagattcctgatctcaaccttgatcctggtgtgcaaaaagtgctgcaagatgaaggtgatgggatccctgaccttaacttggatcctgctgtgaaaggagaagatgccttccaatatgaagatgaagagcttcctgataaccaatgttttgctgctcatgaagatggacaaccagaccctgccatgcaagtagttgaactctccaatggctggagtgcacaagaaatttgtcatctaaacatgtagccaggtacggaatcataatcttaatgcaaagcaagttatcctctcttctgctgaaataacagaaatataaatgttgaaagtagcaaagtttgtatgatcaaattttatgaacaaattcataaactaacatgcccaatattacttctttgcataacacagagctttgcagctttgttgttcgtgtcagtcagttgttttttttgactgaaagtactgctaggtctttgcccaacagtgtgattttcatttattgaaggaataattataggtaatatttacaggaagaaacaagagaaaatgtaaaaaaaccctataaagattgtaaccaattaacaacagatcgcttcaggggtccttcattatgtagagatgcagaagaatctcatttgtaaagagagacttccaagaatggaaggttggctgcaaatttctgaagatgagcccatttcgttgtttccaaatgtgccaggcagccatgaagaagatttcctgaaaaccaggctgattgaactgtcatcttgcaaaagctattctttagtaaaattctagattagcattccatgaaattcccagaaattgccaacaagctgtgctaaatggacagttaaagaagagatgatctctggtttccctttggttagtgttgcacagtacacatgatagatcatcatcttgtttggcacagtgcctcctatccaacatatctcttgtattcaatctgtcctagaagaatagccaagcaaagacttttattttcatgacacacttggtcttccaaatccaaatcagaggtctgggtgcttgaattgcagcaaaattgagtttgtagaatcttttgggggtaaaacagctgttattccagatgaaacaccatgaatctccccttccttgttccaggtgaagatgtgtcagttcatcttgaaggttgagatactcacaataggcttgataagagagttgtaacatgaaagaatcttccaatggtctggcacacatagcttgtactgaatcgtctttgtgtagagatgaagcataaagatgctgatattgctgacatttgaattgatcattccacagatctgtccagaatagtactgtagtgcctgtccttatgttgcatttggcagttcctctaaaaacatcaaccaaagcaataatgtcctttaaccaaaaggatcctttgtttattacatgagggactttagctgccaggtaggaattagccacaagattaacccagggaatgtcagctgcagagtaaattttaacaagatgtttcataagcaaggctacattttggacttttaggttaaccatacctaacccccccttttcttttgggttaaaaactctttcccatgaggccaaaggttttctggtggattcagggcagtttcctctccaaagacaattccttcttgcagtatcaatggccttgaacacagtgacaggtaattgtagggagcacatgtagtatgtgggtattgatgataggacagaaattattaaagtcaatctatctccttgaggtaagaacattgaactagctgttagccttctttccaccctatccacctaggggggcaaaatcaatcactcttggccttgtagttcctaggggaagccccagatatgtgaaaggcagttttctaacagaacatcctggaagtcttgcaattagatctgtcttttcttagaaagattgagtggataaagacttgattttgcataactaacttttaggccggtcgactgagcaaacatgtcaagaagttccttgaagcagaagatttccttttgtgaagcttttaacatgatcaaagtgtcatcagcatattggactgaaaaccctgtttactattctttaacatgatcgggaacccacttccatcattttcattaattggctttgaaattaacccaagattgaaagccctgtttactattctttgcaagagttcagcccctagaacaaaacgaagtggagacaaagggtctccctgtctaactcttctcttgcagttaaaagaagtactaggaaccccattcaacagaactgcagagcttgccgaggagaataccatttgcacccaattgagccatttttgtgggaaccccatgctttgcattacagataagatggctgtgtgttcaattgtatcaaaagctttttcaaagtctagcttgaggatgattatttctctttttgactgctaacattgatgaatgtactcaaaagcccatgctaaacaatccttgatggttcttcctttgatgaatccatattggttttcactaaccactttgagaatcacaccttgcaatctgtcagtcatcaattttgtaagaaacttaagacttgatcccattagagaaattggtctgaaatcattaactgtttccggagagggtttttttggcacaagagtgataaaagaataattcaggatctgtaaatctgtagactcagcatgaaaatgagctgcaagtctgtagaaatcttgtgcaatgatatgctagcatttttccatgaaataaccattgaaaccatctgggccaggggccttgtcaactgggattatagagatgagattatcaatttcttgtgtgtagaacatgtcaatcaagcactccaaatctattctaggaacaaaaagctcgttcaaattgaaatctatagttggggagcaagagatacccatcctattcttgaaactttgatagaacaagtttgccttttgatcatgcaggttaactatctgaccactttgattcaaaacttgagaaattgtgttcattctgtacctttctgtggcaatagattgaaacaaattggtgttttcttctcccagcatcatccatctattagtacaatgttttttccaatatattttcctgtattccaaaagttttaagatatgatgcttaactgcctcctgaaattccactcaaataaagagaggcttctgtcttcttccagaagatcatgaaaatcgatcactttatttgagttattcaagagaagcatgattctggacagattcttactccagagcttaagctttttccccaaaattttcaacttgaaggag

SEQ ID NO: 4707 - DNA, 9510 bp, Oryza sativa
aaggccagacaattaaaattccccctgatgcacccatggagggggcaaaagcaaatgagtcaaagcgcttgggggcaaatttcttgatgtcagaaagatcaaagttctcctttttcgtttcttgaagacacaagacctggcaactactctcttcaattttctgtcttaaagacagaagcttattttcaacattcattcctctgatgttccagcacaagacattccaaggtttaaaattactattcattatcacaccattgagagaggggcaaaagaaccaagcctagcacagctaaccgaaaatgaaccaaaagacaatcacaccagtcttgacatatgatgagggatgttaggtcaagatcttccgataggtattgataaacaacgatttgggcggagtcgcgacacaactcgatccggcttctgaacgaacacgctactgagccccgcaatcgtagcaccacgtctcctctggttatcaaccgtgcctaaacccggttgacctcgccgagaaggctaatccctgcatgtgaatcgaagaacacaagcaagaacaagatagattgcaaccaaattgcatatgaatgattaagcactcgaatttggggttccacaaaccgatctagcggcgaaactgttcttgacaggataatccaagcaaaacccaactctaaatgatgacgtctactgaattaatatgattagggatgtcctagggttgccctagggcgcacaccgccttgggctaagcccacgacacaattacaaggcccaaaactcgtgtcagattcggactggatgagatacatggcttgttttgcagattcccggtagctcggtaggaattttgacatgggactaaaaccatctgaaagtagactccataagctttccaacaagtactcatgagcctcgaaattccttatagatcagtggctaggtccgtttgaagttgatgctgtcaggaggcccgaatccgaatccaaaacgtgtagaactttatctcttttcttctatggaccaaaaatgacgtgatgagatggaagtggacttggagaaggtcttgatatggtccccaatcaacttctttgatcatccatgaattctttacattcggtctcttttcctttgcccaagcaagtacctctgcagacaaaaacacaggaaactcattgtgtagcaatgtttgttcaaatatataacatgtaaatctaatgtagaacatatgcacctttggttgattaatacataaggtagtcatggttatatccgagctagttgtgtcctcatcatcctccccttcttgattggaaaccgtcctcggtttcaccttgtcatggagcgtattgtacttatctttgtctatcacaacatcctgtgctgaacatttcttgatgaccatatgattggatcctaaaatctttgtagtcgaaaaactacaacactccccttcttgcaaaccaacctgtaactcatttaaacaactagaggaactagatagataattacttatattcatgcggtcctctagacaatacatttcatcatgaaaacgaggtatagtcaaattcgaacaaatatatactcgatgcactttatattctcctttactatcataattgccaataatatgaaaaatcacatcagaagggcatggcaattccaatctagcaaatagtttcttctctaaatagttgagtgaacaaagaacatcaaattgaatataaccccaagtatttaaagaagatagcaatttaaactcttcattctctctagcaatgtgaataacatgtttaaactcaacacatagtggttctactatagaattaacatgttcattcactagttggggcatggatataagtgaagcatcacacaactcttctttatcacaagaaatatgaagcaaattattttgtgacaaaggtatttcaacaattgtttccactataggttgctctaacgtagcataagtagtagacataggtggcacatcataactatgcataccttgagtagttgtagcaccattatcattacctttattattctcatcttcataaattataggtgcttttccaattgaacattcttcaagcatgcatggagctatagataggtcttttttctcttcgctttcttctcttcctcctcattaccttggttggtctcagatgcctgcaaaatattagtatccaaagcaataggcacaacaatacattcattttgtaataactcagacttagctgaaggcatcgcaatattagtatctttcctggtatctctgaaaatctcatcgattctaattttttgtcctttcaatactatctttgaaattttcctcgattccattcttcatcctttcaagattatcttcgaaaatttcagtaaaactcatgggtaccagttttattttccgaccattatgtctaaatgtgtatgtattagcaacaaaattatgcgaaccattattattatatacccatggttgaccaaacaacaaagaacatacttgcatagggacaagatcaaaattggcagtatcatggtaatttccaatcgaaaagtttattctcacaattctatttatcttgaacttaccacgagagttgaaccatttgatgtaatatggatgaggatgcggttgtgtaggcaactcaagtttctcaaccaaatctgaactcaccaagttattgcaactctcagccctacccgtcagcgagggtggcgagcgggcccgcccgtcagcggcgcgcgcgcggggaggaggccgaatgggccgcggggagaggagagggagggggaaggagatgggccgagccggcccaagggggagaggggggaaaaggactttttttagagcttttctttttataaaaccattttaactttgtttatttcttaatatttattatttgtgctctgaaaattccactaaaatttatttacgcattttagacttttaggaaatatacaaaaatcctccaagccttatttgacttttaactttgcacattttaattgttggaggctttcacacggattttaattattctaggcataatttagaggatgtattttagagtcgttttgggacgtgacaaacctaccccccataaacggaatctcgaccccgagattcggaagaactggcgaagagattgggatgggctgccttcagctcgtcttcacgctcccaagtagcttcttcctcggcgtggttgctccattggaccttgcaaaaacggattatccggttcctggtcctgcgctccatggtgtccaggattttcactggcctctccacgtaggtcaagtcttcgcgaacttcaatctgctctgagtcggcctgctcggacggcactcgaaggcatttcttgagttgcgacacatggaacacatcatgcacgttgcccaaggaggcgggcagctccaactggtaagcgacttctccgcgccgagcaatgatacggaaaggacccacgaaccgaggtgcgagcttccctttcgtctgaaacctgtgtacaccccgcaatggcatgacccgaaggtacacaaaatcgtccactgcgaattcctgattacggcgttggttatctgcataactcttctgccgggactgtgccacctttagattatcccgaatggttctgactttagcttcagcttctctcaggatatcagtcccgaacacttggctttccccaacttggtcccacaatagcagtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttttaggatctgatttagactctcggtctgtccatctgtctgcaggtgatacgtggtgctgaaatttaatcgggtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctaccttggttaatcggtccacaactacccatatggaatcatatccgccttgggtttttggaagtccggtgatgaaatccatcccaatttcatcccatttccattctggtacttggagaagttggagaagtccggccgttcgttggtgctctgccttgacacgctggcacacatcacaaagggccacgaactctgcaatttccctcttcatactaacccaccagtatttctctttcaagtctaagtacatcttcgtactgccagggtggatggaataaggactttcgtgagcttcctgaagtattagctggttaagttctctgtcgtctggaacgcatacccgattcccgtcccatagggttccgtgttcatcctctgtgaaaccagcggctttaccctggttcatattcttgagtccacgcatatccggatcattctgctgagcctcgcggatttgatcgagcaaggtaggcttggcttccagcgtagccaagaatccacgaccaactatgcttaggttcagggcttccatctgttgattaagttcgggtggaatgccacggacgtcaagagtgttgcaatggctttttcgacttagagcgtcggcaaccacattggccttaccaagatgatagtgaattcccacatcataatccttgatgagctctaaccatcttctctgccgaagattcagatccgactgagtgaagatgtatttcaaactcttatgatcagtatatatttcacagcgattcccaatgagataatgccgccagatttttagagcatgaaccacagcggccaactccaaatcatgggtagggtagttgccttcatggggccgtagctggcgtgaggcataggctaccacatgaccttcctgcatgagcacgcaccccagtccttggcgcgaagcgtcacaatacaccatgaagtccttgcgagtatccggtaagattaacactggcgaggaaaccagcttttccttgagagtttggaacgccttctcgcattgcgggctccacacaaatttctcttctttcttcaacaactgtgtcatgggtcgagcgattttggagaagttctcgataaacctccagtagtatcctgccaaacccaagaaactgcgaatttgagtgactgtcttgggttgcttccaatcggtgacggcagtcactgtttcggggtccacagcaactcctttagcagatgtcacgtgccctaagattttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggtttaaccgaacgacatcaccgtgaattcatacagttcgtatcgcgtggtgaatgcggtcttcggaatatcttcttcacggatggcaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcttttgtacagaggagtggttcctggagcaagatctatccggaactcaatctctcgcttgggcggcataccgggtagttcttccggaaacacgtcttcgaactccatgacgatggggatttctgacagtccaatctgatgaagttctgaacttctgacagaggttgggggtgcaaagaaaacaaccggttggtccggccctcggtacagagtgacagtgcgtctcgtgcaatccactactccttggaattgagccaaccaattcattccaaggatcacatccaaggtcttggtgtctagaagaatcagatccaaggaaaaggaattccctgaatttccataggaacagcagggctataatactttgctgtcataacccctccaggggtggtgatgagcagagggttcctaagcctttctacccccaactgatttctccccacgaatggcatagatataaacgagtgggaagctccagagtcgaacaaaatggtagcagggatggaatgtatgaggaacgtaccaccgatgacgtctggagttgtcagcacgtcctcggccgtcacgtggttcacacgaccccgaatgacatccttaccaccgttgttggagcggggaggcgcctggccttgctggcgcctcggcttcgggcatttatccgcaaagtgcccgggctcgaagcagttgaagcacagacgctgcggaccttgagcgtccctgcggccttgaccaggctgcacagttggcgtaggaggacggggtgcacgagtcccttgttgattctgctgctgctgcggctgtgggacgcgcaccacgaattgaggtcgaggcgcggagcgaggttgctgctgctgttgctgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccgggtagtccccggagactagactgacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagagccacgactccggcgggcacatgggtcctccggaaagcggcggtgaaacgggcccaagtaataggctgcccctctggctgcgtagcctgaaaatggtcccaccatagagatgcgggcccctgcagctggtgggcggcgaagatgactttctcctcatcgctgcactgcacggtgtctagctttttccccacggcatgcaaccaatccaacgcatccacagggttgttggagctagagaaggtaggtgggcggatgcggaggaactcggcgagtttagagtgttgtgggggtggtggtggagcattatgttgtggcggattttggatgtggtggaggaaaccagccatcatgttggcctgctgggcgaggatttgggtgagaatggcgttggtgtctggtggtggtggtgaagacggtgaagaaggtgaaggtggactgccctggttgttgtggttgctgccttcggggtgactgccttcaccggtagcagcacttttcctggtcgtcaccatctaaaaaccccacacagaaccagcaaacagagagagctgacaattaaaactaaccatccccgactaccataattcttgaatttataactgttattaaattggttcattaaagttcaagttgcttaagcaaataaaataaagacaggctccgacatatttataccacacaccggcataaccatgccccatacgactctagcagaaatacaaccaagaaaaacacacgcgcaagcctactaactgcttgtctacagctgcgataggccaggacggaaggtgagcatcagtgctgccaacgccggaggctccatcctcctgaggaaccacgggcgcgggctcggcacgaggggtctcgacgaaacaggtccacgccagggactgacgaacaagctcgggcctggaggtactcttgtgagcggtgatcttctggctgcgccagacgcgcgacgctttgggcgacaagacctctccctgggcgatcttgagctgacgcagctgcgcctccaccgcgtctaagtccttcttgagctgcaggttctcctgacgcagctccaggatcttcagattgttctcgaccatcccgcgacacaccatctgatggaagtcgatacgagccgcgtcgtacgcctccaccatgcgcgctaggtgcacgatggtagcgtcatcctccgagctagcatctcggaaggtggcgtagtcgcgggctcctccgcgacgagggtggtaacggtagggcgagtgctgcaactcgtccgggtagcgctggtgaagagtaccgatggcgaggagtgcggcgttctggcaagcggcggggaaggaatctccacccgcggtgactgccagcgaagtccgctcgggagagccagcgaggatcactgcagtgacctcccaaccagcgtggggctctgcgtcgtcaccctcctgctccgaaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgttccttacgtgcgtgcattaatccttgtcccaggaggcaaggtacaccaaaagttgatacaattcagagtttaacaagcggacgcgtaaatagttaacttattacatgggcagcgaaggcccagcacacacagagacaaacgagaaacagcggaagactagggcgacgaccacaggcgcttgacggcaggcacgagatagacaccgaagccttcatcctccaggaactcctcttctggggtttgggaaaaattgggcaagactgagtacaaccaccgtactcaacaagacacacccagaaatgcagaataaatgcaagggagtacaaaggagttatactataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccggacttggcacccgaccctgggtccagcttgtcccaaccaacccaggccaccatttcacattttaagtgttaagcaggttttaagaataaaacactaactgggtacattgctcggctgcccataacc

SEQ ID NO: 4708 - DNA, 8647 bp, Oryza sativa
  unsure (1)..(8647): unsure at all n locations
agaatacagtggcacctttaagctgatcgacangatcatcgatccgggaaagaagggtacttgttttttatggtgacttcattgagagctctgtagtcgacgcacatctcttcgtctgtgttttcttctctacaaaatcacagaggcaccccatgggaaagtactcggacgtatgtaccccttttctttcacttcttccagctgtttcttaacttcggccagttcatttgctgccatacggtagggtcgcttgtacagaggagtggttcctggagcaagatctatccggaactcaatctctcgcttggccggcataccaggtagttcttccggaaacacatctccgaactccctgacgatgggaatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctataggaacagcagggctataatactttgctgtcataacccctccaggggtggtgatgagcagagggttcctaagcctttctacccccaattgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggctttgggcatttatccgcaaagtgcccaggctcgaagcagttgaagcacagacactgcggaccttgaacgtccctgcggccttgaccaggctgcacggctggcgtaggaggacggggcgcacgggtcccttgctgactctgctgttgttgcggctgtgggacgcgcaccacgaattgaggtcggggcgcggagcgaggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatccggatagtccccggagactagacggacggacagctcagggtccattcctgccaagaacttctcttgcttctcctcatcttcccgaacatcctccggggcgtaacgggccaggttgttgaactcatgcaaatactccatcacggagcggttgctttgcttcaactctcggaattcccttttcttaagggccacgactccggcgggcacatgggttcttcggaaagcggcggtgaagcgggcccaagtaataggttgcccctctggctgcgtagcctggaaatggtcccaccatagagatgcgggcccctgcagttggtgggcggcgaagatgactttctcctcatcgctgcactgcacggtgtctagctttttccccacggcatgcaaccaatccaacgcatccacggggttgttggagctagagaaggtaggtgggcggatgcggaggaactcggcgagtttagagtgttggggaggtggtggtggagcattatgttgtggtggattttggaggtggtggaggaaagcattcatcatgttggcttgctgggcgaggatttgggtgagaatggcgttggtgtctggtggtggtggtggaggcggtggtggaggtggaggtgggttgccctggtggttgcggttgctgccttcaggttggttgccatcaccggtattagcatttctcctggtcgtcaccatctgaaaaccccacacagaccagcaaacagagagagctgacaattaaaactaaccacccacgactaccataattcttgaatttattactgttattaaattggttcattaaagttcaagttgcttaagcaaataaaataaagacaggctccgacatatttataccacacaccggcataaccatgccccatacgactctagcagaaaaacaaacaagaaaaacacacgcgcaagcctactaactgcttgtctacagctgcgataggccaggacggaaggtgagcatcagtgctgccaacgccggaggctccatcctcctgaggaaccacgggcgcgggctcggcacgaggggtctcgacgaaacaggtccacgccagggactgacgaacaagctcgggcctggaggtactcttgtgagcggtgatcttctggctgcggcagacgcggcgacgcttggggcgacagacctctccctgggcgatcttgagctgacgcagctgcgcctccactgcgtctaggtccttcttcagctgcagattctcctgacgcagctccaggatcttcatgttgttctcgaccaacccgcgacgcaccatctgatggaagtcgatacgagccgcgtcgtacgcctccaccatgcgcgctagatgcatgatggtagcgtcatcctccgagctagcatcccggaaggtggcgtagtcgcgggctcctccgcgacgagggtggtaacggtagggcgagtgctgcaactcgtccgggtagcgctggtgaagagtaccgatggtgaggagtgcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgagagctgcttgccctggtagtccactccatgcggataccccaggacaacgcacatgccccgcagctccaaaacgaagccagtcaggtccagaccaccacggttgatgctgccggccatctacaaacaaaaacaaaaagaaaagcaacattttaaaggtcagattttgacgataaatgaagcagcaggacagagagagactagaggattttcacaaataagacaggatttttattttgaaaatattgctaaggcttgggatctacggctcgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgagaaacaacggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagggcagaataaatgcaagggagtactagggagttataatataaagggttagggtttgcagtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagcttgtaccaagccaacccagggcaaccattccacattttagttgttaaacaggttttaagaattaaaacactaacttgggtacatgctcggcttgcccataaccgagggcgcggctattcgaatagattatactctgatcagaggtgtacatctttacccacaagacacatcttcctcacatgtaaccacgtgccacataccaccacggtatacggacagaagacgtgacatagtctccaacccatcctagccatagacaagagtaccgacccaatcccacctacggccggaacccccgggacaggtaggcaagactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttttgcaacagaggcccgaagaccggtccttatatggccgaggtgctactatcaaaaccatgcaccccgagcccagcctaaaaccattttggggattttgaatagagggggcggtgtgaatccaattccacattaatcaaaccattccatagtgtccaggtgatgagaaaattcccaaagtctagagttgtaaaactacctaatgttgcctaattaaccagcgaagcatctacctaaaatcatactagtggtaccatgagtagagtgtccactagttggggttttgtttattctagggtgaacaaggaaataataataataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaaccacgacgaagagcggatcttccgaagctgcagcgtctacacgaccaacggaaaagaaaagacttttactctaataaactccatataacaagcaggaacaaagcacaaaaatgggttcttgacttcttaaggaaaaattagagacttgaacggtcaaattccgagttcaaatggccaagttatggctatttgaagtttatatgctctttaaatgaatatttgcgaatttcttcatttaaatttaattaaaaaaaggtttattgcgtcagccgaggggagggggcgcgcggaccgggtccacgggagtggggcccacgcggcagccccacggtccacggtggaccgggcgcacccgggctcacaccggccggcgccgtgggtcccacgcgtcagccgcacccgagggcgcgtgtcacatcctgattttttgtttcaggatttataaattatttaataaattattaatagattttatattaaatgatctttaatttacaagtgaagttaaatgtgggaaataaaatttcctaaaaataaagcatggatggatttaatttttattaaattctccatgattaagtcaactctctgaaatattctcggatttttcggagctgaattcctaaatgatacaaagaacagttcagtaattatttgatcaataatgatctaattataattgttaagtgcttttcttgtttaaaatccttaaattataaattgttgtttaaaagggattattagaaatgattttaaaagcttcgaagagaagatctaattttaatttgttaaatctcaatataaaattgggctagataaaattttgttaaatactttgcttaattctataattcctagatttttctgggatttatttgagctaaggaagtatttttaataaatggaatttcatttcatgaataatttaaattgaaaaatgtttttaaaagtccgttttggctttgggccgaaagccggcccaaaacctctcttctctctctccctcggcccaagtcggcccagttcgcaatcagtccgagccgccgctctcctctctctctcgctgccgctgacaggtggggcccgcctgtcggagccgtcttcctccttcggccgccgccgcccgaaaccctagcgcaagccgccgccatctccttccaaattcggccgcgtctttccttctccggtgaaatctttagaggggaaatgatcttctcgatttcctcttccttttctcttatggaatcaacggctaatttcgtttggaaattcgtggattcgaggtcgattcggatcggtctctccctcccgaaccctaatctttccttctcgtcgccggccgccgtgggcctttgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgtttcagtcgtcaccgtcgctcgggaaggccgccatcgtggtcgccaagtcgtcgccgtcctcgtccgccccttcgccgccgccgaagaccgccggagaaccgtcgccgccgtcgacccgatctccgccgccgcttctttctcgtcgccggcgctgtctgttgcttttccgccgccgttttggtcaccggtgagttcgccgcgccgcgctctacgtcctggtgccctccgttctcgtcatcgcgccgtcgttcgccggcgagcttgcgctcccgagccgccgccggtgatgacgtcaccgctgacgtcatcgtcgccgttcccgtgagccggtcgtggaccgattgatctcggccgtccgttttggataggatcgatctcgcccgtccgttcccgtgaaccgctgccgtgcacccggtccaccgcaaaccctagccgctgacgcaataatccttcttttccttttcaaaaataaatcattattgcgtcataattcaattaaaatctatataagtgttttaatccgatttaatctttcaaaattcataactaattcatcttagctcagtttaatgtggttcaagttgcaaaaattgtgtaaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgcgagtgcgctggaagtattcaagaagattaattgaagaccgattattgcaatgcaagtcacacagatcctaaacacaatcctttgagcatgttgatcctatatttaaattctctatttatttcaactgtgcatttattttcaaatgtcattgggtggaattaacctattctttgttatggcccttttgttcttgattactttattccttgataccttgggtgattataattggactagttgaactttatatatattggttcaactagatatcagatataattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccagttcgcgagctactattgtgaaacattaatcgtgccaaccacaagccagcgtgggcaacggctttacctttcgtatagcatggttcattgcagagcaccagactgagaagtggcggagataagcccacaggggtcgctggggagtccatgcctctggttttgagggggtgattatgatccaggaaaggtgcactgtggtgggttgtgttatgcgaggggtaatgtcacagctcctttccgaggtaccgtggtggtactgaggcacatggtggcatgttgtggggctgtgtcttgtgggtacagtggtacacctctggccagagtaaaactattcgaatagccgtgcccgcggttatgggcgggttgagcaatgtttttcgtgattagtctcacacttctcacaataattatggatgttatacctggtaataatttgcttagctcctggtttggagattagatctgtacagccgggtatggttgtttcagaatggttgggcctgagcagcatgggcgtgttgttcagtgttgattaaaatttctgattaattactccactgatttacttctcttaaatgttttgctaaatgctgcttttgcaaatgagactatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatggtgaggactaagtgcctcttaagtaagtatttagcgttttaattaatttgatgaatctgtatattaaattgtcagtttgtgtacctcgcctgattcctggacgaggattttatgcacaaataagttcagaaatttattagtgaatttccgggcgtgacagcgcgggcggctgacggtcgggcccacgcggcagccactcggtgcgcccggaggcggccac

SEQ ID NO: 4709 - DNA, 1737 bp, Oryza sativa
cggcgcggctcgggtggacggggtcgacggtgctccggcggtcggcgaccgaaacggataggtggacgaggtcggcgaggatgcggcgaagccgaaggaggcggctccgaggtgggaggtggtccgggtcgacgacggcggcggaccggagctcggcggtgacggtggagagagagagcgacggcgcgagctcgattccggtggggagagagggcggtgagtggcggaaacggtggtggggagctcggggagggtttatatagggttgggagtgagagagggcggccggaagagggggaacgggcgcgggagacccggccgccattaatggcgtcggcgacgttaggggaggggtttccaaacgaatccgggggagagagagagaaaaatggggggaaaggggagggaatcccggggaataattccccccactttattgcgcgcggggacggcgggaggcggcgggattcgcggcggcggcggcgctagggcgcggggaaggcggcgggagcggcgggaggaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagggggagaggggcggaaaggactttttttagagcttttctttttataaaaccattttaactttgtttatttcttaatatttattatttgtgctctgaaaattccactaaaatttatttacgcattttagacttttaggaaatatacaaaaatcctccaagccttatttgacttttaactttgcacattttaattgttggaggctttcacacggattttaattattctatgcataatttagaggatgtattttagagtcgttttggaacgtgacatttatagacctttcgagtgtttttcacttgggtttctttatatattttttcttggtatattaaagctaaagcagtcggctggatgttttattaaacgtcacatctgctcagctacataatcactcggattggatgatatttgttgcttgactatatgtttagtttttaactaatcacatagtcgggggctacacctaattaagtgcatctagccgatgcacctgactttttctatttttcagcccttcccagtctttactcgggagatcaatgcagaaggaattgaagagctcggattatcatttcgtcgactgtaaaggtctcaggggctactatgaagattatggataacccatacctacacggcatgtatagtccgactggatatggggtgccatgtatagatagaatatctttaagaagacttgggttaaattctaaacttgtatatcaaggaaatacccaaaatcctagtcggttacgattgtattttatctgtaactatatattctgttagggatatggactgtattttgtaatacggaccccttcccctatataaggaggggtccgggtgcctctagaggcacgatttttctcctagatcatacaatcaataacacactcggcggatcaatccccggacaggagtagggtattacttcttgaataagaaggcctgaacatgtataaaattccttgtctcttaacacatccacttttccaacttgatagccaccccctttagtattgccgaaatcttgtttcgacagtcggtctcttttccttcgcccaagcaag

SEQ ID NO: 4710 - DNA, 943 bp, Oryza sativa
  unsure (1)..(943): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcattctcattaatctttgctaacactttaaatggtccatcagctctaggcatcaatttagattttctcaaatcaggaaatcgttgttttcacaaacgcaaccaaaccaaatctccaggttcaaaattcaagccccttctacctttgtcacccgcaaacttatacttagcattcatgcgctcgatattttctttagttgtctcatacagttttaacattagctcagcacgttgcttagcatcaaaattcagtgtttcagaagttggcaaaggcatcaaatcaatcggagcacgaggcaacaaaccatacacaacctgaaatgggcacatctttgtagtagaatgcaaggaacgattataagcaaattcaatatgaggcaagcattcttcccacatcttaatatttttcttcaaaacagccccaagcatagtagacaaggttctattcaccacttcggtttgtccatcagtttggggatgacaagtagtagaaaacaaaagcttagtccccaattttgcccacaaagttctccaaaaatggctaagaaatttagtgtcacgatcagaaacaattgtgtttggcataccatgcaagcgaacaatttctcgaaagaacaaatcagtgatatgagaagcatcatcagttttatgacatggtatgaaatatgccattttagaaaatctatccacaaccacaaaaatgctatcacgccccctcttggtcctaggcaatcctaacacaaaatccgttgaaatatcttcccaaggaacagtaggaa

SEQ ID NO: 4711 - DNA, 954 bp, Oryza sativa
aggtcactgcagtgatcctcgctggctctcccgagcggatttctgtggcagtcaccgcgggtgagaattccttccccgccgcttgcaagagcgccgctctcctcgcaatgggcactcttcaccagcgctacccggacgagttgcagcactcgccctaccgctaccaccctcgtcgcggaggagcccgcgactacgccaccttccgagatgctagctcggaggatgacgctaccatcgtacacctggcgcgcatggtggaggcgtacgacgcggctcgtatcgacttccatcagatggtgtgccgtgggatggtcgagaacaatctgaagatcctggagctgcgtcaggagaacctgcagctcaagaaggacttagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagttgtgtggggcatggttatgccggtgtgtggcataactatgtcggagcccgtctttatttaatttgcctaagcaacttgaacttcaatgaaccaatttaatagcagtaataaattcaagatttatggtagtcgtgggtggttagttttaattgtcagctctctctgtttgctagtctgtgtggggttttcagatggtgacgaccaggagaaatgctaataccggtgatggcaaccaacctgaaggcag

SEQ ID NO: 4712 - DNA, 1484 bp, Oryza sativa
atgataaatgtaaaacttaggcctgacaacaatactgaatcttctgtcattaattatcctccatgtttggcctggggatcttctgtcttctttcaccccccaagctggatttagccacctcctcaggagagaggctgcacatgtctacccccatcttctgtatgaccgaaagtgaacaattagagggagaggagtcagagttcatatcactataagaagtttcattgaaatcagactcctacatactgctatcaataaagagttttgcaatacctgcaaattccttaatctttttaacagactttccccttggcttcccaatgcccattcttgggtccatctgcaattctttggttgcattaccctgcagaagtcttgagctttgtcttctgtagggactatagagaatggccttcccatctttcctctttgcaggtgccttggggggaagtagggcaacaggggccacactgattgggctagccacactgattgggctagatgggggcctcacattgattggtagaacatcctcaaccacccttttcggctgagggggtgaaatagactcaaaaggttgcaaaacccattcaggttcatgctggcccactgaaggagaggaatcaaagatggacttccttggcaggagcaatgtggagaaatagttggacattcttaaagcagcaggaataggcttgccctggatcaaagtctgcatgatgccctttgctttacagaggaagtcaatcttgtccaatattcccttcataggataaaagtaggggtgccttggagcttcatttctggcaattctattcagccgagctagaaattcctggacttgggggtctagaacaggatcctggactgatgtcatcctagctgaagggagaggtgtggccatctgctgaggtagaattagttgtcctgggttttcctcaatctgccccattggatggtcttggccccaggcatcttcttgttgttcatttgcagcctgctgttgctgcactgcctcatcccattctcgagccccctggttcccagggttgccaaactgccagacattaccatcatcggggtcttcgtcagctgcatcatcaggtcctggctgcggaccggcatgggggagatcctcttcaggggggaaatttataaaatccacctgtagcatgaaaaccgagactgtccaagattcatgtcacgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgaccgcaggcacgagctagacaccaaagccttcatcttcaaggagctctcttctgggcttgggaaaaattgagca

SEQ ID NO: 4713 - DNA, 12542 bp, Oryza sativa
acgccatgagactcacgatcctagcgaagtagagctcggctagtttgttccctccataggtggtcttcacaggaataaatcgggctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacgaactctgcaatttcccgcttcatactaacccaccagtatttctccttcaagtctaagtacatcttcgtactgccagggtggatggaataaggactttcgtgagctacctgaagtaccagctgtttaagttctctgttatctggaacgcatacccgatttccgttccatagggttccgtgttcatcctctgtgaaaccagcggctttaccctgtttcatattcttgaggagtccatgcatgtccggatcattcttctgagcctcgcggatttgatcgagcaaggtgggcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatggtcagtatatatttcacagcgattcccaatgagatagtgccgccagatttttagagcatgcaccaccgcggctaactccaagtcatgggtagggtagttgccttcgtgagtccgtagctgacgtgaggcgtaggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttaggttgcttccaatcagtgacagcggtcactatttcggggtccacagcaactcctttagcagatatcacgtgccctaagaatttgacttcggacaaccagaactcacacttgctaagtttggcatacaattgatgttcccgcagctttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggtcaaaccgaatgacatcaccgtgaattcatacagcccgtatcgcgtggtgaatgcggtcttcgcaatatcttcttcacgaatacgtaattggtgatatccggaacggagatcaatcttggagaatacagtggcacctttgagctgatcgaacagatcatcgatccggggaagagggtacttgttttttatggtgacttcattgagagctctgtagtcgacgcacatcctcttcgtcttgtctttcttctctacaaaaatcacaggagcaccccatggggaagtactcggacgtatgtaccccttttctttcaactcttccagctgtttctttacttcggccagttcatttgctgccatacggtagggtcgtttgtacagaggagtggttcctggagcaagatctatccggaactcaatctctcgcttgggcggcataccgggtagttcttccggaaacacgtctccgaactccctgacgatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggagcttggccttgctgacgccttggctttgggcatttatccgcaaagtgcccgggctcgaagcagttgaagcacagacgctgctgaccttgagcgtccctgcggccttgaccaggcggcacagttggcgtaggaggacggggcgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaagcggcgcttgtgcgactccagttccttgtgcttggcttccaagcggatgctcttgtccaccagtcggtggaaatccggatagtccccagagactaggcggacggacagctcaaggtccattcctgccaggaacttctcttgcttctcctcatctccccgcacatcctcggagcgtaacgggccagattgttgaattcatgcaaatactccagcacggagcggttgccttgcttcaactctcgaaattcccttttcttaagggccacgactccagcggcacatgggttctccggaaagcggcggtgaagcgggcccaagtaatcggctgtccctctggctgcgtagcctggaagtggtcccaccagagagatgcgggcccctgcagttggtgggcggcgaagatgactttctcctcatcggtacactgcaccgtgtctagctttttccccacggcatgcaaccaatccaacgcatccacggggttgttggagctagagaaggtaggtgggcggatgcgaaggaactcggcgagtttagagtgttgggaaggtggtggtgaaacattctgttgtggtggattttggaggtggtggaggaaagcattcatcatgttggcttgctgggcgaggatttgggtgagaatggcgttggtgtctggtggtggtggtggagaagaaggtggaggtggaggtgggttgccctggtggttgtggttgctgccttcaggttggttgccatcaccggtaacagtgtttctcctggtcgtcaccatctggaaaccccacacagaaccagcaaacagggaaagagctaacaattaaaactaaccacccacgactaccattattcttaaatttatcactgctattaaattggttcattaaagttcaagttgcttaggcaaacaaataaagacaggctccgacatagttatgccacacaccggcataaccatgccccacacgactccaaaaagacaaacgagaaagaacacacgcgcaagcctactaactgctcgtctactgctgcgacgggccaggacggaaggtgagcaacagcgcatcctccgtgctaccaacgccggaggcttccccctcctagggaaccacgggcgcaggctcggcacgaggggtctcgacgaagcaggtccacgccagggactgacggactagctcaggcctggaggtgctcttgcgggcggtgatcttctggctgcggcagacgcggcgacgcttggggcggcagatctctccctgggcgatcttgagctgatgcagttgcgcctccactgcgtcgaggtccttcctgagctgcaggttctcttgacgcagctccaggatcttcaggttgttctcgaccatcccacgacgcaccatctgatggaagtcgatacgagccgcgtcgtatgcctccaccatgcgtgccagatgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtcgccacccgcggtgactgtcagcgaagtccgctcagaagagccagcgaggatcactgcagtgacctcccaaccagcgtggggctccgcgtcctcaccctcctgctccgggagcggcctggcctggtagcccactccatgtggataccctaagacaacgcacatgccgcgcagctccaagacgaagccagtcatgtccaaaccacgacgggtgacgctgccggccatctaaaaacaaagaaaagaaaagcaacattttcaaaggtcagatttttggcgataaatgaagcagcaagacagagagagactagacagttttcacaaataacaaaggatttttatttttgaaaatattgctaaggcttgggatctacggctcgtcctagggtcaaaggatgctctgataccaacttgtcatgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtcaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaataggttttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatagcaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaccgacggcttcgacttccacgaagagcggatcttccgaagctgcagcgtctacacgaccaacggaaaagaaaaaggcttttactctaataaactccacataacaacagaaacaaagcacaaaaatgggttcttgacttcttaaggaaaaattagagacttgaacggtccaattccgagttcaaatggccaagatatggccatttgaagtttatatgctctttaatggatatttgcggatttcttcatttaaagttttaattaaaaaatctcatttattgcgtcagccgggagagggcgcgcggaccgggtccacgggagtggggcccacgcgtcagcctctcggtccacggtggaccgggcgcacacggctgacggcggccggtgccgtgggtcccacgcatcagccgcacccgcgggcgcgggcggctgacggccgggcccacttggcagccgcgagggcacgcccgaaggcggcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggatgacggcgctccgtcggtcggcgagcgaaacggaggcgcggacgaggtcgacgggaacgcggcgaagccgatggaggtgacgccgagtggggaggaagtccggagcgacggcggcggcgaaccggagcttgtcggcgacagcggagagagaggaagatggcgcgagcacgaatgcgacggtgagagcgagcggcgaacggcggaaacggaggagagaggcacgggagacgtttaaatagggccgagaggaggagagagcggccggaggagatggaaaccggcgcggagatctcggccgccattgattgcgccggcgaactttgcgggcacaaaatcggacgaatccgagggagagagagaggggaaagtgggggaatcgggagagggaatcgcggggaatgattcccccctcattatggcgcgcggggacggcgggatgcggcggaatccgcggcggcggcggcgctagggcacgggcgagcggcggacgcggcgggaggaaggcgatgacaggtgggtcccacccgtcagcgagggtggcgggcgggcccgcctgtcagcggcgcgcgcgctgggaggagccgttgggccgcggaggagaggagagagagggagagaagtgggccgagccggcccaagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaattcacccccacccccagcactaagaggatcaaagaggacaatctttctcggcacagaatcctggtccctgtacttagccataacaaaaacccttcccaacattctgtcagcatcctcccaaaaagtttacttaccaaaagaggtaactgcctggtgcacatgatggcgatcaatgaaatcaagcgggaaatctaggaacatgaaccagccttctctatggtagttagccgccctccaattaggacattggtcatgattaacaaaaataacagagtgaaccccatcatagaactcgggcggggagaggaccagagcatccctattcatggcagacctcatctggaagaaacctactacagacgggtaccagaagctgttacaaacctcatagtgtagctcatcttgaacgaagtttgcaatgagggcccgatgatgatcccagtcctgctccaaggggattggctctacaatggccacatagaagtcttcatggcgccgagcagggcgttgcgggacagtgaggtcaacccgcgggatgcggaagtcacctccagcatgaacaacaagaccatgcattaggaagcgcagcggattagggttgagattggccattggggtggagggaagctttgggtgggaagcactgtgcgtttgggagaagaagggtttcggggggaagaagacgagatttccggagaaatagttttagccttccaaacagcagtagtccgagccgacggtttcggatttttagggtgcggggcttttgtgggcttagtggtcaaacaataacgggctaaatggcccggcaagagacaggctcgacatctaagcggcccagaacaagaagcccgagaatgacccttttccaggcaacggccgcaaggagtgttttccaaatttgaattgggcgacaaattaggatcccgcatacctttggcatgcgtaattaactccattgccggaatgaacgacggcgagacgttagccaccttggaggttgccggagaagtgactgaaaccgttttactctgcttaaaccactcttgattacaaaggttattccagctattgcctcttgttgaccgagagaagatgtagggaagaccatttggattcagcaagacaatgcacggacacatattctaccaaacgacgaagcatttgccctcacggtggcccaagtaggctattgacgagtgttaaatgtcgattctataccgccaacatctgcataaagatcagataataaaacatccaacatagtgataggtgcttaatctcacatattccacaagtgttggtctatatttgtatgcagataataaaccctgaagttgggaggaaaattagactaatgtgaggagaattatgtaatcatacaaggaggggttgtgaacttcatcgaaacattagtgaatcaacccaaaactccgagaaatggacagaggagagcctagggagtccaccgactgaaggctaggccaggaggggccagcccaagttcgaccgaaccacctggttcgaccgaacccccctgatcaccgctgatcctagggtttggcgaggacgctccagatgctctcccaatgacggttgaggggcagttcggacatttccccttcgcgaaccgtcatacctacccctatataaggacatcatctcactcacttcaacacatacttccaagcttgagctaaattataagaggctttattgtactatattgtatactaaaataggaagagcgtagagtaggagtcggaagaattccggagttgtcggtaatcttctcctatttcttttattctatttattactctgaatttaatataatattcttcttgagtaatttagatttatcttgtgagaattatctcttggttagttcctaaatagcatacggaattattgttcactgtaatcaactaaaatatagtgattgctttgctgagttataaacactaaagtagatagtaattgcttagacgtggtgtttaggtaattgttgtccagtaattgctgcgtataccacagtacgttgaggtgggtgtagaggtggtgacaaccctcgagatcactgaagtcctccctgtccgggtacgtagtagagcgacatctgggaacagcgggttgccagttcctgaagtactgcgttaggattaaaattaagctttctctagacactgtttctcactaataaatcctctctatcctagcctatcatttgcttggtgtccttggatgaaccggaggaagctctgatcacacacgttcccttggattcgatacccttggaatacaccgtaggggaagtgttacatcggtatatctgtgcacttacggattttatctgtaaccgtatcaaataccaagaagcatttctagcaccgttgctggggaacagttgctgatcatttccgaacccagttcatcctcgtatcttttttcattttttttattctaccttcacccctgttatcctagagaagtattcttgtcaactcttctcgaccatggagcaacctctgtttgagttgtctactcctcggggcgaattctatgagccacctccttcatcggagcccatttgtacaactggctatgaaattcgtcccgagctaattagtatggttagggaaaatcctttttctggttttgatctagaaaatccctaccatcatctgcgagactttgaacaagtccgctcatgccttaagattcgtggcatgagacaagaaactgtgtggtggaaattgttcctgttctctcttcaagagagcaaagcaatggtacacctctaccgttggatgtgtaaatggtagctgggaaaagctgcgagacagattctgttttgccttcttcccagttactcgtatcactgcccttcgaatagaaattctcagtttcaagcagatcgaaaacaaatcaatcggtgcagcttggtccatattcactaatttagagcagtccggaccaaccctgtccttacccgagtatgtgcttctccaagatagaggaacctctaacaatcgagccacttgctgaaccatccacttctgctagctcaattgatgagaaggttcccgagcagccgtccatcgagaatgaagaaattcagactccggattgtgccgcaattatgttcagggacggttttgacgaagactatggcaataccctgaactattttagcaagaggaaaccacccgttcctttgtcacctcccgatcctatggaactcgggttcctatgagaaattgtccgggaattgacatccataatgagcaatgaatggctaagggaggcagagctttcatccgaagtaattcggataaatactgctccccgaatcattccttgccatctggaagggaacgatgtcggtattctctatagtccaactgtcggggccaaccttgtctctgagttttttgcattcgcttatttaagtgataaggcagtgacgccgacaaacaaattcttcaagcatccaaatggaaatatcatcgaaggatttgggattgtacaagatgtgcttgtctgctttgaagacagggaggcgatcttggatttcctcatctttgaaatccaagactttgatatcctaatcggactgcccattgagcaacttctcatcaactcaccccgattaggtagcctcaaaataacactaggagagaatgaattctcaattccattttcgcgggcaaggttcaccttgaccgaccctctcccagaaattgagtcagtggaagaggttactgcattttttcctcatgagtctcccgaggcccttctggaagatgaggtccccgaattcatcaaggaagaagcagatcccggtgagactctcgacctgccaatcatggaaccgccacctcgacctccgcttgagcttaaacctctacctctaggcctacgatatgccttcctacacaatgacagagaagcccctgtcatcatcagtgataagctctctgaagacgagactcaacgtcttctcaccgtgttagagaagcatcgttctgttcttggctactcgcttcaggaccttagggggattaatcccgcgctttgcacccatcgtgttcctattgaccccgagggtactccctctatggaacctcaacgacggctcaataatgcaatgcgataggttgtaaagacagaagtcttgaaactcctgcatgccaggattatctatcccgtaccatacagtgagtgggttagcccagtccaggttgtgccaaagaagggaggaatgacggtcattgcaaatgctcaaaatgaactaatttcgcaacgaaccgtaaccggatggaggatgtgtatcgattacaggaaactcaacaaggctacgaaaaagtatcttttcccgctacccattattgatgaaatgttggaacggctggcaaatcattccttcttctgtttccttgatgggtattccggataccatcaaattcccatccatccggaggaccatactaagactacgttcacacgtccatatggcatctatgcgta

SEQ ID NO: 4714 - DNA, 9328 bp, Oryza sativa
gtcattgtctgcagaatctagacaagtcttacaccaatccaagaaaatgacctcgtgcttaattgggaaaagtgccattttatggtctgtgaagtgatagttcttgggcatcaagtgtccgaacgaggaatcgaagttgatcgtgctaaaatcgatgttatagatcaacttcctcctcctgtgaacatcaaaataatccgcagcttcttgggtcatgctggcttttatagaaggttcaccaaggacttgtctacaatcaccagacccctgaccaatctgctagccaaggatgcaccctttcagttcgatgacgcgtgcctaaaatcttttgaagttctcaaaaaggcactcgtctccgctccaattattcaacctcctgattggactctgccctttgagattatgtgtgatacaagtgacttcgctgttggtgagtcttgggccaaaccaaagataaaaagcatcacgcaatctgttacgctagcaaaactctaaccggagcccagttgaattatgcaactactgaaaaagagctgctcgaggttgtttttgctatcgataagtttagatcttacttagtaggagccaaggtgataattgatactgatcatgctgctttgaaatacctgctcaccaagaaagatgctaaacctcgtctcttaagatggattttgctgctccaagaatttgacttagaaattaaagataaaaagggagtagaaaattccatagcagatcatttgtccaggctgcagatcactaacatggaggaacagccgatcaatgatttcttaagagatgatatgctgatgacggttcgcgactccaacccgtggtatgccaacatagtgaactacatggtatccaagtgttgatgtaaaaacacgaggcctgggagatctgcttaactccagtgcaagtccaaaacttgccttcgggtatgctagcgtgacagttgatttgatcctgcaatcaacaagaacaaggacaaagaaaccgcggttaaatccataaacgatagccgatcggccaggtgccgatgacatatcatttatcttcgagccgatgtcatatttgcatcgatcggcaggcattaataaataaaacaaaactaaatctactcgatcggctgtagatattaatgatatataatccttatatcgatatatacttaaatcaagtgattgggatagatcagtcgccatgccgagacagtataaatcacttagatcgaagtatatattaataatgagattatatatattcgtaacatagccgatcagatagatctagcatgtatcggctaatactctgatactgctttatactaagatatcaaagcaaatagaatatatcaaacaaaggcctaatatacttaaatgcaacaagatcttaacataaagggcagattcaacatatcaatgaagcacatagggtaaaaagtagttaaatcaggtaagatcggctgaaaccccaatgttaccctaatcggcaaccaagaagcaggctagaaattgagattctaatcacgacttataggatcaaactgaactgatgtagctataagtatgaaaaatagcacaatatctagacaatcaagccgttggatgtgtcatagagtggtagataccttatataatctaagccaacatcaatatttaacagaggttagccaattatagggtagatagcgatattgccagagattatgtaagatatatgataactcgacgaattacataaacaagattagagtgtcatgaagatggaagcactaatcccgagaacgcaagccgccataacaagttttacctcttgttgaagatcgaaaccgatgcagctcaacccaaaagcaagaactcgtcgaaacaaaacgaaagtaaaatgggtggcgatgtgctgagattgtattgaacgtgtgttaattcgattacatgggggctcggggtctatttatacacgagaattacaaaacatgtccatatcggacatgactcttatctctaacaaactctaagataccataagtctttgcagcagacttttgcccaaacatatctctaaggaaattacataaaatatcctaattaatagatacaattgccttcttaggactctatccatgtgtggcaatcatcttgaaacatatcaactcaacctgatgatgtataccgagttgtattgtcggaatcgactgtatcggcttacctagtctgactcggacacagccgatcctgatcgtagccgatttggactctagccgattcttactctgtttttgaaatgatcttcgtctttgattccgcctcgatctaatcttcatctccaatgctgatattaccaaatttggtcgataacaccaagtacataccaccaggggaaaatcaatgaaaactgaagtatgaaagtcgccgtcacatatgggatgagccatacctatatcgggtctgctccaatggcctactacgaagatgtgtgccaactaaagaaggactggagatcatagaacgatgccatgcctcaccttatggtggtcattacggtgcattccgcacccaggccaagatttggcaaagtggtttcttctagccaacaatgtacgaagactcaaaagaattcgtcagaagatgcaccagctgccagaggcaaggaggaatcactgctcgcgatgcaatgcccctcacatacaatctgcaagtcgagatattcgatgtttggggtatagacttcatgtggcctttccctaagtctcgcaactgcgagtacattctggtggcagtcgactatgtctccaagtgggttgaggctatgccgtgcagcgctgcggatgcgaagcatgccaagaagatgttcacaaaaatcatcttccctagttttggtacccccagaatggtcataagtgacggaggttctcacttcattgacaaaacctttcgagacctcctacaagaaatgagagccaaacacaatgtggccactccttaccatccacagaccagtggacaagcagaaacatcaaacaaacaaatcaagaatattctgcaaaagacgatcaataaaatgggaacaggatggaaggatagattgccggacgcactgtgagcatactggacagcatacaagacacccattggaatgtccccatatcagatagtttacgggaagccatgccgactacccgtaaaacttgagcgcagagcatactgggccattaggaattggaacatggattttaagcgagctggagaatggagaaaaatgcagatcgctgaacttgaggaatggagagaaaaggcttaccacaacgcaaagatatacaaagaaaggacgaagcgcaggcatgacaaaaggataaagatgaagaaatttaagccaggagacaatgtactaatgttcaactccagggttaagctttttggccacggaaaactgcgcagcaaatgggaaggaccgttcgacgtcatcgacacctctttgcatggggcaatcacacttcgcgacgaataaggtaacatatttaaggtaaacggtcaacgcctaaagattttccttgagccaaatgaaactttagatgaagaagtggatgttactgaattaatttattatgaaccatgatgatctcatctattgcatgcttaaaaccctgtatagttgtcatttttgtacttaaaataggttttagtgggcctatgaaaaatttggtggcatgtcgaacccaccattgttcagccgaacatgatggttcggccgaaccagggcggcgcccgatcagccccaattttgaacctcagtctcccccgctcgtccctagtctatttagatgcgtgtttggaggtagaacgttcggatcacaccagaacactccttcctcttttcctccacatttgcacactctcctctccaattcaacacaattcctcgaatttccactcatatccaccaatggctggcaaatccctaatcccattcatcggcccttcctctaattccacttataacctcaccggagagccgacaccagcgaatcaattgatcccgatggaagaatacaccatggaaggggtaattgcacagtgggagcagcccctcgcagcagtgctgggctcccctgcgaatctggagcccgtcggcgagctccttggttcggccgaacccttctcggccccaatcggcctcccgttcggcagcgcgatccctctcccctcgctatgttacaagaacaaaaatccggggggattcgcctgcacgacggccgactacggcagaactcagcttgttaaaggcacgatgtcttttccaagatgacgggaaggccgcaccgcctcccgccgagcgctatgtgggcgccctcttcaccaaggcaggggatgaggtgctccacaagtataccacacccaccgctactccatccaccccaaaaggggagcgtttctgcattcagggagtgtgaactcccggcggtgggtatggcaaaggtttactccggcctttgatggcatcggagaaggagagggcagcggaatcccgtagccttccacctaagaaggtgaagtatcgtttgacgccccctccaattgtgagggctctcggccaattcctagaggatgaggtgaagtcaccggagccctcgatccacaagctcgccgctcaagtgaagaaactccgcaaggagaacgtagagcttagggattgcaatgcggagctaggggtagaacttgctgaaattagaaataatttcgatatccttagtcgcggtttgtgcgctaagatcaagcgtgcgttcatagagatgggaaaggaaaataagtattatgctaattagatgtttcctttcccatgaataaaatagtagtaggtgcttagttttatttttgcaatcatgtaagcacttgctatgaataatgtggcacattggtgtttaccccaatgtttgccaaagtttgttttttgtttaataaaattcaggttttgaataagtgtgggggcgatatcccagcttctgacgtgcatatgctctgaaaattgttgaaatatctgaacacctggaagcactcaactctgcagaaaattgcagaggaatcgggcaccagagtggttcggccgaactaccaggttcgggcgaaccagtgctggccccagtccctctcatcttcacaggtaagcaggtgagcacgtcctttatctgtatatctccaccatggtatagtactagagctgcaaatttagaaacaattggttcaagcataagtgaaagataaaatttccaactattgaaattcttcatgtgattgatcttttatattcattattctcagctgaatttgtgcttgtgaacaccatccatgtttagggaaccttatacatctaggtaattgctttatgtgagatgattaagatgaaaggactccttgtaactttgttgtgactcttgggaatttgttttcaaaaataaactgttttaaaagctctatcctccaattgactttaccttatacctaccaaggccatatgcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgtttccttacgtgcgtgcattaatccttgtcccaggaggcaaggtacaccaaaagttgatacaattcagagtttaacaagcggacgcgtaaatagttaacttattacatggccagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggagttataatataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccatttcaaagtgtccaggtgatatgaatattcccaaagtctagagttgaaaaaccacctaaagttgcctagttaaaagcgaagcatctacctaaaatcatactagggataccatgagtagagtgtccactagttggggttttgtttattctagggtgatcaaggtaataataacaataacaataataatagggtcataacaaaggtaagtaggcatggctaaataaaatagtgataacgcgggaatttaaataaagcgataatgcaataatttaaatcaacataattttacaaaccgggattcaatatgttcaaagatgatgtgacttgccttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaaggaaaaattagaaacttgaacggtccaattccgagttcaaatggccaagttatggcatttgacgtttatatgctctttaattgaatatttgcgaatttcttcatttaaattttcaatttaaaatcagatttattgcgtcagccgaggggaggggcgcgcggaccgggtccacgggagtggggcccacgcggcagcctcacggtccacggtggaccgggagcacgcggcttgcgccggccggcgccgtgggtcccacgcgtcagccgcacccgcgggcgcgggcggctgacggccgggccccacatggcagccacggggcgcgcccgaaggtgacctcgccggcacggccgacgggaggcggcgcgcccgcgccccgatggtcgccgccggcgaccaccgacgcggcggagcggcgcccgagagaggggagggaagggggaagcgaaagggtcggtccacggctcaccccgggtcgacgaggacggcggaaacgacgaccggagcggaggaaggcggcggcgcggctcgggttgacgaggacggcggtgttccggcggtcggcgggcgaaacggaggagtggacgaggtcggcgaggacgtggcgaagccgaaggaggcgatgccgaagcgggaggaggtccggggcgacgacggcggcggaccggagctcggcggcgacggcggagagagaaggcgacggcgcgagctcgaatccgacggggagagagagcggcgagtggcggaaacggtggagggaggcacggggagtttttgtatagtgttgggagggggagagagcggccggatgagggggactcggccgcggaagatccggccgccattgatgcgccggcgaagtttgcgggagtgtttccaaacgaatccgagggagagagagggaaaagtgggggggaaagagagagggaatcacggggagtgatctccccctctttattgcgcgcgggggcggcgggatgcggcggaatccgcggcggcggcggcgctagggcacgggcgaggcggcgggtgcggcgcgaggtaggggatgacgtgtgggccccacccgtcagcgagggtggcgggcgggcctgcccgtcagcggcgcgcgcgcgggggaaggccggatgggccgcgggggagaggagagaggggggggaactgggccgagccggcccaagagggggagggggggaaaaggactttttagggtttatttcttcttaattattatttgtgctctaaaaattccactaaaatttatttacgcattttaggcttttaggaaatatacaaaaatcctccaagccttatttgacttttaaatttgcaccttttaattgttggaggctttcacatggattttaattattctatgcacaatttcgaggatgtattttagagtcgttttgggacgcgacaaacctaccccccttaaacggaatctcgaccccgagattcggaaggactggcgaagagatcgggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacattt

SEQ ID NO: 4715 - DNA, 23134 bp, Oryza sativa
  unsure (1)..(23134): unsure at all n locations
gggggggggaactgggccgagccggcccaagagggggagggggggaaaaaggactttttagggtttttctttttataaaaccattttaactttgtttatttcttcttaattattatttgtgctctaaaaattacactaaaatttatttacgcattttaggcttttaggaaatatacaaaaatcctccaagccttatttgacttttaaatttgcaccttttaattgttggaggctttcacatggattttaattattctatgcacaatttcgaggatgtattttagagtcgttttgggacgcgacaggactcatggaaataaagtttgctctcaaaacatcaagcaaagaaaatatagccaagccccctccacaatcatgccaagagaaccaatttggagagaaagtgtaggaaaaaggaggatcatttctttattccataattccacaaaatatttgacttttccattttccaccgtaaataaagacccttgatctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagggtccttgataaggattgaacccctgaaatcgaaagtacgcgtgaaggtcatcatgatgttactgcatcatgttgttgatgttggcgaactgagcattagcagattgttgccattcttgtgtttgagctatgtgttccgtgaggttgtactggatctcccctgtctgcacatcaagggtgtccattgtcctagtgatttcacccaagtcccaacgagaggaacttgagcaccattcacttggagatggaggcacaccacttgatctagagggttggttgtccccccagtggatgtcatgaggcgcatgccaccggtcctcactggcgcttgaccaggttgagactccgatgctatggcgtggagcttggatccatccaggtgcatccctagttggtgcccaacctgcctcatacatctgcacgggtgtcgaggatgatgaactttctcgttcgttccttgtcatgttgcgcgtctccctgtatgttccacctgcacgagattcttctatggtctgcaggggaatggttagttcatggcagttgtacaaatgataccccgcatttggcaacaggatttcatttgttaaaccggggaaaaagtatatcaaaaatccatctgctccatgtttcaaaatatgcccttgcactagataggcctcatcaatacgcggacgagcggctgagataaaagcaatttggtcgctaacgacccctagcacgagcctaagtgtaggattatggatatcatttgttgtcaaagccacaactgcatacgtcgaaagacgtggttactcaacagtagttggaaaagaagtaaaatgtattaaattgagaatttttcttgggatccccctattacatggccctatggggctagttatagccccattacaggttcttactactagggttttggttatatagggaatttacatggttgcccgtatgaaagggacatttacacgggtacacagtgtaattgaggttcatgggcccctaacgggccgttaggcgatcgtcgacccaattagcccctaggcttgatgggccaggatggcttcttcggtcctcccggggccgaacttgctacggcaaagtcgtctcccttcggcatatactcttcgccctacatccttcgcccaggaggcctctggcttggtgaggtacccgtgcgattccctgcctctcgccgtcgttgtttcatagtcttcgccatgggggacttcgccctgactaaccttgacgtctcgggcttgaatccccactggtcgcatggtttcagcaggtttggtcaaagggcctcatgccatatcgccaacaagcccctcacgggcaagggtgagataggagcttcggccgagaccgtgcaaaccatgtggtatggtatgtggcgccccctttcgactggtgctcctgccccccattctctttttcaccgccacacttgtcattttcaccgcgcgcgctttcttcctctgttcttcctctcacggcgccccttggcccttcagacctttcactcgctctctctgttcgcaactgcacactcccttcgccatggctccccgcaagcctaacccctcttcggcgaaagggaccgaccccggccggattgacgacgacaccaccgcctatttggggatttctctgatagacaacggcgagttggcaaagttggtcagctctagggcgttggttgagggacaggctttcgccctggggaaagccgttgtaccgaagcccgtcgacaaccggacggtggtgttcgccgtgttttttgaggcggggctccggtttccatgcaactcgttgttgccggagatcctttgccttttctaggtggagctcccacagttgagcccgtcggcgctggtccggatcactatcttcgactgggcgtgccgaacttccgggtttgagcctaacgccgaactcttcgatgccatatttttcgccaccgtgaattcgaagacggtgattaccccggccgggatgaagaagacagtgttcgggagcgtgaactttaatgttcgccccgagcactccaatctctggccggtgaatgccgccatgtcgaagtgggaccgccattggatggcgaggtggtttttccacatcatccccttcgaggctggttccgagtcagcgaaggccctccggtgccggcgcaaggcgattgcacctaactggaaacccaagatcgccgtggacggtgctatggaggcgtggttcgctctgctgcgtaaggtttgttcccgccttagctgtcatgacttggtggagactgcatgcttcgcatctttcccctctcccagtcatggcaagtcgcggttgaccaaggcgaagaggttgatggtctgtcgaagttggttctccctaaggggacgaatggtaagactgcactttcactacgcattcctgttcttggttattttgcttcgttcgacacttaatgtggctgcaccctctattttttttgcagtgttgaccctcaatcaggccgacgccgaagcccggaagatgatcggcgacgtgtcggtcgtcgagtatagccagctcctgacacgataggcggtcggccgggcgaaccgggtttataacggcgaattgcctcccgggcgaacccccacaaggccgacgacgatgcagggccttcgcgaaagtggacgcgcggacaagtgaagcttgcccctaggaagcgaagggttcctgcttcctccgattccgacgccgatgatgaggacgacgtcgaagagcgtgacggcaagtaggaaggggaggaaaaagaggaggcggaggccgtggccgaaaaggccgcggacgaggcggtcgaaaaccgcgtcgacacccctggctacactcctactccaagtccaggtcacaacgagactggggtggaatcgaatagctcccttcttcatcgaaaggatttggagggggcgaaggcgctagtagcgttttcggcaggcaaggcggcgaagggaggcccagttaaaaagatctccaaaaagaaaggactcgtcgatgtcgctcgcgttttcagcgacgacgagtcttctgacgagactccgacttcgcccgctggccacagcttgtacctttcgaccgctcccattcttccgctcgacgctagtggggcaggtggtagcgccgccgctggggcttcaacctccgctgaccggatcgtgatggctgcggcgagggttttcggaagccctctgcgtcagccggttgtttcaccgctagtaaaggcgaaggggaagggggctgccgtcgaaacatctgcctcggagtactccctcgtggtgccccacttcgcccctggtgatttcgagacccgggcggatcttattcccttcgtcgagggagtaagcaatcttgtcttacctgcctgcacccagagcctattcaccgagttgaacgagttcgatgaagggtgttccgctattaaaagcttggcggttcgggtacgccttttcgctctctttttgattttcctctccttttttacatgtcccataattaacatttattctcctcgcccgctcctgtcttggatctagattcttgcggcccactgttcgacagagcgaactgtgcgggcccatcttgatggatttaagaaccgtcttcgggccaaggatgacgaaataggccgcaagagcttgaagatggaggccattgccaaaaccctcaaagaggcgaaggccgaaaacaagtggctccaaaccgaattggagaaaggaaaagaggctagggccgaggtcgatcgcctcaaggccgaactggagaaggggagagaggccagagctgaggttgatcgccttcaggctgaactgaagaaagaaaaagcccattccactatgctgaccgactattataacctcactaagccgaagatggaggctcttcgtctggaggtcagcaaggctgaggcgagcactgtggaggagtcacagcggttttcacgggagatggcgaaagccaccgaatccgcaagaacggcgtgccaaacgctccgccttgcccttactgacatgggtgcaagggtgcgaggagtccctgccgaagacgcctcagccttcaacttcttcgagtggactcagcaggctggtggtgcggtttcgaactgcgccactacatacagcgattgttgtgtgcacgtatcagcggccttcactatgggccttatgtagcagttcggctgtgagcacgtcaccgagttccctaactatacgaagggggactgggaggtaagtgcgcagaacgtttcgccgacgctccgtgtgtggcgaaagcagttctggcagaacgacggccgatccaccgccaaggcgcgcctgctggagcaattggcgaaggcagaggcggcagaccggtgtgaagaagaggacgcggcggccgaagggggtggaggcgatgcccaggatcacctagaggtgtgaggccctccgccctttccttagatttttgtagtttttcttcttccttttgtgtttgccgagagaggcgaatgatgtaaattcggcgggctggccctaaccctccttattgtagccgaaaaaggccccttggatatttggaatgtttgactcaatcttagccactttttatggtcgatgcctttggcgtatatgattacgccactttcgcattatgtaatatttgctcttttttcgcccattcttactatccaattcgtcttttgccctttctgcattgtctaccagggtgtttgctgaaaattgtgcattcggcccccttctgggagttggcgaagcaaaaacgagaaatttgtggcgttgaaggatctgctaaatgtacgatgcccgtttcggcatgtttatcgcgagatggtgataaacggccacagctataaggtttttaaggttgctggctggctacgggcgcaccccgggcgaaccttagaagattatgatcttgttcattcaaaacgtttggaggatatggctagcttttggcaaaaccatcagaagactgatcggcaggaggcgatctcccagcgtcgttacagtctagtctgtgtttcgcccccttctcctcttagggtcgtgtatgatattagtagtgatgacgaacccagttcgtctgaccattccttagagagagagagagtgattgtgggggcgaagatgtaatttatctgtaagctgggctgtaaaaccattgctttttcttttacttgtaccatatttttctttcgaagttaacaaagatgtgttttatttccttttcgctatgcattgtcactttgcgtgctttcgttgggtcagaacgtgttggccctttgcgtatattagcgaaataggttttggcttttcagctttcggcttccgttttcgatccattttgttctacattgtaggaagcactcgtgcattccttttgatcgagtgtaacggtgttcggttagttgttccccgaaacaagctgttgcggtttcaacgttcggcgagcgatgcttcgaccgatttgtttcgcccccatggcctttttcgctgatcaggcgtttgccttggggtttttccacaaattatcaatcacacaaataaataagacgaaggtggaggacacagagattttattatggttcaggcctccatggtagataatagccctacatccagtttttcgtctttttacattttcctcttttttttctttttttccttttttcttctttgccgaaaggtttacatagtgtcgaagggcttacataacgatacatacatttttacaatttggcgatttgggtgccacccgttctagacatagaaaagcttgagagaggcagcgttccaggaatggtcgaactcttcgccttccagtgtcaccagtcgaaaggatcccatactggacttgtccttgatgaggtacggtccttcccacttcaattcaagcttgccaacagctatcgggttcgcctttggcaaaggagatgcagcgaagcaagggttggagcaccccggagcaatatagctggctcttcgcttctgcttcatcctccgggagccaaccgttcttgaggtattttacgaacggggttcaccagtcctttaggtcttcacacagctctgcctggtcgattgccatgatgtccaggatctctatgggcacacttggtgcgtacaggacctcaaaaaagatgtctggcgaatgcgggcctccacaagcagtagatttcgccagggcgtctgcttcttcattctggcctctaggtaagtgttcgaccgttatgccggcgaaacacttttccatagatcgaacagcctcaagatacctcttcatcccttcttcttctgcctcaaaggatttgtcaacatgacttgccaccaatttggagtcagttcagatgagcaagcaccgaacccccaaagctttcgccttttttaggcccaacagtatagcttcgtactctgccgtgttgttggttgtgtcgaactttagccttgcggtgtactgaatcgacacgccccctggcgaagtgagcactgccgcaacgcctgcccccttgtgtgaccatgagccgtcggagtacatcacccaaggttgttcgacaggctagggttcaagggcgaatgtcggtgtccattcggccacgaagtcagctaggacttgggacttgatggcagtgcgggcgacaaaatgcaagtcgaagggagataactccgctgcccacttgctgagccggccagtaatttccttgccccggagcacttcgcccaaaagatactgcgatggcaccgtgactttgtggccctgaaagtagtgttggagcttgcgcgaagccatcactagggcgtaagcaagcttttccatttcgatgtatcgtatcttcgccccttgcaaagtttcgaagacgaaatacactggtttctggcctgactctgtttcttgaacgagggctgcagtgaccgccactggcgaagctgctaggtaaagtagcaattcacttcccagtgctgggctgaccaaagcagatgtgctctgtagatattgcttcagctcgtcgaacgctgcttggcattcgggtgcccaggtaaattttcccgcgcccagagggtcttgaagaagggcaaacctctttcggctgcttttgagaggaatcgattgagtgccgcaattcggcctgcgagcttttgtacttcacgtacgctcgacggggggttcatttgctgaatggcatcgattttttttggggttcgcctcgataccccttttagaaacgagaaaacccaacaacttgccctcgcgaacgctaaccactcagggtggtcgatctcctggatcaccctagccttgcacagcatttgcacctcggctttcgctgcttcttggcgattagcggacatcttgcgcagcttttgtttccttggcttggcatccggcttgcccgccagatgatgcatgatgaggtctgtcgaaacacctcccacctcgtcggggccccaggcgaagatatcaatgtttttcttgagcacctctaggatgatctcagcttctcttacgcccatgtcaccccccagtgatacaagtcttgtgggataggcgtcgtcgacctgcaccttgatcaccctgccgtgaggggcgggcttcggcacgtgcttcacccggtcatgcggttcggcctcaacattgtgcactgctctgttgattacggccaaatcgccctttgatgtagccgaatgttgaagccccttgaccacgatcactccttcagggccaggcatcttgagcttgagataattgtggtcggagatggcttcgaacttgttcaaggttgcgcggccgaagattgcattatagttgtacgggatgtccacgacgtcgaacagtatttgctcttcgcccctgttttcacctgtgccgaaggctaccaccaagtgtgcttggcctagaacttgaactgcttctccgctaaaaccacgaagccgccggtgcttgggtgagggctaagataggcaaccccatcgtcgaccgaacttcctccgtcgactaggattcgctgaacttcgaagccagtacctcggccaagatagctctatcttgatgtgggaacagcactccttcggcatcttctggcccgaaagagatctgctggttcaaatatcgcggggcccctttgcctgccgaagtgatgttgtgcaccattcacagctgcatcttcttttgccgtcttgacagttgattcggcgggtcggcccttgtaatcacttggattactctgcactgcacatcttgccactgttcggctgggggtgcttgttcttgaataccttcgtgaggcgcttcgactgctgctccttgctgcggccttggatcttgcacgttgccacgctgcagaatgtttcggcattgctcggtggtgtgcgaagagcatccgtggaaggcgcagtaaaggtcttttctgaccttcttgcgaacgggctgttgatggctgcttgcttgctgggcgttgaactccttgcggagtgcttgaatttcttcaacagccatcacggccttgcctacacggtcgtttctgaatttcctccaagtcatgggagcttgacctggccttggcgattatccttggttcgctggctgtggctagcgaacagcgagaggagccgattcggcgacctgtgcttgtgcttgggcttgagcagcagcgacagaggccttatcatactcagcttggattgcttgccgtcgcttggtatcctcttcgccccttgcgtatccgtcaatgatgcgaagcaggtgctcgagtgtctgcggctccttattggcgatttttcttatgagttcgccctcaagcaacacagccgaagcggcgttgatgacgaacgcctcagttatgtcctaaacatggcatcgggcttgcgagaagcaacgtatgtactcccttatcgactctcccggcctctggcaaatgccgagtagatgttgctgcggctttggcttctcataggtgcctcaaaagttaaggacaaagacgtcgcacaattgctcccatgagtaaatgctgttagctagtaaattgaagtaccaagagcgtgcgatgccatctagagcgagatgtattacctttgccttggtattttcgtcaccatgagcggcttcgatcgtggactcgtagatggacaggaactcttttgggtccgtttcgcccgagtatcgcggaatgggtgggaacttgaattggggtggaattggacgaatcttgattcccccacttagcggcagccccgtttcgccccccgtctttctcacggcaccttgctgcggaggaccgtttggatatggcgtggcgaagtgcgatgtgatggcttgcacgtgcagttgggccatagtgttcggctgcccggccctaaatggtgacgcttggtgtgccgccatggatgggtcgaacgaaggctgggtccatgccatggcgatcttgttcggcgcctgattcgctccgaagcttggtgtcggtgcctgtggtcggatggttggtgcttgagtagcattgctgaagtcgaactacggtccttgactccatggcgaaggccctggaccaggaaggttcgatggtagccaactgggtgcaccttgacttgtgtttccctccagctggaccgaaggggttgcttctgaaatgttttagggttggttgagctactgaagaaaagcttggagctgcgcctgcaaggccgaagccccttctgccattgcttgcgacatctgaccaagtggcggggggcgtacttgggctcgaccagccgaacttgtggctgtacaagaagggtcgggtgtactgttgcgaccgaacgctgtccggcgcagtacgctggtgcttgcacagcttgtgacggaagggcttgaatcggcgcttgcaggtagaccttgggtgggatgtccgccgaatattggagaatggggaccgaggcgaccttggcttgccgggccgcttcgtacgcctgctgttgctcttgcatttgacgaagcatgtcctagagtcgcgccatgttctgacgcatggcccccatgtcggcttcagcttgcgcttcgaggttggtgttgacttgtgcggcggtaagcgcggtcgaagttgtagcctgctgcggcgaagcagcttggggcaccaccacttcacttgtcgaaaggatctccgccctggtctggagcgcccttgtcgttgcagccgcctttgccgtatcaacagtgttcggcgcctgccccgtcgaagcggcaggagccgaaggtggtggttgcggcgtaggggccgaagtcgatggagccacaccagcttcggcaccaagcaccgaaggctccgctccctcttcgactgccatctccactcctgcttcactctccttacaccttgcaaccttctcctctgcgaccttcttcggtggcattcgctctcagtggtttccctcagaggtccccacggtcgacgcctgccgcttgtcgaaatgacaaccgcatacgtcgaaagacgtggttactcaatagtggttggaaagcagtaaagtgtattaaattgagaatttttcttgggatccccctattagggtttaggttttacggggaatttatatggtttcccttatgaaagggacatttacatgggtatatagtgtaattgaggtacatgggcctctagtgggccgactggcaaacgctggcccagtggcccctgggcttgatcggctgagatggcctcttgggcctccttgaagttgaacttgttatggcaaagccatccgccttcgccatacattcttcgccatatagtcttcacccaagatgcctccaaccttgtgggataccagcacgatccttcgcccttcgccgtctttgcttgataatctccgccatggggacttcgccctgacagactcgacgtcttgggcttgagcccccactggttgcatggtttcggcaggtccagtcgaagggtttcatgacataccgccaacaaatatagtgattgctttggtgagttataaacactaaaatagatattaattgcttagacgtggtgtttaggtaattgttatccagtaattactgcgtatgccatagtatgtttgaggtgggtgtagaggtggtgacagccctcgagatcacttcagtcctccctgtccgggtacgaagtagagcgacatctaggaacagcgggttgccagtgcctgaagtattgcgttaggattaaaattaagctttccctagacactgtttctcactagtaaatcctctctatcctggcctatcaattgcttggtgtccttggatgaactggaggaagatctgaccacacacgttcccttggatttgatacccttggaatactccgtaggggaagtgctacatcagtatatccgtgcgcttgcggattttatctgtgatcgtaagaaataccaacaagcatttctggcgccgttgccggggaacggttgctgatcatttccgaacctggttcatccttgtatcctttttactttttattctaactctacccttgctatcctagagaagtattcctgtcaaactcttctcaaccatagagcaaactctttttgagttgtctgctcctcgggtcgaattctatgagccacctccttcatcggagcacatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagataagaaactgtgtggtggaaattgttcccgttctctcttcaagagagagcaaagcaatggtacacctctaccgttggatgtgtaaacggtagttgggaaaagttgcgagatagattctgtcttgccttcttcccaattacttgtattaccgccctaccagtagaaattctcagttttaagcagatcaaaaacgaatcaattggtgcagcctggtccagattcactaatttagtacagtccgaaccaaccctgtccttacccgagtatgtgttactgcaacatttccatacgggtttggataaggagtccgcattctatctggacataaccgctggaggatcgttcatgcacaaaacgccgtcggaaggaagaataattttggatcgcattctagaaaatacttccgtcatgacgaaatccaatgaacccagccggaggcatccgtgtccaagatagaggaacctctaatgatcgagccactcgctgaaccatccacttctgctagctcgattgatgagaaggttccagagcagccgaccgtcgagaatgaagaaattcagactccggatcgtgccgcaattatgttcagggacggctttgacgaagactacggcaataccttgaactattttagcaagaggaaaccactcgttccttttcgacctcccaatcctatggaactcgagttcctacgacaaactgtctgggacttaacatccataatgagcgatgaatggctaagggaggcagagctttcatccgaactaattcagataaataccgctccccgaatcattctttgccatttggaagggaacgacatcggtattctctacagtccaactgtcggggccaatctagtttctgagtcttttccattcgcgtatttaagcgataaggcagtgaccccaactgacaaattcttcaaacatccaaacggaaatatcattgaaggatttgggattgtacaagatatgcctgtctactttgaagactgggaggtgatcttggatttccacatctttgaaattcaagatttcgacatcctaatcgggctgcccattgtgcaacttctcattaacacacctcgattagaaatcctcaaaataacattgggagggaatgaattttcagttccattctcatgagcaaggatcgccttgaccgattccctcccagaaattgagtctgtggaggaggttattgcagttctccctcatgagtctctcgaggcccttctggaagatgaggtcctcgatttcatcaaagagtaagcggatcccggtgagactctcgacctgccaatcatggaaccggtacctcgacctccgcttaagcttaaacctctacctccaggcctacaatatgctttcctacacaatgacagaaaagctcctgtcataatcagtgacaagctctatgaagacgagactcaatgtcttctcaccatgttgggaaagcacggttctgttcttggctactcgcttcaagacctcagggggattaatcccgcgcttagcacccatcgtattcttattgaccccgagagtactccttctagggaacctcaatgacggctcaataatgcaatgcgagaggttgtaaagaaagagttcttgaaactcctgcatgctgggattatctatcccgtaccatacagcgagtgggttagcccagtccaggttgtgcgaaagaagggaggaatgatggtcattgcaaatgctcaaaatgaactaatcctgcaacaaatcgtaaccggatggaggatgtgcatcgattacaggaaacttaacaaggctacaaaaaaggatcatttcccgctacccttcattgatgaaatgttggaacggctggcaaatcattcctttttctgtttccttgatgggtattctaggtatcatcaaattcctatccatccggaggaccaaagtaagactacgttcacatgtccgtatggcacctatgcataccgtaggatgtccttcggactgtgcaacactcctgcatctttccaaagatgtatgatgtctattttctcggacatgatcaaggacattatggaagtcttcatggatgattttttggtctatggaaagaccttcggtcattgtctacaaaatttagacaaagtcttacaacaatgccaagaaaatgacctggtacttaattgggaaaagtgccatttcatggtccatgaagggatagttcttggccatcgagtgtccgaacgagaaatcgaagttgatcatgctaaaatcgatgttatagatcagcttcctcctcctgtgaacatcaaaggaatccgcagcttcttgggacatgccggcttttatagaaggttcatcaaggacttttctacaatcgccggacctctgaccaatttgctagccaaggatgcgccctttgagttcgatgacgcatgcctagaatcttttgaaattctcaaaaaggcacttgtctccactccaatcattcaacctcctgattggactctgcccttcgagatcatgtgtgatgcaagcaattttgctgttggtgcggtcttgggccaaaccaaggataaaaagcatcatgcaatctgctatgctaacaaaactctgactggagctcagttaaattatgcaactaccaaaaaagagctgctcgcggttgtttttgctatcgataagtttagatcttacttactgggagccaaggagataatctatactgatcatgttgctttgaagtacctactcactaagaaagatgctaaaccacgtctcttcagatggattttgttgctccaacaattttacttagaaattaaagataaaaagggagtagaaaattctgtagcagatcatttgtccaggctgcggatcactgacacgcaggaacaaccgataaacgacttcttgagagacgacatgctgatgacggttcgtgactccaacccgtggtatgccaacatagtaaactacatggtatccaagtacataccaccaggggaaaatcaacaaaaactaaagtatgaaagtcgccgtcatatatgggatgagccatacctatatcgggtctgctccgatggcttactacgaagatgtgtgccaactgatgaaggacttaagatcatagagtgatgccatgcctcaccctatggtagccattacggtgcattccgcacccaggccaagatttggcaaagtggtttcttctggccaacaatgtacgaagactcaaaagaattccccagaagatgcacaagctgctagaggcaaggaggaatcactgctcgcaatgcaatgcccctcacatacaatttgcaagtcgagatatccgatgtttggggtatagactttatgggacctttccctaagtctcgcaactgcgagtacattctggtggcagttgactatgtctccaagtgggttgaggctatgccgtgcagcgccgcggatgcgaggcatgccaagaacatgttcatagaaatcatcttcccaagatttggtaccccagaatggtcataagtgacggaggttctcacttcattgacaaaaccttccgagacctcctacgagagatgggagccaaacacaatgtccttaccatccgcagaccagtggtcaagcagaaacatcgaacaaacatattaagaatattctacagaagacggtcaacaaaatgggaacaagatggaaggatagattgctggatgcactgtgggcataccggacaacatacaagacacccattggaatgtccccatatcagatagtctacgggaagtcatgtcgactacctgtggaacttgagcacagagcatactgtgccatcagaaactggaatatggactttgaaggagcaggagaatggagaaaaatgcaaattgctgaacttgaagaatggagagagaaggcctaccataacgcaaagatatacaaagaaaggacgaagcgctggcatgacaaaaggataaaaatcaagaaattcaagccaggagacaaagtgctaatgttcaactacagggttaagcttttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcacccctcaattcaccagtggctggcaaatctttgatcccattcatcggctcttcctccaacttcacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctcccttcccggcccaagtcgggccagaccgcagccgccgcgcgcgcgcgttcggtcgctacaggtggggcccacctgtcggacccattgtctcctccggccgccgccggccgaaaccctagccgagccgcgccgccgtgccctctaaaatccggctgctccttttcttctccggtgaaatcttttgaggggaaacaatcttcgggatctcctccaccttttctcttttggaatcatcggcttaatcgttttgaaagttcgtcgattcgaggtcgaatcggatcggtctctttcctccgaaccccgaggtttccttcgcgtcgccggttgccgtgggccttcgccgccgcctcctagcccctttaaaaggatccccaagctctcctctacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtcccccgtgagccggccgtggaccggttgatctcagccgtccgttttggatggatcaatctcggccgttcgtttccgtgagccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctctttcctgcttagattccgacgttcccggagagtccgttttcgtaggagaagattttgaagagttccaaggccagcaaggcaagtcacacagatcccaaacaaccctttgagcatattgatcccgtttaaagctattgtttcttttcaactattgcatttattttcgaatgtcattgggtggaattaacctattgtttgttatagcccttttgttctggattactttattccttgatatcttgggttattataacttgactagttgagctctatatgttggttcaactagaagtattagatataattgcttagccctgcttagaaactttagcacactattgggataactttatgactcactattatttaatgatggcttattgatagttcacgatggtcaatcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4716 - DNA, 1102 bp, Oryza sativa
  unsure (1)..(1102): unsure at all n locations
aatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagacatgcataaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgccgccgactggtgcttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttggcttcgccgctgccgactggtgcttccgcctgcacggctgacttattatgcccgcgttgttgggcgtctacgtcttcaccgaccggcttgccttcgccgccgccgactggtgtttccgcctgcacggctggcctttatgccgccgtattgggcgtctacgtctttaccgaccggcttgccttcgccgctgccgactggtgtttccgtctgcacggctggcctttatgccggcgttgttgggcgtctacgtcttcaccgaccggcccgctcgtnccgcgccgactggtgcttccgcctgcacggctggcctattatgctgccagtgtgggcgtctacgtctttaccgaccggctttgcttacgcgcccgcgactggtgtttnacgctgcacggctggcctttatgc

SEQ ID NO: 4717 - DNA, 647 bp, Oryza sativa
tctacaaaaatcacaggagcaccccatggggaagtactcggacgtatgtaccccttttctttcaactcttccagctgtttctttacttcggccagttcatttgctgccatacggtagggtcgcttgtacagaggagtggtcctggagcaagatctattcggaactcaatctctcgcttgggcggcataccaggtagttcttccggaaacacatctccgaactccctgacgatgggaatttctgacaatcctatctgatgaaggtctgaacttctgacagaggttgggggtgcaaagaaaacaaccggttgttctggccctcggtacagagtgacagtgcgtctcgcgcaatccactacttcttggaattgagccaaccaattcatttccaagaatcacatccaagttctttgtgtctagcagaatcagatccgagggaaaaggaatcccctgaatttctatagggacggcagggctataatactttgttgtcataccccttcagggtggtgatgagcagagggttcctaagcctttctacccccaactgattttctcccacgaatgcacagatataaacgagtgggaagctcagagtcgaacaaaatgttgcagggatggaatgaacgaggaacgtaccaacgatga

SEQ ID NO: 4718 - DNA, 1095 bp, Oryza sativa
tgttcatcctctgtgaaaccagcagctttatcctgtttcatattcttgaggagtccatgcatgtccggatcattcttctgagcctcgcggatttgatcgagcaaggtaggcttggcttccaacgcagccaagaatccacgaccaactatgcttaggttcaaggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatggtcggtatatatttcacagcgattcccaatgagatagtgccgccagatttttagagcatgaaccactgcggctaattccaagtcatgggtagggtagttgccttcatgcggtcgaagctgacgggaggcataggctaccacatgaccatcctgcatgagcacgcaccccaatccttggcgcgaagcatcacaatacaccatgaagtccttgcgagtatccggcaagattaacaccggcgaggaaactagcttttccttgagagtttggaacgccttctcgcattacgggctccacacaaatttctcttctttcttcaacaaccgtgtcatgggtcgagcgattctggagaagttctcgatgaatctccggtggtatcctgccaaacctaagaaactgcggacttgggtaactgtcttgggttgcttccaatcggtgacggcggtcactgtttcggggtccacagcaactcctttagcagatatcacgtgccctaagaatttgacttcggacaaccagaactcacacttgctaagcttggcatacaattgatgttcccgtaactttcccaacaccagacggagatggtgctgatggtcttcctctgattgtgagtatatcagaatgtcatcaatgaaaaccacaacaaacttatccaagtattccatgaacactcttgttcattaagttcatgaagaaggcaggtgcattggtcaaaccgaacgacat

SEQ ID NO: 4719 - DNA, 6467 bp, Oryza sativa
  unsure (1)..(6467): unsure at all n locations
tcagcaagtcacgtgcatagtaagaatgaacaaatctagtccgcatgacccgtttcaacgcatcccaagtttgtggcatgttattaggatttttcttgccatgttctatccaccaaaccgaagcaaaatcagtgaactcactagtagcagctctaactctagtgttctcaggaaactcatggcatgcaaatttttggtcacagcaatctcccaagaaaggtacgcatcaggatcatattttccatcaaaaggaggaatattaaatttaattttagaaaaagcatcatcattgttgcgtacctcacgtcggcagcgaccacccatacctctacgattgttgtgtagccgtcaacgatcacgagcatctcgatcatcttgttcagtgtcagcaatatattcatcctcccaattatccccgatgtactctccatcgatgtcctcttcactacgcccaccattgcctccagcattgagagcatcaaaatgcctcacaagagcagcaaggctagtgtcaatgcgggcgaccgatgtctccagccctgtaagcttggtgttggtggcgatctgcgttgactccaattgtccaatcttctcgtttgtcacctgcaaatctgtatcatgtccttctgtgtgttgcttcacttgccttgtaaaatattggatgatgcgtttggtgcgtggggaatgagatgcaccctcctcgtctttatcctcgggacctgccatggtttagaaaagaaggacaccaaaacaatagaggatgtaatataagccctacaactattgggatgtagcttttgcaaaatgctcactcgcagcctatctcacaagctcttaacagttcttatcttgcacacaggaggggacggtaacacacaagttagcaaccgtggaacgaggtgtattagtgctgtagcaacaagacctgtcaagctgtagtcgggtttgtggtggagctgtcggtgggctgaaagcaatgctcaagagaaaactagaaaccacgttagtcaaagcaagttgaataatcgctcaagggtatagtgtacagtgctggtcctaggctagtcgaagtagagacgtgagcctaaccacaaaggatgccacaaaacacaaaccaaacagcaacgataaagggggaatggtggttactcgaacggtggaaggtggtgaccaagggggaatggtggggtgtgctcacaagtcggcttcctctcttctgcctttttttttttgctttctctctctagtgctgaggagagagacacgactttttttattttttttatttttttgatattttttgcacaactaggagcacactggaaccaaccacagaaaatcttatctcaaacggacaaagtatgaagcttgtagaatttttcaaagttctatccgaataggtcccaaagcttctcgccacgaaaacagaattttgcaagcggaatttggcgattttaaatttgccgaacccggcgaagatgggaagaattggatgtaactttttctgtagatgtccatggatatattataagcctaatttcgagtccgtatgaaaaagatatgactgttttaaggaaggtcactcgaatcagggttctatttcctttctagtggtggcaggatacaaggcaactcacaaacgctatcggcaacagatcaaacacaaatagaaagtgatttggtgggtgactgcgatggcggtgacggtggtgatgacgacaaaattgatgagggtggcgatgtgcggtggcaagaactcgaaactctaatcgcctaacactaagaccagcaaattaacacaaccgatgcaatcgaaaactcaacaagccttaactaagcagtactagcaaaaaggtacaatggtctctaggatcacgggaaactaatctactatttttttttgttggccttttctggactataggaaaaaaatttaataacaaagggaagggtaaaatctctcactgatgaaccacgctctgataccacctgatgcgaacccgctagggtttgtggcccgatctttcgatgagaggtggggataactcgattggatgaagacgacgttcacggcccgattacaaccgtccaaagatgctgcgccttagcaaccgatacactgtctccaatggtcaccgcgaacttgtggtgcgcgtcaaccctgccacgagggcactcatcttgcaaacaatcaaagaacaagcaagaacaagtagaacaagcactgaattgctagatgacgatgaaagttttcacaatcaaaaacacaatatggtggggttctgattacatgcagacaggcggtttagccaacatgcacgctgcgagccggtagcaagtagctaactctatcatcaaaacccaagtgttcttggcggcgattagaggtataagaagaggggaagaacaaccacagggtcgtgctccaaccctaggacgcacccctaatgggcccaacttgatacacaacccattgggccaaaggaggtgacgcagcaccatggacagaaagcagttgggactaaaacgacgattgcggccgctccagaacagatatgaacatgtggctggatccatttgaaagtagacttgataagctttccatgaagtacttgcacgccgaaatcgcatgaaattgtgaagaccgtccgatgttggtgctgtcctgtaatctgaatccaaccggcggaaatcctctcccctttggatcctctccatcgttcctgagtaaaacaagagtgcacgcgtctccggggtataaagaagaggaaaatgaactcaagaaagaactcacctaattgttcagttgacgtgcacgagcgcgggtaataggaccatgaagttgtacttgtggggacgtggatgtatcgatggtgttgatatcctcatcacatgttagcgaaaccgggcatccatactacctcgggaccttttttggatggttttatatagttgaggggtacacatttctggtattgcggttaggggaccttagacagactcggcgtacaattgagggatgtcacgtgaacttattccttttaagaatatcttttaatggaagtgtagcgtctcatgtattatcgtagattatagggttaatttgattcatgccattatatttgcttgttttgaaatataccattataattcatgaaattggaaccataccattacaatttaccataaagatgtgccattgcttaccatttcaatacaatttttacttcttcctgaccaaattacccttgtcttcttgttcatcctcttcattccctttctctcttctctcagctccaagctcgatagaacaagatccgttggttgccctcgttttgaggctgtcctacaacgtcgccaccgccggaccttgccaccacaaggcaagactgagtagaggtcagcaacttcgcaggatggctaggtgatgacctatgtctcagagactccgccaccgtaatgtgcagcaacgacctagatgatgctgctcccggagacgatgatgtcggcgacgcctacaagatcgtcttcctgttgttgttctggcggaattctccaaaagtgagttgctggggcccggccccatcctcacatagttctcttcttcccccaattagactgctttagttatgtcagtatgtgtatatctgtgttttgtagtttgtacagctcccaggaaggacacctatggagttttctagagcccattgacctggaggagatggttgttgggatatgcgtaggctacgataacataaatcaaaacttttctaccgcgtaaactaggaaccatgcaagtattagatcatagatcgttatcactcgacgcgctgcgcagcggaagaaggcgctaagaagtcgaaggaattctcgcgaagtagtgcgcgtcgatgtagaggaagtagtcgatggcaccggctcgaccttctcctcctcgtgtactcttctcgcggtactcccatccgatcagcaccgcaaatcagcggcacctctactggtatccacacgtacaaggacggaacgccacgcgcagatgtgctagcacccgcgtgcggctagggttttgctccggaagggaagtgacggctagggtttctcacgtgatgcgatccctccgctggtcacacctctcacgaatatatagaatccatcactcgggcctccaaggcccgtaggactcctattcggatccctatctgaattaagctcatattggatctccatccaatccccttattccggcccattaagcatgcgaccctgtaggttcatgtacactcggctgtaacccgaaaactccttttcgctccacgtgtcaacagcggcccctagcagaacgtattgacccaccgagcatacataaagatcatatcagctgaacctctagcgtatacttgtatgaacccctttgcctcacgatatcgattaagctcaagaaaagatatgtgccatcctctaatagctcaatcattcactcgaatctgtgatagatagattatataacttgtgattgactcctcaatcacttttggcatggccatgcacttccataatctataacatcgaggggcccagagatatctctccataggaggggccaatcccatcttgattattcatattccactacatgtttcacagcatacccaaaaactacttttataatttcccaattacggagtagcgtttagcagtccctaagtaagctacgacacatgttgggaaccatgataatctcaggtctaaggattcaacaccaacactaaatgagatcactgatgacacaacacagatggctcttgcactgtatcatgttgggtctatccaacaacatgttccccaacatgtgttcacattattaatttggtatctctgtactatgatccatgagacatgatcatcaattaatacttgtgctgatcatttaaacatatttgttccacatatgatatttgatcatggatccttaagaaatagtacaaacaacataaagagtctaatgaaagaaccacatattcattaaccaataatgagttatctatttcaaagaacaaagttggataaatatataaacatagtatgtgatacaatcatctgtatgattgcctctagggcatatcactacagtggtgggagtgatgatgcatgctgcacgttgtacaatgaagccaacgacggccattcctgcctcttgttccatcggaactcgaagctgagaggagggaaagaacggggaaggaacaggaggaggatggaggaagaagacgacggtaatttgttcagaaattgtattgaaaggggtaagtattggcacatcttcgatacttactaaattgtggttccaattttataaattataatggtatattttataacgagcaaatttataatggtatgaatctaattagggcccctttgaatcgtaggaataaaaaaacggagaaataggaaaaatataggattctgacaggaatgctagtgtaaaacaaatgattgcaaaacacagaaaaaacacaggaatgatcgtttgattagaccacagaaaaaacataggaatcggatgagagagataaactcaaaggatttttaccaagagattggacctctccaaaacctatatgcaacaagccattccataggaattttgtaggatttcaatccttttcatcaaagagctacataagaaaatttccggtaggatttcaatcttatgaaatttcctccataatttgtttgattcaaagggcccttaatcctagattatattggcttacatgagtctactactagtctactacacgtggcttccatcagggatgtcctaacggactcaaccggtgtttcttctacgcctagtaccttccaggccgagatctcccatttggatcctctgttctgcagtctgcacggctttcttctagctgtcggaagggtgaagtcttgcaacagatgccatacctaccaggaaagcaaagtgtcgaaacatgaattcggcaataataaaagggggttgcgtacgagacctaaagtggatggatgcagagacaaaggatttagacaggttcaggccctctcgatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataatcatgccgtgtgggtatggggtacccataaatctcacagtagcccctgagacctcacagtcngaaagataatctctctcgaactagattac

SEQ ID NO: 4720 - DNA, 779 bp, Oryza sativa
agcttcttccaaaagtgagaggtgaattggcttcccctatcagatacgattttcttgggaacgccatggagactcacgatcctagcgaagtagagttcggctagcttgttccctccataggtggtcttcacaggaataaatcgagctaccttggttaatcgatccacaactacccatatagaatcatatccaccttgggtctttggaagtccggggatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcagctttatcctgtttcatattcttgaggagtcatgcatgtccggatcattcttttgagcctcgcggatttgatcgagcaaggtaggcttggctttccaacgcagccaagaatcacgaccaactatgcttaggttcaagcttctcatctgttgactaagttcgggtggaatgccacgacgttaagagtgttgcaatggctctttcgacttagagcgtcggcaaccacgttggcccttaccaggatga

SEQ ID NO: 4721 - DNA, 1746 bp, Oryza sativa
aagggggaaaagaggacttcttttagggtttttctttttataaaccttttcaattttgtttatttcttctcaattataatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaaacctaccccccttaaacggaatctcgaccccgagattcggaaggactggcgaagagatcgggatgggctgccttcagctcgtcttcacgctcccaggtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcggagacatttcttgagttgcgacacatggaacacatcatgcacgttgcccaaggaagcgggcagctccaattggtaagcgacttctccgcgtcgagcaacgatacggaaaggacccacataccgaggtgcgagcttccctttcgtctgaaacctgtgtacacctcgcaatggcgtgacccgaagatacacaaagtcatccactgcgaattccaggtcacggcggcggttatctgcataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggattgatagctgttattgtaggagaactcggcataggggagactcttatcccaggtcttcccgaaatctagtacacatgcacgaagcatgtcttctaggatctgatttagacgctcggtctgtccatctgtctgcgggtgataggcggtgctgaaattcaatcgagtacccagttcttcttggagcttcttccaaaagtgagaggtgaattggcttcccctatcagatacgattttcttgggaacgccatggagactcacgatcctagcgaagtagagttcggctagcttgttccctccataggtggtcttcacaggaataaatcgagctaccttggttaatcgatccacaactacccatatagaatcatatccaccttgggtctttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctgtttaagtctctgttatctggacgcatacccgctttccggttcataggggtccgtgttcatcctctgtgaaaccagcagctttatcctgttcatattcttgaggagtccatgcatgttcggatcattttttgagcctcggggaattgatcgagcaaggtaggct

SEQ ID NO: 4722 - DNA, 48552 bp, Oryza sativa
  unsure (1)..(48552): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnatctagtggaggaaaacacaaatttcctctcactttatttcagccacaatgtgagatcaactaggaataagatccctcgatacgatgatggttcctctacatttgagagttcttgtaaccttcaaattttccagtaccctggtcggtgttttaatcgtcgcacatgtcgtgatctaacagtggaggagtacaaggctgctttcttgtatattcttactaatatttctgagatggacactttgtttgagtaagtattcatattaaaaaattgttttaacttaataaattcctattattttccctaatccatccctacatatagacaatttgataaggaacaatggaagagcagaattgcacctagtgataagcaacgtcatgacttaagattaaatggttggaaatattaccgtggaactaaacatgggccaaatttctttgactggttcaagaaacaagtaattctgcctactttttaacttcctctccttccctttatttgaaatattctaaactagtaactttcatttatgcagtgcatggcaaattctagtattgatagcaccttgcggcaaatttcttatggttttcctagaagaataaccacttatggatgctatgatgtgaatggatatagatttcgttcagagaagtatgagagtgcaaaatcaggattaagtactgtcaatactggtgtttgtgtgtcttgcgttgacgatgataacaatgttattgactactttggtgtcatcgaggacatcatcaaaattacttgggagggcagcacgaacctagagttggttttatttgattgccgctggtttgatccaacaaattctggtgttaggcgaactgaaaatttgggattggttgaagttaaccacacatctaggctttcaaactttgaaccatttgtgctggcaagtcaagttactcaagtttattacttgccttacccatgtgattccagaccagatttaaaagattggtgggttgtacataatgttacccctcatggttggcttcctcctagtaccacgaatgagtctgctcctcctaatgatcagccacaaattgacacattctatcaagaagaaggattggaaggtcattttgttattgatttaggggatgacattgaaatagcaaccacttacatatctgatgagataactaatgagaaagatttggactatcttgccaaatgtaactctccaacacaaggagatgaagagctggatgatgaggaagatgatgaagaagatgaagaagaagctgaacctgaagccatcatttatgatcctgaagatttctgattgtgttttatgtcttgtattttttttccttgcttatgttgtgaacttgtggtcagtgtgttcttatatgttgtggacaagacttgactaagataagctggatgttggtatctttgtgttactgaaatatgctatatctgatgtaatattgtcttaatagcatttagtttatgtatttaattatactagtaagttatttaattagctgtatgtgcatgtgcagatcatgaacaaccttcgccatcggtctcttgcttcaaagaagcgcccagctagccaactttccaatacaagtagtgctaatggtgctagctcaaggagtgtgccttctacaaatggcactcaagtgaaccctgctaactctaatgctgaaggtcagagtcaaggaagtcatcgtgcaagtactgagcaagctgaacagcaagctacacaaagaggacgaaaggagaggtcaaggaccagcctggctgtaccttgaccgggttggaaggtgggccttatacctaggggtgaaatgtaagtatacattcataaattttttaagcgatgcaagaaaaattcagaactgctatactaatttagtcatttgctactagttcatttgaaccaattatgtgaattgagactaagtgtgctaaccttgtatacaggcaaattcaagtatgtgaattggcatgctgcagagtacaagtatacctcacagcttggggttattctgaaacgcgaatactcaggcactgtgaaggaccttgacaatgatggtagaattattcgtagccgccctgcactccattgggcagattattgtttgaaagaaaatgaagaatatggagagacatgtgcagagcgagtggtgaatgaattttgggtaaccgtaattctttcctatcctagatttcaaagaagtgtttggttttgtttttttaaatctatttgtatacctgtaacacatcatgcagcgattgttttctacaagagaagaattaaaggcagaggctaaccgtgtcttacaacaatatgcaaacaagcgcgtcaatgatatgatgtatcaacttcgtgttgatgctgtcaagctctacttctttaaagtgcgtggggaaaagattaaagacgaagtagcccgtacaattgaactctcagacgaggaatacctgctggctcgtgtggaatgggttagtgaatcagattggccttctctctgccaccactgggacactgagcaataccttgagaagcggaaaaaagcccaagattcaaggctacaatctgaagacgattctcggaatagaggaggatcaaggccatttactgagacacaacagtggctggtagaaaatctgatcaagtaacatcatttcttgtgtattatttcctatttgagctttggttgtgtaacacattattggctgcatttgtaggcacatgactttggacctgagaaggctactggactaaacacatttggtgttatgaaatcaggtgcaaaaaacgtggacagtactggaactcatggacggatcgacaaccaaaaggcagaaaaaatcatggtataaacacagtgatctttcctaactatgtctatattttctttctctagctactttatctccatcattgctgcacaaacttagaaaaggctattgttcttgtaggctgactatactgcagtgactagctcaggaactcaaggagattcagatggccatgaattagatccaaaggcactttattccatttgcaatggactgccacatggacgccttcccataggcaatggtgctatgtccaagtctactgttatagcggccggtaaagagacagcacctaggccatctaccccatcagccaatcaaactttgcgaaacgaaaatttaaaactcacacgcgaaaatgcagaacttcgccgccgaatggattccaatgaacggctgatcagggtaacccttctaatataactgtacaataatatgtgattctgcattctagccttgtctaatccctgtcccattttagtttctttatgaaaagacaggagtggaaccaccatctgaggaagatgtagtgccacctgctaatgaagatctaatgtctcctgcgcatgtccaggtaagttgtgtaatgaaagaaataacactcatttgtctcagtatattaaaaaaatccaacctaagcaaccatggtacccttttttttcttttattttgttaagagaactaatcgtttttggtagcagaatgtcaacaacacatgcagcagttcacaagcctcatgttgagaactgtaacacctgggcataacctcattcttagttctaaattatggtaaggtagccaggaatgtcacccctattagaggtttggaaatatagatgtctgaagcttgtgacatagagagcttgattctagtaactttttgctattctagctggattcgattttgttttacatgaagtttggatatatggtgtctgcgatgggatattaaggatttaagtgtaattgttttattgctgccacaaccgttagtgttgtagtatactgatttctgctagcattggaaataatggtttgccacaactgtttctggtcatgtcatccaaagtcaggcatgcgatttctggcattatttcatttcaatgtttgctattacttcagtggaaagtctagctagccatagatgttttttttctttataaggtatatgcatgttcattggatagatacttctttcatcagaactttggcatcactgcagtgcatacttccaatcgcatgacttaatgttcggacctatttattgcagcgaactggttcttctcatgcgggctcacagcaggaagctgaaaatgatggaaccactgacaccaacatgggcagtgaggagaacgtggtctgtgaggtgaacatcggctgcgaggcgaacaatggatgcaacagaaatcaagtttgcagcagtggacgggctatcgcagcctagcttcttgcatttgcacaatgcatcggtgacgtggacatggcttttgtttcgcacatcagtacttagcccatatattattttggtagcaacttagtagatagagacttcggtaatacttcatggcctgtttggtggtgactaaactagatgagacttaacatagtttatgctcttttggtagcaacaaagtcagattacacatgctcttctgaacacttaagtagtggctcacaagtgtattggttgtaagtaatggctaagtagttgtgcaatgtcagttagcatgtcaaggtgatatggggacacctattggttgtaaacctgattactcctatagaatcagtactagaacttgatgtactgcatgtatggtgatgcaagtatatgaaatggtggctatttgaatcaattggtggctgagatgatggctatttgagtcagctgtgatttggcattatttgaatgattttgtgatttctgggcatgttatttgtgaagctgttgtgatttcattgtttggatgcattctattatgtaagtgaaatgaaatcagatctttttagcagcttttattagctgtttttttttcaatatgctccaattattctgacggttttattataaccaaccgacagaaataatataattctagccaaaaaaaaacaactgcgacggtattttcctgtcggttcactcacaaagaaaaatattgtgacggtattttcctgtcggttccgcgtcagaatttacaggtgaaaaacctgacgccaatacattttcctgtgttccacccccagggaaatacccacagaaattattttcctgtaggtaacccgacaggaaaattgaatttctccgtggtgatttttctgtcggcaatttctgacggtgaaccgacaggaatataatttctgacggttaaagctatttttctgacggttttgcttctacaggctaggcctggagtctggtagtgaaagaccaaaacaaaagttgtagatattgatgatttatataactttgttgttgatgactttttcagttgaaatcatttagtatttgaaaatgttatttgaacatgtcataatttgaaattcaaattcaaattattgaaacagagtcatatagcaaaatgaccaaaacaaaagttgtaggtattgatgatttatacaattttgttgttgataactttttcagttaaaatcgtttagtatttgaaaatgttgtttgaagttgtcataatttgaaattcaaattttatataggtcagttaaactcacatggagaaaaaaccaaaataaaattgtttgatctcaataagaaaattgaattgaaatttgatgttcgaatcaaataataattgaaaagtagtaattagaggtcacctgtcattgtggtttgagaggctggccatacgtctaccttggcttaacggataaccatatccgatcatcacgatgcgacgtggtttctacgcgccggccgtgcaagcagactggcatagcgaaattggacaaaggatgtatgggtcctcaatgagatcgatcttgcccaaatagtaggacagtgtctgtaccggctgctagcttctcgctggccgccgccgacgcgtgcaatggccgtgccctcctgtatacatgcatgtacatcaaaaccaatagataatctagattagattgtggccaatatcaatttaattaggctttacagagcctatgagtctacggttaaaatattataattaatcaaatcaacggttaaatttttataattaatgtgagagcttctacagtatccgatttattgtagatagatagatatgtaagtagttacaagagcctcagtagtacctgaggtccagggttcgacttcccatgaaagcgaattttcaggatttaatggcgctgtgctttcagtggtagacgacgtacccgtcgacagtgaggcgcctatggtgacttcgtcgatctctccaagatttgccggtccagttttcgaagatgctcatatgggtagggtttgcgtgcgtgtgtttataggggtgagtgcgtgtgtgttgtgggtgtgtgggttgtactgtgtaatttagaaaaaaaagaaatgtaggtagataaaaaaagggtgaaaatatatgtttttttccttgaatttgcaagaaaatactggattgaaacgtttggcaaaagtataccgtcgtcgtattcctggttagcgaaaccgtcaaacggggcgcggtctcgcgcatcacccaccgacaccgctgcaagcgccacgaaaacggcatggacgcttttatcaaactaaaggagcagtctcgcttgactaatcaggcattagttaattaattaatgatcttggctcattagttatttaattgattaatctgaattaattaactactaatgatactacaccaattaacttagcattaattagatgtttgagtggtctcgcttgactgacctgcaacatgaccctttaatcagattataattagttaattatcttattaattcgttaattaatatgaattagttaattactatgatatcaattatgctaaaggggtggatgaaaatgttgatattcgtggcatgtttttcaaactgctgaataatgtgttttgtgtgaaaacttctaatgtgaaagttgctctaaaatatcagattaatctatttttcaagtttgtaataattataactcaattaaccaccgtattttacgtaaaacactcaatcttaatcttcatctttatttacgggagaaaaaaaaaacatttgaagcccacctgagttcatcgccctggtctcacatggaggagtgcaggcgaacagtgtggcggagtggggcatcgatattgcataacggttccgcgcgaccacgcctgtctcttgcgtgccaacactatgacatcttggggccgtgacaacgtcgtccatttcgcgccaacgcacgacaccacccatctcgcgtcgcatcacacaagactgtggtgtgacgtcattttcgtataatgatttagcgataacgatggtatatttgtgctaaaagaattacatcccagaaatttatgagaaaaatataaataaacagtatatttttaaatttaattctagatagatattggtaagcaggagcggagttataacgaaaaggaggaacactactacttcctccgtacttcctccgtttcaggttataagactttctagcattactcacatttatatagatattaatgaatatatatatatatatatatatatatatatatatatatatatatatatatatagattcattaatatatatatatatatatatatatgaatgtggacaatgctagagtaaatgttaatgccaaaataataaggaagtatttcttgacaccgcataaacgctttacacgagcatttttgacccggctctagccaaggacccgcatacatcatgtatttccgtaaatgcatttaagcaccgcctaaaaaatatatttacgcagcagatatcttcagattccacctacaaaaaagttttttcacaggcttctattgaaggcatccacccgtgtaaacattaattttaacatgcggatctagcctatgaaccagctgcgttgttctattattgaaaaaaaaaaccagcagctagctatgcaataatgcatgcccttacaaaacattagcatttttcttatcaacataaatacacatcaatcacattacaaattcaaagccatatcacatagatagagaggtagtattgctaactaagttgatcatacacattgaaccgcatcaacagaatacaaattgacatacatagtttttagtcatacaaattcagagtccaacactggcttgctaatgtaattactatttaagatgtcaactccaaacatgcgctcagcaataactaatgcatatatgtaaggccatgtttggatcattagtcccgggactaaggcggtgtttggatcctttagtcctcggactaaaatactaaacactttagttcatgcctgtttggatacagagactaaaagggacttaaggtactttagttcatgcctgtttggatatagagactaaaaaggacttaaagtcattaattgcactgtacaatgactatgttacctctaaaaccattgaaaaagagacgcaccatgcccatgtgtgggggtagcgggtggaaaggaactactttagtcccaataagctcctcccatatatagggactaatggactagtgcactttaagtcctttttagtccctcctgtttgggactttagggactaaaagggactaaagtgaagggactaaagttttagtccctccaatcagatagggcttaaaattagtccctggactaaaaactttagtcccttactgtttggatccaatgactaaaagagactaaaggcacgtggaccaagggatagagaagagagaggctgccactttagtccttttagtcatccctatttggatttttagggactaaaatggagggactaatgctttagtcccatgaaccaaacagggcataagcactttgcgtgcattaagtcttcgtagaccgtgaagtggtttaactctgaataaaatatatattaatgaacaattcaattggatggttagcacattaggagattcgccctacatactagacaattatatataatttatttttagataatgagacaattatatagaatgtaattggaaattagaatattaatgaacacttcaattggatgggtgttgaaaagactgggagacgtaaatgacacatcattattatcttccagcccttatgtgctagacgcaatggtgtaattcgattatctttaataactttcaaattttcatgttagaaaaaaatatttttctacgatctgtgcgagctttaatccaattaattaatgttgtacataattaagatatattttacgcaaagtacaataatatgatattgtgtatcatattacaataatgtgtatatcaataagagaataaccactttacatatcatcgataaggctcacacgtctaagggtatttccatgcatttaaagagccacctgttcaagtagcaacatgtttgttttagaaccttttctgttcggaacttcagagaccaaatatctgtgtaagaaggatatgatcacatcaacataaatggtagcaaaattcgtttaaaacctaatcaatgtgggtgatgtacttgatgcttacttagaaaacctaaactgaccctggaaactgatgatatatacatgacactgaatattttcactaacatacagtacaatatggtttcagacataaaaacaaaaggagtaatatctcaattcatttcccaaattggatacgtcatgcatgcaatcaaatttggaaattcatttatcagttcatcatctcccaaattgcattatccactctttcagagtacataaataaacaacaaaataagctccaattattacatattttacctctacctccaacagcataaatatcatttcatacgacaatcgtcggacgagcaaatatatatgcatagcttccattcatctaaaaaaagaatattacaccacaattttcattcacacacagtagagtagagagttaagagaaataaaatagcactaccaggcatgaaggaacatgttctgcagtgcaatcggtcccatgacatacatggccttctcttgtagttttgacaaagagaggaaaacctgatagaagctcaattgaaaccatttggaataatagaggtgataaactgataacatataaatggaacatccggcgtcagcctccacatccgctgcgcctcgcgtccgctggcagaaatattttcgatatcttcagatatccttcagaacttggaccacttgcagaaatatatacatgcatgaatgattcaaatatatgttctagctaaatgaaagatccaaatattggttctctagtgcttatacaatatttggatgaagagttggatgaagattaagattttcgtggcacgcattttaaactgctaaaccgcacgtttcgtgcgaaaactttagatatgaaagttgctctaaaatatcatattaatctatttttcaagtttgaaataattaaaactcaatcaatcatacgttaataccacctcgttttgcgttaaagacttaatcttcatcttcatcttcatctttaggagaaaagaacaccaatcacaaatgaacaagtcagtgatgcataaaccaagaagtggttcctaaaatctagcttcatatcacataccaataagagtgatgcataaaccaagaagtggttcctaaaatctagcatcatatcacataccaataagcggtttagggtgagaacagcgagggaaaaagttatggatttttatagatgaccgagtgagaaggtaccgaaaccccacctaagagcagatgtcggtgacggtgaagatggcggccgcggcaacgccgttcgtcagcacgggccacgcctcgatcggtcgatcaatattagccactgcatgtttgtaatttctcacttttagactttaaaaccaaagttcagactttcagagttaccttttgtcaatgaatccaaagttcagactttcagaatcttagccatggtaacttataacttaaactgtcttatcatgtgctttatatctatctatttatattaaaattccattaaactttctacaaacgctctcaagccgccatatggcgctcctacaattgctcctaggccgccacgtggcacaatctaatatctcaccgtcaattttcatttaaattggtggtcccgttattttataccgttagattagacctatgccgttgattttcatttaaattggtgtacccattattttgtaacaataaatcagatctatatataatatacctttcttccatatgtacagtttgccggaaggaagaaaacatagttacgtacgtacgataaagataaaaacttcctcatggttaacatacagcgctactactgtacgtatgagttcatacgtacgatacaaatactaatacttccatacgtacaaacgtgcataatcttttctaattttgctggaaaaaaaaacatacacatgaacataaaaagatagaagaaacatacatctataaaaatcaacgaacggtctttaaatatgattttcgataaaatatattacttcacaaatataaatatatttagttaaataaagatctataataaatatccaatcaatgttctttaaacatcttctaaatctatctattatatatgaaaagtatattaaactttttacaaatacttttacaccgctacgtgactctcaaataaattagagaaatcatagaaatatattatatactaaaagtctattaaacttcctgcacacgcttctatattttcacgtggcgctctaatttagagtaatcctggaaatttagagtgaaaaaagaaaagcatccaaccttcaatgttcacttaaattagtggacccattattttaaacaatggattagagctcttaaaattcccattgctaatctctatcaaaaaaacataatgtgcttatgtcgtactatcgtctccctaccggaaaaaaaaaacaaaatttaaatacctacgccatatacgataaaaaaaaagatcaagccaaaaaataaaaagaaaacatgcacacgtacgtacatagtagaatcgaaaagaaatactaataaggaaaaatcatcaatgctggcacagatttattatcaacaacctttaatttacgattttaagatctttctctccaatctaaaattatagtcccgccggtgtagatagaaattcctttatggtctaattccgagcggtagtaaataccatgacttagtaatatttgattgatcacaatttggtatattgcatttattataaaggttgctaaggaattcattataggaatgcttccaatggaaatggtttgctcttgcacatcgaaaccaaaaattaatcgcgtggatacgtataattcagaagaatagatgagtgattcatacacaacattcctttcttttatcgaaggttctagcaattgatatcaggattttttatttaaatctaagagacattcttatcacataagtagtatattaaaatctatcatctattttacagtaaatatatttcttttttcattgtaggataatctaaattcccttacagtatatacatagtgatgtatgattcctttgagcatttttttaataacaaataagatgcccgtgcatctatgtgaaattcctttccgatttatattccaaaaatattctccaatttatattctgtcgttatagtgtttgaaaaacaaactacaatacatgcccccgcgaatgcgcgggctaccttcctagtttaccaaatactgtgaacattcaattgcaaaacctctgaaaaaagtaggaacaagcagtcaacaaaattcagcaatagatcttgagtatagttagagaaggttgagatgtatactaacaaaataaattgctttgctagcatgttcaggtccatagccagtgaagcctataagattgtaatacatgttaattatctgagaagcatattgcttaacgaatataacttgaaatatcattacatcagtgcagttattaacagtgaaagcttcttaaaataaacggaaaagcagtggtcaatcgacattatttcttacccaaaatccatatcctgctaaaaaaattcagtagacgattagctctatcaattggcacgctcataaacaaataatggtcatatcttccaatggaactagaaccagaaccaaaatcaaacaggaacagagtggaccaaaaatcaattggtgttgacagtgaatcagagagcgtggggcggggtggagctaaaatgatgtacaggaacaggttgaagtgcaactcaatgtactataatatttgtcattgtttttttttattttggaaaataaaaagtgtgcatagatgccctcacttatctttagaaacaaaaagggtggacagtcgcccttaaaaatgaaaacgtaaaatgatcaaatacatgaattatgcatctcgttctattgttttggttgattctttaggatgggaataaagagaacgggggaagagagggagggggttaaggatgatgatatatgtaccttccggttaatcaggtcaaagcgggagatgttgttgaagaggccgagaccagtggacacgcagaggcggttgacgaggtggagactgggggcggccggcgtggtgggatgcgtggagatcgcggggaggatggtgtcaactgtacatcattgagcacatagccaaacaaggttatgaggtttcttctgccagtaactagcaaactgctgcccacaacagcaatggtacacaccagaataaatcaacaacctgcttccatgcataatatttattttgagaagcataaaatcaagggccagtgttgcctacaatatagttcaacataaccatccacttaaatgagaaacatcccaaatttttcatcctaggaaaaaaactgcaaaaaagaaaacaaccccattcccttatctcaccaatccagatgtattagttcaccccattccataacctgatcttcgtggaaacattgtatatactgaactgtatgtactgaacaaacgacacaacaattggaattgtggaaacagtataaatcaagatagtttcgtacagaaagattgttcgtttcccaccagttatccccaaaaaaccaagactggctattgtataatggaaaccacaaccctccagatctcagtcacagtgttagcgttaggcataaacttaccggtgggcgcgcggaggagaccgagatcaggggcgcagagaaaaccgacgaggcgggcgcgacggcgggacgatgttctggtgacgaagttcgaggtggagatcggaggcggcgtggagaagggcgacgacgagagatcatggacatgccaacggcagggttgtgggagcgcgggtcgaggcgtgcaacggcgaactggctgcgtgtagctgggagtgggtcagggtggcaggcagaagggagaaccggcggcgttgcaacagtggttagggtttagagagcgacggagggggcagtgggtgatgcgggactgtggggggtgatacggaggaggagggatggggtgtgtgtgcacagtatctaggccgttggattatacaattgatgaatatgagccgttggatctgtatgatgtaagagtataagagtgtaaggatgagagatgagtaaaatgagttggtgaattatagggttgatgaaataactaaagttaggcaagagtacgttagtttgtgcctcgagcaagttggtttctttcctaacaacatctgccaaggatacatattccgacggacatactccacctatcgcttacacaacaattatggccactgctacagaaaggcctttggtgccggttgcaaccccatgtagttgtcggatttggtaaccggcacctcgcaagtggctcagttgtgaaaccaaataggtgctgacggtatagaaccggcatctataaggataaacgaaccaaaaaaatgccggctcgactcaaataaagccgacccaagcacgaatcaagccgagcacatcaagaacaacatcaggaacttcaagaacatgtcaagaacatcatgaacacagcacagaacacagaacacatctaagaacacactaacaacacaaaacactttgtgtcgcaagccgtcacatcgccctctgacacaggatcactgatatatgctttcttgcatatatgtcttaaccatcctggagggtcagtacactactagatacataatataaaacaattcctaatttgtcaacgtttcaaaatttgtcacttactattttgcatattatgcttgattcgtaaaactatttgtaattagttttgctgcaaaaacaatcccaatacgcatatcatatttttttttgctgcaatttggtctttaccaaagttatactttgtctaggagtatagtcttcacaattttttattgatattcatcaaataaaaagaatattttttaaagaacacagcaggggaagcccccactgtttaagagattttattaattaaataagaaaagaatacagaaaaagtgaaattacaacaacatgatccaactcttgactacatcttgatcactttcctttaacctaaacaacaagagcagaaagactccgttaagaagttgcttccaagagaagaaagaaggttgcttattatcaaaattaggaccatttctttgcgtccaaatattctaggctcctaaaaggaaatttctccataaaacatctgccttgataagaaactttagactgcctcatcatattatccataggagctatcctagatagtgccaaaagcattctagcagttcaccaaaaaaggacattgaaaaaatagatgcaaaagagtttcaatgcattgttaatgacataggattgtttatgatccgacataaactttgtattcaatctatccatgagtaaaagccaaccaaaaactttaaccttcaattggactttgtttttccataaccaaacaaagcgctgcggtggttgcaagcttcaaacctccccaactgaaagtccaactatgatgttcctgcgaaagatgaagatcactaaccatatctgacaaattcacttagtcattatatgcttgttgagataaaggcagatcaaaattatcttccagctgtgctgtcatagagttatggacataaatgtttctatggacaaaaagaaattccatgaaacatggaaaataaatctaatacaaacacttagacaatattgaatcggctagcttagcctgcaatggctctacatcagtgtcggcatttcttacgatcacagataaatccacaatcacacggtagtattcctaagggtatcatatttacattctgtaggtaaggcgatggtataaagatatgatttttcttttatatctcttaatcaatctataattaattcaccaaagcctaaacatgggctaggataataattgataaggtagtggacacacacaggagattcacctctataagaatatctagtagggaattagtatgaggaaactacgattcatatgtacttctatactaatcatgttcagtatacacttaacatatacatgcttacaatataggactcagtgccaggcacccaagtactaccgagagaccactccctgctggtctgtgttgacggtcgttagcgatcagtttcgaccgtcaatattactaaaatagaggagaactagttatgcttgcaatgcatatccatgttagaataataatattccactagtatttggttcaccaaccttttgcagagaataaccataaagtggaggagaatcgacatcgaatcagacgataaatcaatcggacgatgtcgagaactagacttatgtatgaatgggccaagaacttagaattgacataatggattgggccaaaattcacaagtctgcgaaagagagcaacagaggaggccacctgtcgattttgggccagagcggcccgacccatggttcgggcgaaccccctacaacgccattcgatctaggtttttcctggatggctgagatggctccccaatgacgggtggtgagtattaccgaccttttcaactgtcataaccgtcattctcaagctataaaaggagatctcatcctcacttcacctcacacacctcaagcaagagctctctcatattctttcaagttagtttagtgttctccagctagtggaataggaatagagtagaaatcggagtccggaagccttcggaagagttcgggtatggctctagtagctcttctcttctcttttgtaagctttgaacttttattagaatactcttctttatacatttatgatattgaaatactttccgagaatatgaatgccaactttacattatgttcatgttatactgattatactgcttagcctatctagaagatgctttggtacgggtatagtgtttgattatgcaattactctatgtcatgacgatgatattagagtagtatctggtagtttaggcgtggtgtctagattacatgatatcattatttggggttatatgctgcgaatgagaggtgggccgctgatggtgacagctcagtacgggtattcctctgcgcgtgtgttgacgtaaaaacacgaggcctgggagatctgcttaactccagtgcaggtccaaaactcgccttcggatatgctagcgtgccagttgatttgatcctgcaatcaagaagaaacgaagacaaagaaaccgtggttaaatccataaacaatagccaatcggctgggtgctgatgacatatcatttatctttgagccgatgtcatatatgcatcgatcggcaatcataaataagtaagaaagaactaagtctactcgatcggctgtagatattaacaatatataatcctcatgtcgatatatacttaaaccaagtgattgggatagatcggtcgccatgccgagacagtataaatcacttagatcgaaatatatattaacaacaagactatatacgttcatagcatagccgatcagatagatctagcatgtatcggctaatactccgataccactctatattaagatattaaagcaagtagaatatactaaacaaaagcacaatatacttaaatgcgacaagatcttaatataatgggcagatttaacatgtcaatcaagcatatggaataactatagttaaatcaggtaagatcggctgaaaccccgatgctaccctaatcgacaaccagaaggtaggctaaaggttgaaattctaagcacgacttaatagatcaaactcaactgatgcagcattaagtatgaaaagaagaacaatatctagacaatcaagccgctggatgtgtcatagagtggtagatatcctatataatctaagccaacatcgttattttacctaatcggctgccctctattagcagatgttagccgattatagattagatgacgatattgtcgaagattatgtaagatatgtgataactcgacgaattacataaacaagattagagtatcataaagatggaagcactaatctcgagaacgcaagccgccataacaagttttacctcttgttgaagatcgaaaccgatacagctcaacccgaaagcaataactcgtcaaaacaaaacgaaaataaaaagggtggcgatgcgccgagattgtattgaacgtgtgtttatttgattacatggggcttgggatctatttatacccgagaattacaaaacatgtccatatcggacacgactcttatctctaacaaactctaagataccataagtctttgcggcagacttttgctcaaacatatctctaaggaaattacataagatatcgtaattaatagatacaattgccttctcaggactctatccatgcatggaaatcatcttgaagcatatcaactcgacccgctgacgtataccgagtcgtattgtcggaattggccatatcggcttacctagtctgactcgaactcagtcgatcctgatcgtagccgatttggactcagtcgattcttactctgtttctgaaacgatcttcgtctttgattccactttgatctaatcttcatcttcgatactgatattaccaaatttggttgttaacagcgtgtatattatcctaagttaatttcctggggagggtactcctccgtatttagccccggttgtatggtcatgacgggctgtcgtaatgaactcgatagtcaggggtggcttctcaaagtaccaggagggcattagatagagggtattagctagtatatcagataactaggatgtatgtatgctatgtatactagaagtataggaatagattctctttctattttctttccacttagcttagtgttgacgaaaaaattgaacacactggcctaggaaatctgcttaactcctgtgcaggtccaaaggttggtgagatgcgggcgtgccagtcagtttgatcctgcaactgacaagatatgtaagcagcaggtaaaacagccgaccggctgacaagccgatggagtagttccagccaatgccgataccagccgatagccgatgccagccgatagcgatagggttctgagctatcggctttatgtccaatgtagatgatgatataaaggcaatcggctgatgataatcgatataattaaacaatataatccagtagaaaccagtcagctaataatgatatgatagaataagcactgatctgaaggttaaagcatacatcggctgtaggtctgatgtcataaaatccacaagattagattaaacgatgaaacctttgttgcgatcggctaaatccaatatgtatacaatccttttaagccgaagcaacgtccagataactcatcggctgaaaccccgatgaaacccttattagcaatcaagaagcatgctagatattatggttctaagcatgacttagtagatcaaacttaactgatgcagtactaagtatgaaaagaaacataatatctagacaatcaagccgttgactgagttttcggggtggtagatgtctaagctaatctaatctagcaacacgatttagctgataccggcataaaccctaaaacgagaagcagccgatagagctaaattgatatgctaagactagattaacagagacatatgataaataggtaggcaaatatatcatccaaactagagcaatccaacaggtcgaatgtaccgatgcagccttaaacgacaccaacgtagacgatacaattgcctggaccggcggaacattggacttaccccttcgccggagatcgaacaccgatgcagccctgcatcaggtgccaagtcccgccggatgataatataaaatagaaaaggtaaaaggtggcgatacgccgaattgtattgatcgtagccatagattacaatgaccccgggtgtacatatttatacccatgggtagatactagtccttgtaggacaagaaagaaactttcctaaagataaaaggaaaacacaaagtccttatcggacactaaacacactataaaagaaaactaacaaactattcttaattaatagatacacttgccatgccgcattctctttgaactcggtctcttctggataagcttcctttagtatatcaatttccttaaccgaatatagcaagaatccaacaactgacgacttgataactctcatcggctaatctcaggacttcgaagctggtgctgactctaagctgatgaatactccgggcttaccaaatttcactgttaacacttagatattttagtatgagaatgagtagcttcatgcttgtgtgtcactctacccttggattatcttaacccctgcttagactatggttattgcaagtaacatataaattattagtcaggttctctctactatgatctttccacgggattaaataaatacgataaccttggaatactctcgggtgaaatgctacaatggtatatccgtgcgcttgcgaatgaactctgtaaccataatataccaggagtatttctgcgccattgctgggaattatatttctagtaatgtcgttaagaaataccaaaagtctgccagcgtggttatagcatttaggtactcttacgccatacccgaacatggaggaatacaaaggacggacatggctatcatcacctgccacctacctcactttccgtgggcacacccacatccaacggtatttatctagcctaagcaccatgcctatgctactaaggccctgtttctttcagcttgggattattataatccagattattgggagtaagctgaaagaaatagacaacttattaaagtagcttattataatctggagctcagcttattataatctgataagctcattaaggtgagctttttctagattattgggtgaaaaattacccaccatgccaccccactccctctttagacttacaaacccaataatctaagctctaataatctaggaaagaaacaactaaccgcttattctactataatttataacaatcaagcttatagtaatctgactcaataatctagattataataatcccaagctgaaagaaacagggccgaaataatatcactaactcccctaggtctctcaccctatgaatgaacaagttagagctagatcaacctataaaggtcattggactattaccgtagcatgagactagcctaggatgatgcaaatatacgaagtatctactactcagaacatatattcaataaagaaatatataaaccatgagcataaataaataaagaagataattctattaattcaactatagtctttcccgaaccaccgccgcttccactacaggaaaggggagggagttggaagagaaggagaggggaaagggaggaatggtggtggcactgtggcggccctcctcgctgccgtccgcctcctatgctgccagccgccatagacgcggcaaccgacactcgtgtcccgcctccgcaatgccctccagccgccacccgtcctacccgttgtgcccgccgcacccccagcggcagagaaaagaaaagagagagaggggtgaggtaggagatatgacaagtggtcccatagttttttattatttctttttctaattagattgccacgttggtgtcacgtgtatgccacgtaagatcaaaacagctacggattgagccaagggggtaatttgtccggttttaattgtttagagtgtcaaatgtctggttttgtggtttaaggggggtaatttatactgtcgagatagttcatgggggtaattcgtattttttccaattataaacttaatcaaacttaagtttgacttgtaaaaaaacaaaatatcttgtaccccctccgtttctaaatatttgacgctgttgacttttttaaacatgtttgatcattcgtcttattaaaaaattaagtaattattatatttttttcctatcatttgattcattgttaaatatattttcatgtatacatatagttttacatatatcaaaaatttttaaataagacgaaaggtcaaacatgtgcttaaaaagtcaacggtgtcaaatatttagaaacggagggagtatatatgcaacggatatatgtacttgccaggtcgcggctactcatattcccaagttcccaactgggtcaaaacatatacgcgtgcgtcattggccgttaaggttcctacgtcacatcctgatctatcacatgtgtgtgcttaagtagagaaccccacgttgtagcgtgtgctataaattgatgggcgagttgtattcgaacgtgttctgcaacagctgctcagaagaatataagaaatcactacaaaatgccggaggagcgcaacaaggacgacgcaggaaaccccgagatgcatgtcaattttgtcctaaaatagtactcactctatctcaaaatataagcatttttagaccctgacacgatcttcgagatgctactttgaccaacaatattaatgaaactgagatgttttaaataaaaagtgttgcatattatgatagtttgtttaatgatatatttaggaatgtaaatatttacatgtttgatcttttttatttttttttaattaatgattaaagttaaaaatatttgacttatcactatattaaaaatgtttatattttaggacggatagagtattaataaggaaatgtacgtagtatctcagctcgaccgctcaaactaaaaccgattataattactacatatggggttattaatattgtccaattcaacaagcataccaagctagataatactgtcgatcaggaaaggccttgtttgatctgggaacaaattaattaatcagatctttcgagaaaagataattaattaggtacagttaacgacagtgatcggcaatggcggcacgaaggcgatcgtcatcgacgtcgaaccgggtgatgattcatcacccaccagcaatggtagccctgctgccccggaggcggaaggccaaaggtattcgtcgcaagaagaacgcggtgatggaggtggttccagctgcggcttccatgtcgtagatttaaccagcaatatggtggtgcccgacgacacgacgactgaagatcaacctcgccccgacgccggaacgatcaacggcgacgactgtccgtgccagatcagaagggtccatggccgtgtccgcgatatcgaccccggcgcgtacgaccccatggtggtgtccctcggcccctaccacgccgaccgcaaagacctccggccaatgcagaaggagaaatggcgctgcgtagagtacctctgcgacctcacaggcaccccgagctacgtcgattacttgccggtgatggatcgcgtctgtcccgacgcgaagacttactacttggatgaaaccggccatggccggagcagaggaggaaacggcgccggcggcctcgccctcgccgtcgagcatgccaacttcctccatatgctgctgcgagacgccgcgttcctgctcgtgtccatcggagcgctggacaagctgaagaaagccgacgagggcggcgccgaacagcggagccaggaccggtggaaggacgtcgccatcgcccacgacatgcttctgctcgagaaccaagtccccttcgtcgtcgtcgaggacctctaccgtgccgccatcgacaccgcaggccgccgtggctgcgacgttccctccctctcaaccgtcatggggaaattcatccggggcgtgatacaagaggcggaagaacaagatctaccactgcctcatcatctggatggcaagactccgcaccatcttctgcatctgtgccacacgctactcgagccgacccccaaagaacctgcgtccccggtcccggacaacgtcgccgcccgggtgaagcggcggtggcatcgcgcggcgcagtaccatgtcaacggcgttgggttgaagaagaggctcttcagcggcggggtagatcacagccaccacagcctgctcgacgtcaagttcaaaggcggcgcgctggagatccccgtcctccacgtctacgacaacacctgcagcctgctccgcaacctgatcgccatggagcaggcgagctccgactccggcgtcggccactacgtcacggcgtactgcatcttcctctcccggctcatgtgcaccgccgaggacgtcacgctgctcgccaagaagggcatcgtcgtgcaccacctgggcagcgacgaggtggtggccggcctcttcgccgacctgtgcaagaacgtcgtgttcaacgaggacgacgacgagtgcaactaccacagggcggcgtgcaaggcggcggacgagcggtaccagaaacgtgtctggaactggatgacgttgctcaagcacaagcacttcagtaacccgtggctggcgatggcgactgtcgccgccgttcttgtcaccatctgcacggtggtgcaaaccttcttcactgtattcccaaggaagtaagaactacgaacaagtactacgatgggattaagaattatattgtattcactctatcctttttattttcatatattcattctatctttaacaacatcgttgtttagaattttatgaagttagttcggacatcctcgattaggcctgatatctattatatctataaagtaataaaaaaaaggagtctccacgttcgctctcacacgttcgctctcacggcgtagaaattcttacattaataaaaaaaaagaaaaaagaaaaatagaactagattaggattaggatttgttaaaaactgaagaaaggaaaaaaatgcatactaagaaacttcaatcggacaacagtcaaaaactaaaaaaaggaaaaccgaatcatatcatatatactctggaaatggacaatgttttgggaatccgcatgttcacactcactacactggccaaggtcacctgtgacgggcccaaaccctcatctttgacggcttcgcgcatggtcagtgatcagtggtcactggtgagtccagtcacctttgacgggtagccggccgtcacaggtgacacccacctctgacgggcaagttactaaaaggccgttagaggtgttggtctccgcttgtctagggcgagttggcacccgtcacaggtgactcatctctgacggccctttaaataaaggccgtcagatgtgatggtctccgtagttagaagctgtcacaggcgatctacctgtgacggccccaaaagtaaaggcccgtcacaggtaggtcacctctgatgggcctttatttgctagtccgtcaaaggtgatgttacctttgacggatttttgttccgacccgttactgatgagttaattccagaaaaaaataaatgctaaatattggctagcctcaggatttgctagccatgccctctgaaacacagatacatcacagataaattccagtcaaccccccccccccaatataacatcacagatccatctcaaacatcacagatccccaacaacacagatccatatcaaaaattgacatcattcacatatgcagttcaaatggcacaattttgcacagcaaattcacaccccttgaaagccacaattttggtcgttgctcatataaccgcatatatacttaccaaatggattaaagccataatgtcctcgacctccacaacctgtcaataaggaaaaaaaaaggagaaaacagataaatagtacaacgtaaatcgtagttgatcaaatttgatgagaatttagtaaactaccataaatattgcacatatgaaagtaaattacattgcacttcataaaaacatatttttttacatcacaagaaattatgaaaacatcttttttacatcacaataaattatctagccaagttcatgagtctatctgacgtgaaaacgtcctttcttattcattatttctgccagaatgaagacacacacttcgcctctgatagcggggggttgatgggtgagatcttgaggccagctctacctttctgtttaataaataagatgttagcacgttttgaatagcaatgttggtattgaaatgagcttattcgccattagcaacaacctcagggtcgaaatctttcacctctcttagaaatgttgacatgttgtggcacacatggaaaccacattggtctccgatctgttgtgcgcatgcgaacttggtgtcatggtaaagttcgtccttgccctccttgtgcctaccacccttttccacatatgggccccaagccatatttaaggccttggtgatttcagtgaaatcataatctttggacttattggagttaaggtaggtaacgctactccacttaggtacgatgactaggagaatccaatgtcgcttgcgcagtggttatgtagcgttagtactaagaaccttaacttcaaaaataatatacacgaaggtaattgtcctcttactcttggttatgtgcgcacatgatgtactccttgtcttgatgggcccataaacaccggttgacatagtcaaccacctcagtgaagctctgtcgtaaattaacctcgttcaccatggatggatcaaggaacccaacctgattactaaggcgacgactctcgatccaatacaaccttaaaacatttacgtattagaactaatttaattaggagatatagtccaatcatatcacaagcatagaaggtatgcacttacaaggagtagcattttagaagaccagtgtccaacttccggatcctgaaaaggtcgaagaggtcatcaaagcctatagttatataggcaggcgatgataggaacggctggtggtcgtgatgtccaactatggatgactccctcattttccgcttagcattgcttagctccatgaattgcttatgtagctctcggcaagcaatacccatcacggctaatacattgtcctccaccaatggcatgcctagctcaaattgggctggcgccctcccgaccttccccgctttgctcaccggcatcgacatcgtagccttgcccctttttggctccggcaccaacttccccttgccgcgttcacgcttctggcctttgacaagtggtggggagctatcggcctttcttgtggtctttattggagccaagctttgagctatatctgccaagtccatatcagctccaccaagagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgaccaaagtcatgatttcatcattgggggcacgggcagcggatagcctgaccaggtgtcttttactgtatcgatggacaccttggcatacccagctagcaggtctgcgccatggaccttgtctgtaaccgagggcttgaaagccatgccctcagcgacttcgggagcgaaagttgggtggaccctcgccagtaggacacactgtgctacgccctgcatatgtgaaagtctgaatttaatattggaacgtgtaaaggtttttttattagatatggattggataacatcaattacctctatgtggtccactgcagctagtggtgcgaccgggagaccaggggccggcacctctgtggatgcacaactactcctatgctgtgacggactcgcgtcgtgttgtgcacaaggagttggatgcacagcaggtgttgtgtctcggggtatattcatgtcggcgaggaccttgttaaccctttcttccaccctagcgttcatgctagcttctagttcttgaatgacctcaaccttaagttcggccttcaaacgagcgtccctctctttcttggagactttccgtttcctgtattgggagctgtactgcgagagtccatgcttcctgtcatgaccgaaaataacccaacgggcgttccttacgtgcgtgtattattccttgtcccaggaggcaaggtaaaccaaaaattgatacatttcagagtttatcaagcggaagcgtaaataaataatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggggttataatataaagggttagggtttgcagtaaacaccattaaaagacacttagttgctcaaagctattttgtaaacacgattctagagctatacaagattattaatgaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatatggacggaagatgtgacatagtttccaacccatcctagccatagacaagagtaccgacccaaccccacctacggccgggacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagttgctactattaaaaccatgcaccccgaacccagcctaaaaccattttgaggattttgaatagagggggaggtgtgaatccaattccacaataatccatccatttcatagtgtccaggtgatgagaatattctcaaagtctagagttgtaaaaccacctaatgttgcctaattaaccagcgaagcatctacctaaattcatactagtggtaccatgagtagagtgtccactagttggggttttgtttaatctagggtgaacaaggtaataatatcaataacaataataataaggtcataacaaaggtaaataggcatggctagataaaacagtgataacgcgggaatttaagtaaagcgataatgcaataatttaaatcaaaataattttataaaatgggatccaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaatggtccaattccgagttcaaatggccaagttatggccatttgaagtttatatgctctttaaatggatatttgcgaatttcttcatttaaatttttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacacgtcagccgcacctgagggcgcgggcggctgacggccgggctccacgtggcagccactcggcgcgcccgagggcggccacgccggcacggtcggcgggaggcggcgcgcccgcgccccgatggtcaccggcggcggccatagacgcggcggagcggcggccgagagaggggagggaagggggaaaggaggcgacggtccacggctcaccccggggtgacggcggcgacggaggaggcggccggagcggagggaggcggtggcgcggctcaggtcgacggggacagcagcgctcaatcggtcggcgaccaaaacggagaggtggacgaggtcggcgaggatgcggcgaagccgaaggaggcggcgccgaggcgggagacggtcccggcgagcgaagaaagccggccggaggtcgtcgccgacggaggagagagagagcgacagcgcgagctcgattccggcgaggaggaagggcggcgagaggcggaaacggacggaggaggtgcggggagggtttaaatagagttggaagggggaaagagcggccggaggggaaggaaaccggcgcgggaggtcggccaccatcaatggcgccggtgagatttgcgggggcaaatccgcccgtttgaacgcaagagagagaggggaaaatagggggaaagggagaggggatcacggggagtgattccccccactttattgcatgcatggacggcggaagcggcggtattctcggcgccgccggcgctaggcgcggggaaggccgggatcggcgggaggaaggggatgacgggtgggccccacccgtcagcgagggtggcgggcgggcctgcccgtcagcggcgcgcgcgcgggtagggaggccgaatgggccgcgggggagaggagagagagaggggggagagatgggccgggccggcccaagggagggaagggggacttttagggtttttctttttataaaactttttcaactttgtttatttcttaataattattatttgtgctctgagaattccattaaaatttatttacacattttaggcttttaggaaatatacaaaaatcctctaagccttgtttgacttttactttgcacattttaatttttggaggctttcacaaagattttaattattctaggcataatttaaaggatatattttagagtcgttttgggacgtgacaaacctacccccttaaacggaatctcgacctcgagattcggaagaactggcgaagagatcgggatgggctgccttcagctcgtcttcacgttcccaagtagcctcttccgcagcgtggttgctccattggaccttgcaaaaacggattacccggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttctccgcgtcgagcaatgatacggaaaggacccacgaaccgaggggcgatcttccctttcgtctgaaacctatgtacgccccgcaatggcgtgacccgaaggtacacaaaatcgtccactgcgaattccaggttacggcgtcagttatctgcataactcttctgccgggactgtgccacctttagattatcccgaatggttctgaccttcgcttcagcttctctcaggatatcagtcccgaacatttggctttccccaacttggtccatacaacgcttcatagggtgtcatttgtatgctggcttggtagctgttattgtaggagaactcggtataggggagactcttatcccaggtcttcccaaaatctagaacacaagcacggagcatatcttctaggatctgatttagatgctcggtctgtccatctgtctgcgggtgatacgcggtgctgaaatttaatcgggtacccaactcttcttggagcttcttccaaaagtgagaggcgaattggcttcccctatcagatacaattttcttaggaacgccatggagactcacaatcctagcgaagtagagttcggctagtttgttccctccataggtggtcttcacaggaataaaccgagctaccttggttagtcggtccacaactacccatatagaatcatatcagccttgggtttttggaagtccggtgatgaaatccatcccaatttcatcccatttccattctggtacttggagaggttggagaagtccggccggtcgttggtgctctgccttgacacactggcacacatcacaaagggccacgaactctgcaatttcccgcttcatactaacccaccagtatttctctttcaagtctaagtacatcttcgtactgccagggtggatggaataaggactttcgtgagcttcctgaagtatcaactgtttaagttctctgtcgtctggaacgcatacccgatttctgttccatagggttccgtgttcatcctctgtgaaaccaatggctttaccctgtttcatattcttgaggagtccacgcatatccggatcatttttctgagcctcgcggatttgatcgagcaaggtaggcttggcttttagcgtagccaagaatccacgaccaactatgcttaggttcagggcttccatctgttgattaagttcacgcggaatgccacggacgccaagagtgttgcaatggctttttcgactttgatggtggcggagaggtcgaggtcgaggcggtggagaggagggcggtggatctggatcgagagagtgaatgagtgagagtgggtgccggatctggatcgatctagaagatgtccaaccctaggtcaaccctagtcaaactcacctgtgacgggcgccaactatggggccgtcacaggtgtcctcacctgtgatgggcgccaactgtggagccgtcacaggtgaggccacctatgacgggcccaatactctggcccgtcacaggtgatgtcacctgtgacggccccacagttagagcccgtcacaggtgagtttgcctacaacaattttattttattttatttcacttagttcttttattttccttaacgtatttccatatacactatatatttttgttatacttaattattttatttcactaacagtagtaattgcacttcattattttactatttgtattattttatttcaaatggttagactaatttaattattttatttcacttctagtgggtgcttcacttaattattttatttgactatttcatcagcaatatactattgatcattgcgaacatattagagtcatccagataacagagacaatattgcgaacatattagagacataacctacgtacataaattacaaaaataatccttcctcatggtcgacgcgtgcatattgaacgtcatcttcttcttcctcctcttctagaggtatttcttgacctatgccatggacgtgctggttgtaatcatcctcgtctgcaatattgtccaatccaacaattctccttttcccttcacgaataacatgtagtttcttgttacacgggtcaactatgtagaacacttgaacaacttgtttggcgagaacgaacggttcatccttgtacgcgttgttagccaagttgacagtggtgaaaccttcgttgtcaacttttacattgcgaagatagacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgttgtcttgctttaccatgcgaaaggtgtatccatttatgttatatcctttccaggtggtggcactccattcaggaccctgtgacaaccactgaagtgtttcattagacaagttctgcaacctggcaattcggttcttcagccactcgttgaaagaagacatgtgcttatttttgacccaactctctgatcggcctgggttctcctgtcggagaactgcaaggtgttcgtcaacgtacggcaccacatcagtcatatactgcagtaccgtgaaatgagctttatcgtacaccttccgatccaacctaacagtctttcttccaacagtaccaacatcgtcaagcctcccttcatgatgagatcgtggtaatccaattgaagaagtttctgacatgtagtccacacaaaaatcgatgacctcttcggtggtgtaactctcgatgatactcccctcggggtgtgaacggttccgtacataacccttaaggatccccagatacctttcgcaaggatacatctgcgtcatcaatgctggaccacagcactttgtttgcctcacaaggtgcacgggaagatgttccattatgtcaaagaaagttggaggaaagtacatctcaagatgacatagagttctcacaagttctgcctgtagttcatctagtccctcgggatcaatgatcttctggccgattgcatggaagaaggaacacaaccgctggatcgtgtgtcgcaccttaggaggcaaaatattccttagtgcaatgggcaacagctatgtgataagaacgtggcaatcatgcgacttcattcctaccaacttaagatcttgcagtgaaacgagcctactaattcttgatgagtaaccagatggaacctttataccactcaaacatgttagcaaatcaatcttctcttctttcgagagagtgtagcaggctagaggaaggtaaaccctgccggatttcgtggttatgggatgtagttccgagcgaacacccatttcttcaagatctcgtcgggcgttgagaccatcctttgtagtacctgggttaagcagtaatcccattaaactctcacatacattcttctcgacatgcaccaaatctatgcagtggcgaacttcaaaatccttcctgtatggtagtctccaaaatattgacttctttttccacatgctcctctcttttgtcttttgtttttccacatgctcctctgttttttccttcgatgtgctcttctcttttgtctttccaactttcttcttttttccaaactcgttggttattcccatcaccaagttgtgcacctctgtccctgttagctctgccgggggtccggctgtatctctgtgtccattgaaattctttttcatattcctatacgggtgataccttgggagaaatctcctgtgacccatgtagaccgtcttgtgtgaatgcttcaaccatttgcttcttgtttccttcatacactccgaacacgcccatttccctttcatagtttggccagaaaggttgccaagggtcggataatcattgatggtacaaaacagcatcgcatggaggttgaaatactcttgtgcatatgcgtcccatgtccgtgtgccctcattccatagcctttcgaagtcatcgattatcggttcaaggaacacatcgatattgttgccaggttgtctcgatccttgaatgagcatggcaagcataatatactttcttttgaagcacaaccagggaggaaggttatagttaacaagcagaactggccatgcactgtgacgactactcaaatcaccaaatggattaatgccgtccgtacacattgcaaaacgcatgtttcttgggtcatttgagaattcctggtaaatcctatcgattgtcctccactgtactgaatctgctgggtgcctcagcatactatcgactttccgttcttcggcatgccagcgcactagcttagcttgttccttattcacaaacattctcttcatgcgctccacaattaagagataccacaccacctttgctgggcctcccctctttgacttacttccttcaccttcactctttgctcgtttgtatcttgatgccccacagacagggcagacatccaagtcagcatattccttgtaatacaaaatgcagtcgttcggacatgcatgaattcttctgacctccaggcccaacggacataatacttgcttcgcttcatatgtcgtctgcggtaaattgttcccctctggcaacaggtcttttaacagctcaagaagttctgtaaaactcttgtccgaccagccattactagccttaagcttcatgggttccaacacgcatgataacttgctgtgcttcgacttgcatccatcatacaagggcatctgacaatcttccaccaacttactaaactactcaaaatctctgtcgttgtcctctgcatcttcaatgtcatgcaacattgtagatagacattgagtgtccaaatctatggtatctccacctaaaggagaaggtacgaacatgccttctcgagctgcggcgccggcggtgttctctacatcctgatccaacacttcttccgctgcgacatcaggcgcctcttgctctccatgcttggtccaacaggtatatttcttcatgaatccattcattatcaaatgagcatgcatttcatcgctatcttcgatcatctgttcattcttacagtccctacatggacacaacatgtgcatgctcatcctactttttctatcattatccgcaaatgtgacaaattcagtgaccccctctctatactcggtagacgaacgatgcgcatagtacatccatctacgatccatctgaaatcaacaacatacgaagaaaaatatatgatgatcgatatattgagaaggaatggagaataatgtgttttttaccttgaattttagaaaaaaatcgcccccttgccctcccaaccgatttgtgaacagtgaactggtcgggatggaaagcggttggcggtttgggggggtatttatagacccaacacacctcaaacaggttagattaaaaaagcccgtcaaaggtgttggtcatacctttgacgggcttcaattgagttgcccgtcaaaggtattgacctacctgtgacgggctgtaaaaaaaatccgtcacaggtggcggaccaccacctgtgacggctcatagtgccacggcccgtcacaggtgaggggataccagtgacgggttgggaggaaaacccgtcacttcctcacctgtgacggcttttccttctggcccatcacaggtgatggatacctgtgacaggccacggccggatgccccaccgatgacggcaaacctagcaacccgtcaaaggtgacggtcatctgtgaccaattcataggcccgtcactggtatgctgtcacagatgcagggttctggcgtagtgactgcttttagaaacattgaaagacaaaccaatcctaatcaaactctgccgattccgaattgtatcgttcgcactcgcgcgctagaaattctcacaataatcgaaagaaaatataaggaaatatagaaaagatctagaccataaaacatattttgcttcagattatacgttgtagattgctttcgtaggatacaggaaacggacaaggtttctttcgatttagaaaacgtattggacactaattttgaaaaccatgtgagacactaaggtggtgtttagatccaaggacttaactttattccctgtatttagacactaatttagagtattaaatatagactacttaccgaactaattatatataaatgaaagctaattcgcaagacaaattttttaaacctaattaatctataattagagaatgtttactgtagcatcacatagactaatcatggattaattaggctcaatagattcgtttcgcgaattagtccaagattatggatgggttttattaatagtataggtttaatatttataattagtgtccaaacatccgatgtgataggaactttaaagttttagccccatctaaacaggatcttaaaagacagactaaaaaaccatcatcgtcagagtcatgcaatctaaattgtacacaaattacatgccatggtaatatataaatagtacgctagaaatcttctctccacaatccaccgcaacaaaaagaaaggaaaaaaaagattgagtacaaaacagtgacgaaactctctaccagccaaaaagaaatcaaaagggatccgacttttagcgatgaaaaaaattgtgagatatttcaaggaaaatagcaactaactgatgctctaaaataccatagagccgaaacgatatcaaaacaagaaggcaaactcaatctattatcttaataaagaaatagaaataaaaaaaggagccaccactctcatagactaaaaatttccacatgaattagagagaaataaaaattctaatatatgaaaaaagagcctagatggaaagtataatagaaaaagaagccaccacgtttgctcttacggcctataaatttccacattaatcggagaaaaagaaaaggtagagtccatataggaatacaatttaaaaacagctgaaattcggaattaaaaataaggaatattgaaagagtagactagagtccataaaagcataaaatttagaattaattaaaattcggaattaaaaaaaaaggaaaactaaaattagaagttagagtccatatagaaatacaatttagaattaacgaaaattcaaaataaaaaaagtaagattaatgggagaagagtcatagtccatatatgaatacaatttataaataactgaaattcgaaattaacaaataaagaatactgggaaaaaaaagtctagcgtccatataggaataaaatttagaaataactaaaattaaaaaaaagaaatattgaaaaaagaagtctacagaatacagtttaccaacaattgaaattcaaaatcaaaaaaaataagaaatattgaaagaagagtttagagttcatatagaaatacaatttataaataactaaaatttagagttaagaaaaattaatattggaagagtagtctagaatctatataggaatagaatttatgaacaaaggaaattcaaaagtagagtttagataggaatacaacttaaaaatagcttaaattcggaattaaaaataacgaatattgaaagagtagactagagtccatacaagcatacaatttagagttaattaaaatttggaattaaaaaataggaaaactaaaattataagttagagtccatatagaaatacaatttagaattaactaaaattcaataaaaaaagtaagattgggagaagagtcatagtccatatatgaatacaatttataaataactgaaattcgaaattaacaaataaggaacacttgggaaaaaaagtctagcatccatataggaatacaatttagaaataactaaaattaaaaaaaagaaatattgaaaaaagaagtctagagtcaatatagaaatacagtttagcgataattgaaattcaaaaataaaaaaataaaaaatattgaaagaagagtttagagttcatattgaaatacaatttataaataacttaaatttagagttaagaaaaaatgaagattggaagagtagtctagaatccatataggaatagaatttctgaacaaaggaaattcaaaatttaaaaataaggaatattaaaagatgattcttaagtccatatagaaatataatttataaataactatcatgtatatacaatacaataaaaatatcacacatttgttagtccaaccaagaatttaaaattatgttgtcattttaatatattttaataataaaatgtgaaaatatttaaactattgtatgagaaaataaatctaacaatgctagccgcgcaatctgcgtgggccgccatgctagtttgtctaatattgttggtttagattgatcaatgagagaattccttatatgccactcaaaatatagcccattcctttacctgccactccaatttgacactttccttctatgccacaagctcaaatttgtccaccctcctgtgccactaatgtcactccaccagctgttgacttatttcgaacccctccaataggtaaccacgtcaagccattagaagcccatgtagttattgcaaatcgctcccccatatcggttcaagggccgcatgcagcctcttaagagccccacttgtaaaagtaggagatatttttccaagcaggcctcttacgcagccacatgcgaaagtcagattttcacaggcacctccttaagaggcccgcttgcgaaaatcactaggtactaaatattaaaaaaatcttctccgctcctcctccacctcccctctctttctctctcactctcactctcttattcatttctccccctctctgtctctctcactcattctccctcttgtgtggcgctaggctagagcggctgacagtggacaagagcggttggcagtgagctggagcggcaagcgggtcggcgatcggtggcaaggagctcggcgatgaatccgatgtggaggacgacgggagcagtggtggcgggctcgggtagctggagcgacctcgggcagccgcatagatctggtgctggctgcccttccctgcacgggtccggtggtggggacccttggtagcaacgacgccggacaacagcgaggatagcagatctgacgggcggtggatccgacgatgacttattgactgctacgaaggtctaccacaagcaccacgatggtgatgaggaggtcaacaaggcggcggtggctggcgtggggacaaagaggtgcgggtccatgatgaggcagctgtcacaccctgaagttctcctcccaagcctaaaattcaatttataaatgaccctaagaaaatgccggtgcaaatcaagagaaaaccgtaagaaagtaatacaaataataatcgaatatggcatgtggaatttttcttgagttctacatgtcaaaattcactaacaggatttttagtggaattttcaaagccctagaaataattttaaccaattaaaattgagcaagcaatattttaattccagggaaaatccttttcttcctttttctttttccccttttcttttcgagtgggccgccagcccattctccttcctcccctcccctccgctgggccggccgaaggccaaggcccagctaggccggccgcctccctccttccacccgggacgccgacaggtgggccccacctatcaggcccgtcttctacctcgcgcccgcaaccgccgacgggcccacacctacggcttctccgggccacgtcggcacgcccgcgcatgcgccgcaccttccgcgcccacttccctctttctctcgtccgcccccgcgcccgagatggccgggattcgattttcgaatcccgcctctctctcctctcccactccccacgttggccggcggaatctcgcccctaccggccacgtccgggactcccctcccctatttaagcttcctcgtcgccccctctcgctttttccctatctcgccgaactccctcgtgctccccatcgctcccgcgccatgcaaccacccgcccgccccgcttccgttactctggtcgctgctagccgccgctagggtcgccgccgcaccgcgccgtcgccgccgtcgggttcgcgaggccaaactccacctcgtccgccccttccccgtcgggattcgttgccggaattcgcatcccctcacgctccggtgagttctacctctaccgccgccttcggccatggatgccggctgccgtggttcatctccctctctctaatctctctctcctccttccttagggcaccccgaagcccgtccaccggttgccgtcgtcctcccgtggcttgccgtcaccgttcgccatcgtcttcctccgcgccggccaccctcggtgaggcgtcctctcccctctactcccctccctctccctcctagagccgcgccgccacttcaagtcatgcgtcgtcgccttcggccgccgccgccgcctcccgtgctgccgatcgccgtcgccgtcagccgcgtgccatcgccgctagccctgaccggccggccggctttgatgccgagccgagcccggcggcctccactatcgccaccgcccaatcggctcggggccgatctgggccgttggtcccgtggaccggcggtggaccacccgcgtggtcccggtccacggtgcaccggcccccctttgagctgctgaccagtgggacccgcctgtcggcgccgccccccccccccctcccttgatgacgtcagccctgggaattattgcgcaataagttatttaaggactttttgttatcgtaataaacacagtgaatcttctaaaattcataactaattcatccgagctccgtttaagcccattcaagtctcagtaaatcaaaaaaaatgtgtagaatccattaaaaatggttttgttctctgtttcagtagtcttatagtctgtttgcaatgtttgccttgtatgttgctagattccggttcttccgacgctccggtgtacttcgaaatagtcgccgaggttcctccagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccttgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttggtgttggttagttaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgacgcatccaggcaagggtgggcatgatggagtttggatgggccctgcgacggcctatgcggcttccggattcacctaggcatgagaggggattgtccgtcgcccgctggggacgggggtgaaacctgaggtatggtgtgcttggctagagggggttatgcaaagggtcctgtcacggcctctttccggtatgtcgtggtggcatatcggcgcacggaaacgtgtcgtggggctgtgtcttgtgggtacagttgtacacctctgatcagagtaaaactattcgaatagccgtgcccgcggttatgggagatcaaccagattcaccgtgattagtctcaccctagtttagtctaatgaaattggatagtataggtggatggttgggtctgttgcaacgtggtatagcgttggacagtggatgattaatattgattaattattacaactgtttaattctttcaacttctgtttataaatgcccgctttatgcaaatgaaccactctagctctcctttgataattccctgcatcatgcccctattccggtatgacttgctgagtacagtgggtagtactcagtcttgctctattttccccaaccccagagtacgagtatgtgtcagatagtggtttctctgaggagtaggcttcgtccgtgccgtcgaggatgcctgtggagtggtgttcccgctgcagttcaagtcaaggcttagctcctgttatctttcgttttttccgctgcatttatgtaaggcttttatgatgtttgtaagacgtggatctgaatgtcaatattgtcgtttgtgtaccccggccagtcctggacggggattttaatgcacattctgcttggaattctattcgggaatttctgggcatgacagcaacggtggcagcgatgacgactttagggttttggccggtggcgggcatgggtttggccggtggtgagctatggttcggctaatttgttgttttgtgatttttatttttttctccaaaattattttcacattccattgatataggtgaggcatgcgaaaataggattttttttcacatgtgattgcaatggccacatgcaaaaatctcgattttcgtataaacctgggggcaggtagaccacccaccgcatgcgaaaatagattttcgccgcatgaaaaaaatcgaatatgtagtagtctaaggcaacacggcgacgtgtggcggcaggacgaacatgttggttagactccttgctgttggactatattattggttagggttgttgctgttattgggctgggctagatgatgctatccaggtaatatccagataatttattgggtaatatctatattctttataggatattcgtcggatactgccatcccgaacccgatctcacatccaccaaaaagtacccgaattcggttcctatatctgtacaaagatccagataccctgattttttgatccaaaattgtcccaaaataatacgagtggcgggcagacggaaatatttgtcccgttttcatccttattactagagaggagcggcatcttcgctccactcttgcacttctgaaatttacactacacgggaggagtgtcagctccgctccagcctttaagtaggagttgtatcaaacgggccttatatatcatcactactgcagaaaagctggtgtcagttttaaagggtttataggtgctggttttggtgccgacaccaattatccggcacccaagtcatcgctgccggtactataggtgccggttcaaatttagaaccgttttttagttctgcgggtgctaaaaaaacactataggtgccagttcaaatttagaactttatttatttttccaggtgctaaaaatacgaaaaaaaatatttggtattttcattaggcactcacacttcatttcccacatgtcacttgtttttttagcccatattcgtagacatggatcaagtaagattcactacaagataattgtgctattgccaccaaattattacaacaaaaaataattcgtagcaatatattatactattgcaatgataatttttctgtggcaaataattattttttattgcaacgatctgttttatttagtacttttgttgcaatagaaaatgagatatcgccacaaaaaatcatactattgcaaaaaacatgttctatcaccacaattttaatttttgtggcaatttatatagtacaattttaatttatatggtacttttcactattttttgttgccacgatcaacaaattcgttgcaataaaaaaattgttgtttcataatttaacttatttttttcatatggactcggattgagacaaattttatatggaaattatagctctcgacgagatctacaattttataggtgataattttttcatttgaaatcttttagatattcaaatatatgatttaaatctcagttagctaggctcaaatggaactatatgtattttccaacagaattgatgtgtaggtgagttggtaaaggagagcacacctaaaggacaggatttgggttcgaatcctagcaaagacacaaaataaaaaagatatctagataaatagataggatgatagattaatatttgaaattttaatttggtacgtaaaactaatactacatatggagtggtggcaataatttttattacaacaatgtgaagtgttgcaatatgactttttgccacattcattccgtagcaacatctaaatttattaccacaaaataaaaatcgttgcaataacctattaccacgttgtttattaccacagctagcaacgattttacaattgtggcaacatatatctattgccacaattttagtattgatgccacgatttttttcatggcaacaaatgattttttgatttttctagtagtgatttaaactcaagacctctctctccatccaaagcctccataccaactcacgtacaaacatctgttgtgttggaaacaaatgatatcatgagactcctatcatccgaatttataatccatatttaacatcgttgatgagttcaaatgaaaagcttgtgaactacaaaattttagatcttagatttgcaactttcatatatgtttgtctccatccgatatcgttaagagattttaaatatttacttatgcaaatagatctcagaccttgtaactcattttcagatttttaaactaccttaaatcgaaaagtcataaactacagagtggaaaagcttgctaggtaccggttttaagcaaaccggtacttataagatcgatctctatgcgttgttttagtaatgcatcctatcaaaatttcagtgtaaaatgacttgtatagaaacaaataaaataggataatatcgttcgaaagcaaagtgaaccattttgaaaatagtttatgagtaaaatgggccgagaaatattgtagaggtaaagtactctgaatggtttgacggagtaaaacgattttttttctttgaattttacgtgcccatcaacttgcgcacacttttacgtgccgatcgtaatttaccgatcggatcaagacctgctaggtcaattaatgtacgtatctggaaacttactgcgcatataatattattaagaactttctacaaatttaattttatgctcgcagcctagttggcatgccgcagttatcttgtccgcatgcatgggcaattggacaattagcacgttaattggaatttagacccacgtgttagtttcactgactaccatccccaaggtgaaagtgttggtttgtccccttggttaatatatacaaattgatcatctcaaaatagtttttctattaatatataaatacatactgataaaaaagagtgttattgacatccaactattttataaataattgatcaacccttatttggataaaaagtaaacatccactcttgaatgtgatgtgcaaattgtcacatgtgagcatgtggcagcctagctagatagttgctactagtacagtagttagcgtgagagccaagagtagtttcatcgtggtcaataaaagtattagatcccttctggcatgcctgttccttaacaagtacagttcagtgcaattagctttggaaaaaactatttagtatagtcatgcaactaaacatgagaagtaattgcacacttgcgttgttttatcagattattcaaagttattttccttgtattaagcactacgccagatttgctcacttgtgatgggttatctgtgatgggccaaagttctgatgaccgttacctttgatggctcctacgggatgccatcatcggtgagtcctcgactacggctcacctgtgacgggctgacaatagaacccgtcagagaaacacctctgtctgatcccactttcgacccgtcacaggtgacttgatacctatgacgggtggtgtagctccggcccgtcagaggtgtagtttagtcaccagaaacaggttttagccctaacccgtttgaggttagttgcggcctatgtaaaacccccaacaaccacctactttccttacaacctagtgcactgtttacatttcgtgtgggagggtgcgaggagggcaattttttgcccgaaatggaggtaaaaaacactataataattatttttttctaacgtgtattatgtattatgtttttattgatgagaaaacacggcgcccgggaattcttcttagctacagcgcatgtccaaatctcgctttcgggttaaggacgttgttgacgagaaacacgacggcctgggagttctgcttagcttcagtacaggtccaaagcactttcgggttcagggcgtgctagttggtttgatcttgcaaccaacgaaaataaacaagaaaatctagtgagaatacgatagctgatcggccggtgagccaatgacgtatcgtgttagcctagccgatgcgatctaaccgaatcggctgtgagaagtaagataaatgaaattaagtatacctaagatatgtttcatcggctgtagatgtaatcaacatgtaatctatggacagagattatatctttttatatcatagccgatgacacaatacttagggtaaaatagataccgtatcggctaataccccaatacagctttatacaagagtatcaatctaagtaaatatatcaagagcaagcttgaattaaaggaatttaacaaagctaacactactacatatgtgattatcctggacgccggcaccttttggttccaggtgggccataagtggctccgcctggaaccagacgaatgtcagggtcgg

SEQ ID NO: 4723 - DNA, 12123 bp, Oryza sativa
  unsure (1)..(12123): unsure at all n locations
gtaggcgaccgcttgcgatggtcagggggcatataagcccccagcccaaccgttgccatgaatttccggcgtttctctctcctaaacatccacaaattagggaggaaggttttcgacctcaaatctttgattgtgttccatataaaagatgtagagcttgttctcctccttcatttgcttccatttttgtcagttttcattggtggatacgaagaaacttgcacttttataaatggaatagtgtaggcacatttttgttttttatttttttagcaaataaataatgcaatcttttacttgtttaaaaaagtatttagtacctacattgaaaagttgggtttgcctgtattaaatttattttcatttggatgaaaggacgattatttttattttttagaaatggacaatattatattaatgcttaaaattgttgtgcggttgtttaaaaagtccgtaaaattttaaattactaggtgattagttccctccaatttaaatacattcgtgtttgaatcggtcatggatgtattaatgacaagctttattgtaggtcatggatcggacatggatgcacaacacgaaaagagctcatccaacattcttgaaggaagcagccaaatttgttgagctcgtaaaggcacatgctgtgagggagaatttgaggagcattttttgcccatgcaaagtttgtaagaacgaaattttgctgtaagatcccaatgaagtattgtcgcacatcgtagaacgaggatttaagaagggctacgagatatggacttttcatgcggaagtcggtggtcgtaacgaagagttagatgatttctgttatgatgatgcagaaaattttataatcgaagacatgtcacagggaaacatcccggaatacggtggctcaggtatagagaatgaaggtattgattttgatctggaagatatgttacggcacgttgaaccagaggtcctaactggtacaagacgagggttggacagttgggaagcgttgaaaaaaacagcgaaggagcttctgtacgacgaagccaaaggatgcgacaaggactattcggtcctacgctcagtgctcgaacttctcagattgaaggccagacatggatggtcggacatgagcttcaatgatttgatggatcttttgagagttatgcttccaaagccgaacctgctaccgacgaacacatatcaagcgaagaaattgatatgtccattgtctctaggtgttcagaagatccatgcatgtgaaaatcattgcatactataccgcaaggaattcgcggatttagactcttgcccaacatgtggacacacacaactctattggaacaaatcacccacatattttggaacccctctattaagggaattcgttccattatttgttccgccaaaaatgtttcatctagtgtactaagaatgtttcattatgtatagacctaatgttgtagtgaacgaaacattcttttgcaacaaatcacctacatattttggaaaccctctattaagggaattcgtttcattttttttccacaaaaaatgtttcaccaagtgtactaagaatgtttcaatatgtatagatctaatgtttcactgaattgaaacattctttcgctatttgttgaaatattgtttttatataaggtgaaataacgcccgatttaaacgattgtttgatctacctagtgaaataattccgatatacttggtggaacatcatgcaacatttaaaaataattcaataataagctaaaaaaattgttggaatatatccatgtgtggtcttgttttgaagatttaattggaacgaatttaatggtgcaatcggatcatgatttggataaataatttaagagaaaaattagtttaaagtagttttgcacgtatatctggttttttacggttgaggaataggaaagaaactcgggaaaagctagttagcgcgcgccggcggcgcgcgttttaggcccagaaggcccagcgcgcggcgccggcgcacgcgtgcctcctcaacgcaacccattacgagtaagacgagaatccaagacgaagtaaacgtgattagcagcatgattacttccaacctttttaattaagccgtattagaaaatttaattagcgacatgattagtcctgaattattttttcatgtaattgcaccgtttagaaaacgtaattagcatcttgattagttcctatttttctgtaattagaacgtattagggtctagttggtttttctttgaaatataatttaatttaagactttgaattcaaaattaaaaaccttcaacactaatttaaaaactttcaactctaaatttaaacttttcactcaattgaaacttttcaaattaaaatttgaaaaaatcaaatcaaaattttaaaactttcaacacaaatttaaaaactttcaactctaaatttaaacttttcactcaattgaaacttttcaaattaaaatttgaaaaaatcaaatcaaaattttaaaactttcaacacaaatttaaaaactttcaactcaaaatttaaaaactttcaacttaaatttaaaaactttcaactcaaaatttgaaaagtttcatctcaaatttgaaaactttcaactcaaatttgaaaactttcaattcaaaattcaaaaactttcaactcaaatttaaaattttcaattattcttttaaaacttttaactaaatatttatgttttttaaatatttaatgctaattaccatagttagccctaatttactgtaattagtgttggctatgtaattagcgcttcgtgctcttcgcgcttagtgttggcctagaaggggtgccttcgtgctcgctgcttctgtaaccggcgcgcacgtgccgagtaggaacacccaagaaactcgagctggatatgaagtaaactttttccttcttgtattccaaccccaattcgaccgactgctaccattgagcccagcctccatccaggccggcccatttcgccctagttggcctcataaagcccaacccacccactcgacctccgcatttcacccctcttggcctcctctcctctcctcttccaccaccacccgccgccgccgcctccgccgcgtggttcgcctccgccgcccgatcccctcctccgggctcgcgcctcgagccggagcgccgcaggtgagccagagagtccccccgtcccccgcccttccttcacctaactctagggcccgagcgatctggtgttctggtgcgctagggttctcgcgtggggggttgggttggtcgaccgtgctctccgcgatctagggtttgtggctagggcggctctgagctgcgcggaattttattctgttagggggtcctgctagtcgacagctgatatgatgtgtgtggttgaagttattacactttgacttgttcatgatgaaatataagactcttcgatgcttcgttttaagttatactccttattactgattgttcatatgtatggcctttcattgttggattagtttgtagtacttgccctttttagtttactgttgattattagtaatattgcatcaaggatcagtggctcgatttaaataataatggtactaattttctgtaattgggctatcagttgggagatggctgggtatatgtcaagaggccccccaaatggctctgtttatgtgtgcaatctgcctcctggaaccgatgagaccatgctggccgattattttggcaccatagggttgctgaaggtatggatgggggtcttcccaggcaacatttttgtagctgattaaaagattcttcaagcctttgtcgcttcattttcatggtaattagtcattttctgttgttgatctcaacagaaggataaaaggaccggtcgtccaaaaatctggatttacagggacaaggttaccaatgaaccaaagggtgacgcgacagtcacctatgaagacccacatgctgcttcagctgcagtagaatggttcaataacaaggatttccatggaagcaccattcaggtccatatagctgagtcaaaaaacaaagacacatatgacaactcggcgagtttgaacaactctgctggccttggtggacaagatgaattggacaacggggcaggcagagggagagggcacggtgatggtccaggaaaagcctggcagcaagatggggattggctgtgcccaaatacaaggtctgttttgattggtaagaggcttccctgtcacttaatttcttttgctgactactatagtagtatggtcatcaccgtgtattcaaaatcctgtctgatattgcttcctctcccagttgtggcaatgtaaactttgcctttcgtggtgtctgtaatcgctgtggagctgctcgccctgccggtgttagtggatcaggtgccggtggtggtggtaggggtagaggccgtggaagtgacgatgcaaaaggaggcagccgtgctgctgctgttggtggtcctcctggactgtttggtccaaatgattggtcatgcccaatgtaagaatacccacataagtttgctgtttcatgacttcttctgtccttaccttatttgtatttgttattagctgttgcatgcctgcttgatgaacccaattgtgctgtgctctctatgactatttatgcctgttcaaatcttcaatattatttctaccctgtgtttatgcaggaattttggagaagcactaaatgttggtaatcaagctgttagaaatttaaatttcataggtgttataactcaatcatcttaaactttagtgactgaaaatcaattttgcaatatactccctccgtcccacaaagactttatttctagcattcaaaatttgtcccacaaagacttcatttctatatgttgcagccaatcaagctaatgcacgcacatttaattggagcctaggaaatacaaccaagagtattaatgaggggtaccatagacattttttctccctactactaatttgtctgaaaatcgctagaaatgatgtctttgtgggatggagggagtagttattagtgaatggtgaccttgtaatctttcattcttgttactaacctactatggggtctaagcttttcaataatgtttcgtcaaaccgttatttccattaacacaaatattttgtaacttcattaggatgatgacctgttggtgtctcctcagtcctatgggattgtagtactaatattatgtattgactaaattgatcaacagtaataaaagcatcatggttgtaccatgtactatattataaaaccgcatatgtgatgataaataatttaatgttttccaggtgtggcaacataaattgggcaaagcggatgaaatgtaatatctgtaacaccactaagccaggtcacaatgaaggtggtgtgaggtaagacatgcacaacctgcatgtggcatgttcattgctttgccagttaaatagtcgaaatgtattatttgcctttgctttggcatgaactatggtgagcaatttatgtaaagcaaagcactacatttacctgtcctgctcatgtctaaattagagtacactcatcacaccctggtttgtggtgactgatttttggctataatttggcagactttggaatgtagttgcctcaaaaactggttacacagttactcattggcattcttttttttttcatttttggcacatacgaatagcatggtaactacagtgctactctgttttcttgtaaacagttttgggcttttggtctcatttgagcaacactagacacaaattagagcgatatgctgttgcattttatcctatttgtttggcatgactgtctgtgaacctgtggtgatgacaattagtgcacctagctgacagtcacacggtgcaccttttgccagttgtaatatagagttatgacaacacaattgggtgcagtactgcagtatgttgttatgacaacatagttggggcaccatcagtggaaacgttccccatttattgatgatttagcacctttgaaattcaacttcaaactcaagtatcgaaataaacatgaaaaggaagattattatgatgcaaagtttttcctttacttttgattgacttcctttctgttaatctttacactcaacatagaatttttaacacaaaattgtacaaaaaggcatggtaaaatgagaagtgcatgtggttgcattacccataaaatcaactcatgtaattgttaattattatacatgaaattgtaagtctttcaatcatgagacttttctcaccaattacatttatttgcagaggaggccggggtggtgggtataaagaacttgatgaagaagaactagaggaagttaaaaggcgccgcaaagaggctgaagaagtgggacatgttatttgatgtcccatgtgtcaagtcatgagttttcatctaaatgttttttttcctgtataggatgacggggagatgtatgatgaatttggcaacctcaaaaagaaattccgtgctaaaacacagcaaactgaaaatgcaccaacccttcctgggtctggacgggctggatgggaggttgagcaacgtggtattacatgctcatttcagtttcttttgttaattaattccgtttgaatttgtgtgtagtcctatcacatgttcttggtaaattatttttgtagaggactaaacatttgctatgcttattaacataggataagttcaaactacacctactttatgatttgtacttgtgcacttaacaaatcacaaaatagatacacatagttctggacaaacaaattactttctggcacagaaatctgatttaccccctttttgtattggacatgataatatttttccatcatcattataggttcaactagaagagaaagcagggaaaggagcagagatcgaggcagagaccatgactacatgaacgggatagcaggaacagagatagaggcagtcatgggagagagcggcgccgaagccgaagtagaagtagagaccgtgagaaggaaagagggagggacaggggcagagaccacagctatgagaggagctgggagcgaggagccgagcgtgaccgtgatcgctataggtgaatactttatgccaggacatcacacgctgcatgccgattnttggttttccgatacttctgttttgtggctgatagctatgctgcttcagctatttcttgtggatgcggttgcacattgtctgtcttagcctgatgacangttatatcttcggacttctcgatgaactagaccactaagctctgattaaatgtgctatgtaccttgggagtattttcatgtaagatttaccgtgaatgctgtccacttgnanctgggaattatttttaaggatattggtttggaatccacntcgtctcaccggttgttgggtatatcatgcaagacttaattttactggtaatttggattttcgtctagtggattaacatactgtcacagttagccaattcaacctcgagttggtaacttttccctcttgttttattgctgatggagtcacaatcttggagatgaaaccaggaaatgaataatatgacactagtctctagagccatcatcatgcattgacatttccaatggtttgtgtccttgtcagcagcagtagaatttgaattgattgggtggttcttatctatcatgttaaaaattttcaggtgttatatcggatgtttgactggatgttggaaggggttttcggacacgaatgaaaaaactaatttcataactcgcatggaaaccgcgagataaatctttttagcctaattaatccatcagcacatgtgggttactatagcacttatggctaatcatggattaattaggctcaaaaaattgtctcacgattttcctcttaactgtgtaattagtttttcttataatctatatttaatgctccatacatgcatttaaagatttgaagtgatgtttttggaaaaaacttttgaggaactaaaccgggccttaatacggctcctatcatatccaaattacacttggcaaatgtcaaaaaaaaattacactcggcaaaccaaactgctcggagaacggataattacacctcctattgccaaatgagggttaaatacaaacaagggttttttaggctatgttatgtcagtttcctgatgccacgatcgtgatttgtgatttgtgcttgaacagttcaaaagtactcgtagagaactactgcatgatgacctctatgttcctacattccgaaatcgccaacttgcatacgcataagaaaatctagcatgattcacggaaaataatcctgtatataaagattatatatctagatggtcttaaaaagcattgttgacctttgtttttttatgtacatattttagtaaaaaataattatataaaacaatttgaaaaataccacaattccaaatactatttctggtattgttttgttcaaagttaataaagtttgattataacattatttgttgaatctgtgtatatgtcccatatacgccctattcttttcatattatttcatcggattattgaaatttaaattatttgctctaaagcttcaaaagaaatatgtttttttaaagaagttctattcaattttgaccacttgttttaagctacttatgaagtttataatttgaaatatttaatctatccctataatcaaatagataatccctacaatggctaacaatctttccatccagggagctgcacaataaatcataattaacaagacatttccaagcatcctttcctagagaaaaaaaaatagaacccctgtattgtatttctttaataatgaaagtggtttatatctcaagccctctacgaatctaccatgagacacaactaatattacctcaaaatatacttaacaatttaaaggtctcatttcatcatacagaagacagagaaacccacaccttcgctggacgttccaagacaataggcaacagttccccatccactcacatgccaacacttttttgtgtctttgtccagcttgctcaagtgcacaagcaaaaacagccatcatgcacacatgccatcgccatcaccggcatcatcagcaaattcttaaatcataataacgccgagagtttctgcttaatgataggaattagattctctaatgcatccttaaactgttggatgacagcatgagtagtcatgtgctgtgatgcacacaaccacacggtttatttttttctgtcttccatgcttggaaccttcattggatcaggagctttcgttttgtgttgggttggaaacttggaatcttgacatcaacaacagtagccagattgttggacagccaattccacagtactgtgaaaagttgattggtcacgaatcacaaatgtcactgattttatatatcaaaattttggtgtaagattgtagatacagtaggtaaagtggtgacatgagcaaagagttatattgctgattagtttataacaaacgaaaaggagtcgatcgtgtgactatagaatccctatttaagaccaagagttcaatttaaacgattggagattcatgcaaacatgatatatgattgaagaaaaaaagaataaaactttaatacttctcttagaagagcaaaagttaagtagttatgaaagtaaaacatctttcaggggggggaatggttttaatcaattccgttttaagcgggatagctatgttcatgttgtctttctttgaggttcctaaaggtattctcaagaaattggactattatagattcctttttttttctggcaatgtgatgaacacgggaaaagatataggttggctaggtggagcatttatgccaacttaaggaatgtggaggtttagggatacaagatttagaattgcaaaacaaatgtctacttagtaaatggttgtacaggcttttgttgaatgaggatgtgatttgacagaatttattgaaaaggaaatatttgatgaaaaaaaactttcactcaagtgaaaaaacaacccggggactctcccttttgatcatgacttatggcgtctaagaacgcttttctttcatgtggatccttaaaggttcacaatgggacccaagtgagatttttggaggacagttggtgtaggaacatctctttggccaatgaataccctaggtcgtataaccaagtgagaaataaaaacgcttatgtggcagtactcatgggaaaaagaccgcttaatgtgtcttttagaagggctactgtggtggttaaccttaaggattggttggaggtagtggcaaaagttttgatggttacatagacataacaaaatgactcttttgtttgggaggtacataaaaaaggtatgttatctgttaatttgatgtacaaggccatcatatatcgtgatgttgtaccaagaaaagaggtgatatagaagttaatgttgccattgaaaatcaaaaaaaaatttatagtacctaaggaaagaggtcattccaacaaaggacaatttggctaggagaggatgggaggatagcactaagtgttacttttgtaattcaaatgaaacaattcaacatcttttctttgattgccctttggctagatttgtttggaatgctatttttatagcttttggaatccacctgcctactaatgttgctaatcttttgggtaattggttttatggagttcttcctaggcttagagctcaaatacttgttggtgttgcggctttatgttgggcggtttggttatgtagaaatgatgtggtctttaatagcttcaaagctaacttatttttgcaggtaattttcaggtagacattctgggcgcaggaatggtccttgcttcttaaagagggagatgtaggatcataaagggcattttccaccccaaaagctagccattgaggtgagagctcccccacttatatcttaggtccttttcccttccacaactaatgtgggactattcaacaatctctcccttcacacattagtgtccctcagcccttcatcgccccttcactgtatacgggccccgcccacggtccatcaggtatacgggccccgcaggcacccacgatccatcaggccttgacacactgtgtccatcgggccagagatgttaaattagccatactctaataccaattgtaggatcgtaaagggtctttcctaccccaaaagctaaccattgaggtaagggattcccccacttatattttaggtcctttgctctttcataaccaatgtgtgactattcaacaggagatggtcaacttgtgaaagacgcgtgtaggaagctggaattgacaatgttagatttctttgctaaatatgggtggaatcaaagaggaagattggaagtttaagacttttctttgtttggatgttgctttttatgctttttgttgcattgtgcaagatgttatgtggtattgttgttagttgagtctaagtacttgtgtgaaaattttggttgtctttctccttatgtaaggggatgagtctaagaactattgtaagtttggttggttgtatacatccgtctctagatgtagaggccggttattccattatctttaaaaaaaagtagtgatgaaagatttgtttgttcagttcagataaaaacactaaagtaattctaaattatgttatgaattcaaaatcagtcatatcacaaataggcatgcccaaggtcaccagattcaaggcctcaccagttcggttggagaatttagattatctaccacctaattcgcgtgcctcaacttttttaccacccaattcgcatgccctctataatatgtcattagaactgctaattgctctatttgataccactttctcagtttttcattatttctcatttcttaatcccatttgattttttctcaaactttatggactgttttgtccctgggcccactgtcaaatgaaaggaagagaaatcctcttctctggatcgatcgatctctcgctgtagcgctagcccgagcgcgacgagctcctccgccggcgagcacctccgtcgccgggcgccaccaccccgccgccgagcgtcgcccccacgccgacgagcgccgccaccccacctccgagcacctctgtcgccgggcgcccccaccccgccgccgagcgtcgcccc

SEQ ID NO: 4724 - DNA, 12510 bp, Oryza sativa
  unsure (1)..(12510): unsure at all n locations
tcgatccagagaagaggatttctcttcctttcatctgacagtgggcccaggggcaaaacagtccacaaagtttgagaaaaaatacaaatgggattaagaaatgagaaataaatgaaaaactaagaaagtggtaccaagtagagcaattagcagtcctaatgacatattatagagggcacgcgaattgggtggtaaaaaagttaaaaggcatacgaattgaatggtaaatagtctaaattctccaccggttgccaaaatttggtactaagccatcacggcttattagcaagaaaaaaaatttgtgtgtcaaaattttaataacttcaaaagcaatgtaaaataaaaggtgcgttgaaaatatcttaaaatcatcttcaaaattaagttttaacattacttagatataatgagtacacttaattttcttttattgcaggctcctagacctatgtggtccatttgaactgttgtcccattcaaaaccacatgttaggtaatgttgcgtcgatgctaagatgtatccaacctggttaatgggttatgataatttgagatctaaattctagccaatagaaacagagggggaaagggaaaacggaaattagctcatataagatctgtttatgtaacattagtcatatgcacttgggttgcaatggggtgagatatggtgaacatgattcaatttttattttgttttctcccatttatcttctctcggttggttagtttattttgcatcattttagcatatttttataggtaaattttactatagagcacccagttttttttaatgtgcggataaacatagaaaaagcatgtcatggttaaaagacatcttaaaattggtgatttgctaatggacactttcgggccagttggagagataaaatcttaaagaaagacgagaatgccctaaaaccacatgcttcaacacatggcattagagtaaaaatttagaaatcatgtaactctaaatctatcatcaccctaaatacatcactaatatacatcatatttcattttcactttaggcttagctcaaaagttttttaccctaggggtattctcatgtttttgaataattttctctccaattgagtcgaaaatatgctccagaaaattatcaattatttaaaatgtcttttagccttgacgtgtttttataatgtgtactagcaaaattacataaattttaaatgtcaattagctatttttacttttcttttaatatgtggaattagggtaagaaggaaagaagttttaaacagtagagatatgtactaatggggagaatgatatcgcttttaaaattaaagatttttggaggtatttaaaatgaacttttgattttccgcgtttcataaaaacactaaaatctccaaaggatttactatggcatatttgacttcggacgatgtacaactcaagattttaacaacaaaaaccattggaaatttcaaaacttgcagacaaacatcccacatttcgtatcgtgccgtttaaacaaatttcagaaaataaagcattgccatccatctgatctgatgtcccggagccgcacgccgctgatgatccattatcccatccctctcattatttatttcctcgtatctccagccgcacacggaatattaaattatttcatccatcgatatcgtttcaaaatatatttattacttatatcgatttatcacaatcaaaatcaaatcaaaccgaaaagggaagtcgaaaaattcagtcaaaaaaaaaagaaagcgaaaaatacttcgccgtcgtcaagtagacgtcgccgtcttccgcagccagcctctcccccatctcatcgtcttcctcctcctcgcatcgccggaggccaccggggaccccaagaatccgaccaatccgatccccaatctgcttctccctaggcccgcgagaatcttgcgaggaaatctcgctgccggattcgaagaaaccgccggattccgtggagaatcaagaaacccccgcaaggtgttcgtccatggacacggagccgctgctgtcgccgctgtcgccgtcgccgcacctgctccacccgctgccggagcacgcggaggtgtccaccttctcgccggccctctcgccctgccctttcccggcgtcctcgtacaaggagcggatcatcttcggcgcgcacccgccgtcggcggctgcgacggcggcgccggcttcgcccccggcgcgggggaggcggtactaccggcgtgtgtccggggatgacctcgacgtgccgtcgtgttcgtcctcgccttcccctcccttcgacgaggagaacccgccgccgaacccgccgtcgctgttcgacttcatcggggggcgcacgaacctncaccgctcgcgcaccgcgccggccatggcgccgctcaacgcggcggctatcgccgcggccgccgcctcgggggacagccggaacccgccgccttccccacggcggccggccatcgtgctgcacgcgttcctcttcctgctcgcctacctcgccatgggcgtcaccttctacgccgccttgccgggcaacttcacctcctcggccggccctacccaccccgtcgccgacgcgctctacttctgcatagtgactctctgcaccatcggctacggtgacatcacaccggcgacccccgccgcgaagctcttctcaatctccttcgtcctcatcgggtttggctttgttgacatcctcctatccggcatggtgtcctatgtgcttgaccttcaggagcacctcctcatcacggcgctcaagaacccccgctctgtgcgcaagcaccggcacaattacatctttgatcttaagaagggccggatgcgtgtgcgcatgaaggttgcacttgcgctcaccgtggtggccatctgcgtgggggtcggtgccgcggtgctcaagagggtcgagaatttggggtggctcgatgccgtttaccttgctgtgatgtcggtgaccaccgtcgggtatggcgatcacgcgttccggacactggctggacggctctttgcatccgcgtggctgctcgtgtcgactcttgctgttgcaagggcattcctctacttagcggagatgaggattgacaagaggcaccgcgctatggctaactgggtgctgtcgagagacatgaccgtgtcagagtttcttgctgcggatatcgacaacaacggttatgtcacgtaagtctccgataccttagctattctttacctgcctgcatttacctgatttttagaaaatatgtgcacagatacttcttagtccttgctgatgatgatctagcaatttacaactgaaatagatgtttgaacatccaaattagagactttgcaaggtataggatttccgaacattaagcaacatgtgctagttggagaatcaatcattaacactgcttgttcactaggttgttgggtgttgacatattgtgtctgctgctctctagttcttggagtatactatggttcattttagtatgatgcaattttgttacaactaatgtaaggtggaacagaaacctaatttattggaggaacaaatggaatagtgagcaaggactttcggtttagaattaataaggtctcttaaaggaacttagcatcttagttctgtatgctttcttttgaacactatgtctcattacgtaggctttaccttatcttccttatgtatagttgtagaatactttcttttcactacaaatgtagtcttttcgatctgcgtatgcctgagattctagtatatgtgggtattgattttttttttcaggctcacaatttgcatggttgattattgggttgtgtggattgtacattgcatttgggaattcagaacgcctgttcataagataaataagaaatcagaatggggaaactgggaaagaaactcttggcttagtactggatatgtgagttttatagtattggaattttgaatttactgaaattgtaggtatgagaagtgttgaagaattttgtgcttggagactgggcactgttttagatacatggatatgtcatactacaagagaaattaaaatgtgctctgaaaagaattacctttctgaatgtaaagtagctaattctaaaattttgatcatgtgcatttaactggcatgtattcgggaacacgggacagaagcagtaccatttatgttgatcatgaattcatgcaacttcttttctgatggcatacaaaatgaatgactaacaaattcgttgtgtagcccatcagtggaatggaatcttctttttcttgtttcttgatacatctcagtatgagcaatgaaaatatattgtgcaattatatggctattaaaacttaaaatatgccaaatcgaaagagcttgacaatttgtcaatacaggattatgacattcgatgattagaaattctaacatctgaagttgtaagaatgtgttgtgtaggagagcatttgaattaataaataataaggtagaacctgcttctttcatgatcttatatttctcctctgtgtccagaaggtggctggacaaatattgtgaaacagatggaacactttttggctcattgatttgaactgtattttgttggtcttttgcttgatgtgttaacaatactctattgagtttatggatattaataagatatgtgcattaaatcgatttgtgtttacaaatacctcgaaaaagcaaaccttttactgtggtttcataaaagaaaatgtggggactttgccttctctagcaacccaggatttcagttgctattccaacacaacattttagaccacaataataaatcagttgcatgtacagctagcctctgatgcctgaatagctactgttataaagactttttagctcattgatttgaaccgtatttagctgctactccctccgtccctaaatataagggattttggttggatatgacacatcctatgttcagatttgttgtactagaatacatcacatccgaccaaaatcccttatatttagggacggagggagtattttgcttgatgtgttagattgagtttctggagattaatgaaatatttgcatcaaactaatttgtatttacaaatatccagaaaacaaaaagtttttagtgtggtttcacaaaaaggttggcacttagccttgtttagcaacccaagataacaataatacatcagttgcacatagcctgtgagaactaaatataagctaataaaaaaacattttcatagtacattgattgtgccagactgatcagctctcttaaagtggcatttgattacatatgttgacagcatgtgcttttaatttagtgcggatgcaaaaggcagtttttttttcttgaaatgcttacgaggttatctgcacaaatttatctcacttagaatgatcactctaatctccactaccagacttattagggagtagctacagcatgcaaccacaagcctaaaaatagttcgttcacttaaattttgcatagcattttattttatagcactttttacacatattattgctacaagcctgcggtataaatgtgttcacaatccacatcgacacatagattgcaatcacttttagttagataatagcttaatagaatgttagcaatgctatgtattgatcatcactgaatttgccacaatagttgagtgctatcttcttgtaatagcatggaattttattgcttgtcataatctctgaagaatacagcttcttctagctgtatggattattgttctaaccatcactttttctgttcaggaaatcggaatttgtagtttacaagctcaaggagatgggcaaaatttcagaaaaagacataatgatgatctgtgaccaattccaaagaatggactcaggaaactgtgggaagattacactttcagatcttctcgagagtcatcagctggtcactgaccttaacgagaagaaaaaggggaagaaatcataatacatcacaagacgcagaaaaaaaaatcgtagggtagtagcattttgctcatgaatcaatggtagaagagctaggaggctttctcctacgctgaattcagaaagcatccattgatggtaggatagcttcaggaaaagtagtttactgctctccagctatgattgtaccctagaaagggtgagaagatcactgctgtgaatagaagctgtaaataggaaggataatacaaggacatttattcagattctttataaatatatattatatggaggggttggctggtggccatttggcttttcaagttcttctgaaaattatcatggccaaagttgtggttggttggtgagacaagaaagatgagcacgccatttctgtttatatgcatacaatatagtagacaccacacattttttttctttatgatttgattaagtcgtttctgctgctgacactaggaaggcgacattagcctttgtcatcaaacctgttttgtattcttttgctctgattgacaattctttcggactctctgaattcaatgtattcttttgctctgattgagaattctttcggactttccctgaattcatggacatgaaattaatagcataataatttatttgtttgtggacattatattggacgtagaattatggggctttctgccacgccacgtggcatgaaaggattaggtaattaattggaaagtgaagtgttaattgagtgaaattttggatgacagtttccgacatctagtggccagtgggtacgagagcaggtacaaaagcaggtataaataagctagctgcaaatatattttaagaagataaataagccagctgtaaatatattttaagaagataaatgaggagagagaaaagcagcgggctacagatttatagccagttggagcacggacttcaagacacagtgtgtgtatgacatgtgggaccaggtgttaatagtatagtatgtaactattgtatgaatgagctattaaattagctatagatcaattggagctagtactcggctatactattaaacttgctctgattaggatcgtctggtccatgatcgagaatttcatcgacagcaaatcgtgattctgaagctaacatcgacaacaaggtaacaatcataaatcaccacgtaggatgagaaatcggacgatgatattatcgtttcagttttgggatgcgcttcaaagaaacagagagaggcatatggtacagagaaagaacgatcacaatgctaatccaaagattgatttcccaagaacacaaacttagaaccataatgactagtgtaccattcaccctaaatctgcagcagcagcagcagcaaaggcgactgttttcattgatcttgaattcttgatcgcatcggcgtcaggtggacaggtgctacgatgattggggtggtggcgccgccgccggcgccggtagcggcagagtcttcttctccttcacctgcggttctgtaaaaaaaaaaaagaaaaaaaaagaaatcaacttccatcaatattgagtcgtatgcatcgaatagtcctctagtttggaatcaaaatggactataatcattatttaattgcgtactagtcagaattcgaactcaagacctctggttgtaataccatgttgagttgtgttgcatgcacgattagtcctacccagaagcttaagttgatgataaaagacggaaaattcaatttatattccaacgctcaaaatggatcgaaggattagtagtagatcgattacttgagatgagagccttgggccggtccttgaagaggatcttgtgccggatcacgccgatcaccttcagctccgtctccgccgccaccgccgtcgtcttcttcttcctcagcacgaggagaggcttcttgagcgccaccttggtgccggcgagctcatggtaccccacggtgaaggtgaacgccgcctgcacatccgaatcaatcgaaacgtgagatggccgggaccgggagggagtggggtggaagaccgccgccggcggaggtgggttcttgccttggaagacggggcggcggcggcgcaaaggcggccgatgtggaggccctggatgcggccggagaagcacggctgtggctgcaccacgccctgcacctccacgatggcccactccgggcaccccgcctcgccgcacccgcaccgcacgcggatctgcatcgcccgccggcccgccgccttcttctctccgccggccgcgggtggaggcgaaggcgaaggcgaaagcgaaggaggaagagaggagagattttttttttctgggcgattggcgccaaaatggcgtgctaagttggtcccttcccgccatttctccccccggaaaacaatatttctttgcttcgcgccaaaacaagaaaaataggatttcttaggagaattcgaattgggctccggagtttaggatagccagcccagaaatggtattcaatatctctactcctccattctaaaataaatcaacttagaataagatacattagtagtaaggacatgtacaatgatctttattagcggtctttctttattgtcatgcaagcatatttggtgatgttgaagagagagaaagaagaaaagagaaagatggttgctacgcatgacaacagcatagagtcgactcttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtatctacctttgtacttgccctaagaatctgaacaacgttacttatgctaagtaatattttgttttattttaggttggtttattttaggatgtaaagaatatcttttgtttctcttttctcgaataccccatcatatctctatctagattcgtaatattggaatgtgtcatattatatactagatttgttttttagggacgaaaagaagtacatgccatcagcacataatagaagcttccagtaatcacacagaaattatggacagaacacaagaaattatggagaaaagtaaccatgatagtaacatccaagtgtaacagcataacatcaacagcttgtgcttctgaccactgaccattacaagtttacaacaaattacacgcgaaaaattgttcatgttaaacacttttgtcaataaagatttacccagatgagcagaagtcgacgccgcgacaaagcgcaaccttcaaacttcccaactcaacagctgataataaaatttacaggccacgaaattacaagcttaaatagctgtcatatgtagtatcatgtaaacaatcatctgaacacctacaacatttttgtctaccaacatctccattgggacttagaaatatactactgagagctacaacacggatcttagatcattacttcgtctcgaacaagctagcgaagatgctgtgaggagtatcaccagatgctaatgacctgagtaggacatggaacattgttggaactctgaccccgaactcgactcgaagatagaatgaggaagggcgaagtcagtttccgagaactctgcaccattacctcgttgcctctttgctgccctctcatgctttggactagcggtaggagaaccaggctgacagttggaatcaggggttagtggttcatggcgggacagagaatcatcgcgctgggggctcttggttgcttcgttttgtcctccattgtccctattcgaaggtacaccttgagttggagattcagatgtaggtgcaggagtcgaggggtcagttctttcggaatcagggaactgatcgcttggcaatgtgacggaagcaccagcagcaggtgtttcagatttcactccaccgagacgctgctgctcctcaatgatcttcttgaggtacttgccctgcgcctcaatgcgcaactgcagctgcctttgtacctgaagagaatgtttatcatatcattagggcctgctctttgctggatatttcacaaagatttgaagaatatgtgcatccagaacaatttctttgcatagatttggaatattttagtaacttcggaataggcttaataaatatataaggatggagtacaaatgttagaagctaacaattttatgctgaaaggaacttccacaaaaacttacttctaactgttcatgtagacgcttttggacctccatctgcagcttcagagcttcagatatctgtaagccactgtacaaaaaaaatatcacgatgaatattgactattgaggtggagaacagcaccaatcgaacagtaacataatggaactgtccattgaaaagataaataggcattgaaatcttacagaagataaatagaaagcacaataacaaatgacttaattttttcaactaaaaggaaaaagcatattaatcagacttaagttatttcacatattttgttgttttctagtatctaggatttatgttcttgaggatgttgaaagccaaaaatggtgggcagaagaaattatgtgtaaaatactagtagtagtttcaatctcaatccagcagcagcctattattccttgatactttcaactacagagggactacaatctagaaagcgatatttgccgagcagcatggcagcatgcaaacaacaatggtaataatttcaatagttggtcatggtagatttactggtaaatggtaaaatgtggcaaaccagcatacttccatttcataccataacagtatgtcagtagcatttcttttttctttttacaaaacgactgatatgatatcggagaaataattaggcttatgtatacttacgaggatccctcaagtccagcaagcaaatctccagggtctttgttttcagccttgttacctaccaaggagacaaaaattaggataagctaaaagaatgccagagtactaaaaaatgcaatgcatgatgaagagattgtccgcgtaccatcagctgaagagtcgggaatgtactttgcaagcctgtatttctagaaacaggaggggaattaaataggataaaaaaaatactagctacaaaaaatattaaagggaaagtgacacactgtaacaagatgtacctgcaaatgacttttcacatggtatatcgtcaacccttgtacacccataattcttagaactcctttcggagttgctcctgttgcatttgaggaattcaagtgttagcagaagcagaaatttacagttaataagttcaatggtaagagagcatgattacatgcatgcagtaaagttattgtctccaagaaaagcatcatacagaacagtctctatataagtttgataaaatcaaataaatgaataaatgaaaacataattgcaacaattgcagtatgaatacatactatcaggaccaccaagttgagtaacagcctcaacaaatcgttcgtgcagctcatttgtccaccgtaagcgttgccttgcagccaagttggaattgttgtttgctccattatctgggcccatattgttgccacctaattccatatgctgctgataagtgactgaattattacagtagggccaacactaggttcaggttttggttaatacaatgatcatcacctgggaaaaaatacatcagagagccagatatcagttttacaaacagcgatcacaaacaatgtttgccggtgataaaagtacaaaaacacaactaatcagtgcaaagttgcagtggcagttttctgtccatctctaagacagtcacaagtgtttctagaatttgtgagcttaactacatagggaagttttcattgttgcagaggaaagaactactagtactagtatagacaaggaaaatgccatttgtaccaagaaaactagcgtgtgcaacgctgtccaatacatctatccaatttgattcatcataccatactgctttacatggaaggttaggcaaatagagtgacccataaaaatggtagatgcaaagctctaacagaaaaccagccagcatacatagttaaggcgaatacttgcatccacagcttgcatggtgcatcaatcgaattatcatccattagtatttatttattttgctctcaatttataaccaggcaaaaaaaaggtaaagagctccatgggagcaacccacacaacctatcgccagacatatgaaattagctttgatacatgatgttcttgatgcccttcaattgcacagtagaaaaagatgaaatcaaagcaaagcgaattgcagctccatgctcaaagcaaagagcaccccgtatatgccaacctactaccaccagagaactcatcacaaacagcgcaagccacacgccatctccggcggaggtgggcccgacctgtcagcctcaggaagcccttttttttttcctctcctcgcttgcattttttcccttttccattgggggaacaaaagcgagagcaataacatctcaacacggaaagcaaaaaaacacgcacaaatttaccgggaattctctctacagaggcaaagtaaattttggggggggggggggggg

SEQ ID NO: 4725 - DNA, 25899 bp, Oryza sativa
  unsure (1)..(25899): unsure at all n locations
aggcaagatcgaagctgtgcggcgccagtgaagtgttgggggggaaggggggaaggattggtgggttcttggagaggcgaggagagggggagagaattccacgagattctcttctctcctctcctcttcttgtctcgtcttctcttccccgcgtaggcgtaggtgtgtgtggccctctgctgctgggtgcctgtgccagcctttctacctgggcctactacgctatagaatgacctgcccatagttaaaaaacatgatacaccttttttttcggtttggaccctgggtttttgtatattatcattgggtcggcaaatctactcctcccaaaatagaatttgttatattttagaacgggggtagtagtattttttttataaaagaaatagggtataacgcaggtgctcacatgagtacacacctacctctatgaacacgtatgtgcatgctctatctctatgagcatctctaataggctggaccatcatattttaagattgacgaaggaactatagacgtcttactgtcatgtcatcgcattgacggattcatcgcctacaagtcgtaaatgcgagcacttatgccaagtcgaattgtttatagagtaaattttaccttgagccatatttttattttctatgttttcactttggaccacttgtctctcttctcaaccatatgaacgatctcaggtatgtcgacacctactcatcaatgaactctcatagttatatgtaagacattttttagcatacgacgagttggatgtaaatgaataaaaaagttgagggtggtctaaaataccacaaaggtaaaaatatctggttcaaagtaaaaaatattggttaaaaggtgatccatagcgaaacatcggtaataaatgtgatataaagttgcattaaactctaatattagctataagctcatagttatctctactattaaacttgctctaagtagattaacaatggtttaaaggctggcctcgagctgctcaactcaacagaccaacaaataaggtcaagcttttgacattgtataagtttaaacctgatatgatgcctcatgaacatagacatgttcataacctgatgcatcatgaacatagacaaacctgatgcaacgagaggccttccatgaacctggacatgattaatcatccatgttcataatatggcgattttagtgggtgcaagctgaattttcatacgcaggaaggagacaacgagcacacctgctctcgagtctcgactcgctggccaatgggccatggcgtctcctctcggcgtgcaggccgttggattgtgccacgtggaagatttctatacgtccaaagtagtaaatggtcaaagcttgctgctaggaagggtaccgactaccgagtggcttttctatgaacactttcaagagaacgcgcactttgaatgggagtttttattttttgaacatatttaataaaattttaaaatggattctctactatttttaaataaatgttttagccataatgttgacaaacaccgcatatattattaaaccttagccacaaatagtattttactagtgtcgtagtattattttatcacaccagtaatattggaaataatataatataacaagattatttcacattttttaggaaaaacttatttattaaaagaactcatttcaacgacttgctggccaccgtaaatcgcttttccttaatggcagagccatggcctttttagagttcatacaaatttaagtttgttggagtagttattagggaaattctattttcaattttaatattaacattaaaaaaattatattgtgcatttgctgacaagcctaggctgttgccaaggatagccgagcaatcgctccacaactgtttttcctcatatgtgctatttacatataagaaaactaaaaggcatcttcaatggctgtaagaattggggaaatttcttcttttctaatataggctaaatggtcagctgaatcatagcattttcttttcaaaataggagcacaacatggttgctcgatggaagatccatagtttttttgcacatgtgttccgagctacaattctctaccacttttatggttacgttttcttttctgccatgataatgatgttatggatttttattcaactaaagaaaaggtcgatgcaaatattagggataaatgagttatatgttgttcctcataaaagttttgcgttctgaaatggcccatgatcaagttgattttgtttattttcccttttaatttccatgtcagcagattttaatatggagaacatgtatactgaagtacatcatatccatatgtgtagaatattgcttcacgagagaaatttgaaaatatactttattttctcatattttgcgtttatatacctggctgtgattaatttccaaaaatatacccaatccgcggaacggttgcgcgggagtgaggacgaaccagccggtcccgcaggctggggatgcagtaccgcgccggtcccatggactgggtgagcgcggcaatgctcccgcatgccagatgtgcgggaccggctctcccacatgccgccccctatctcggttcccgaattggatctgatctcctatgcacggaaaacggagcagaccattaccacataattaattaagtattagcttttttttcaaaaatatattaatatgattttttaaacaactttcgtatagaaactttttttaaaaaatacaccatttaggagtttgaaaagcgtgcgcgtggatgagtaggaaaaattagaggaagaacacatctcaaacaacacgcggcctgctcggttccgcgtgttggaaacacgggacagcgtcagtcccgcgccaccgttctgcggcaccgccgcgttcactcgctatcccacatgctccatcgctcccgcacatcagagccgcggtaccgactcagtcccgcagtccagtcatgtgggaccggctcggttgcgcatcccagttccgcgcgaccggctcggattccgctcccacatccccagtatgcggttcgtcctcgctcccacccatccgttccgcgaattaggtatatttttacaaattaatcacaggtaggtatataaacgcaagatatgaaaaaataaagtatattttcaaatttctttcatggcttcacaatagtcatgtaggaattctgcgttaaaaaaatcacgtaggatcataaagcttccaaaaaaattcaaaccatatatccaggaaatttaaaggattttcctttttgcacaattccgataaaaatcctcaaattccgagcattccagcaaagcccttatcgtctattgatgcacatgccagcactcgaaagtagttagaatcgagaaagtcgtacaaatgcgaaaccctcaacaaggttggagaggaacaagaattggaactgtccatgcaaaatcttgaaactaaggtatatccggtgcaatattaatttctagttttctactatcttgtactgctcgttggagccatgcatgacatctgttgcaagctataaagagatcacttgcatgggagaggcatcgatttcatctttaaatcttagacacctaattcactactggtttgcaaattgtaaatgagctggtcgttgtcgaaagttgcccgaaattatagtattttttggatttggaggcatccgttgcaggaatctttagaaaaagatgcccggaatattccttcgaggttgtccctagggctagtcatcacttgtgagaaatggtttctctgtctcttcttcgtttctgtaatgcttagtatgtgctggaaggggttaattgggcattagggcataaacaaatggggattaaggtgaagacgaggtgtcacgcccggaatttctatccaaaattccaaacgcttacatgtgtgtaaaccctcgtctaggaatcagccgaggcacacaataacaaattgataatagagtacaattattactctaattaataagcgaatataaagtcattatagaggtagatagttcctctcaaacaataaagttctaagcagtggaaaataaaagaaatagcgcaggcgactcctctccacaggcagcttgaccagggctacgcctaatcatccacaccatcagcatcactgtagaactcctcctctgatgaatgattgcaagatgagtatatgacatactcagcaagccacgcagcaaatatgcaagtgcaatggataacaaatgatggcataatataggctcatttgcataaacagcatttaataagcaattgagagaatagtaaaacagttgagtaattaaacaatattaaatcaacactatacaacacacccgtgttgcatagggccaaccattctgaacaaccaatcccggctgcacagttctatctccaaaccaggaatataccattccaaaccaggagctaaacaagttattaacatcatcatttaatatagtgagaagtgtgagactaatcactaaagacattgttagacccgctcataacctcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcccggatcataatcacccccttaaacaaggcatggactccccagcgacccccgtggccttatctccgccacttcacagtctggtgctctactatgaaccatactatacagaaagtaaagccgttgcccacgctggcttgtggttggcacgattaatgtttcacaactaaaaatcgtgaaccggtccttaattgtcatgagcacgaccatcaaaaccatgtgctcacaacccaccattatcagattttagttggcaaattaattaattaaccaatcatgattaaccatcatgagctatcattaagccatcattaagtagtagtaaatcataagttatcccatttatgtgagctagtgtctctaagcatggctaagcatcctaatcactttagctaaaaccatataatgttctagctaatcaaattattaaccaagtgacaaagaatagggaatcaatagcaaaagggctataacaaggcaataggttatttcgacccaatgacattcgaaaataaatgcaatagttgaatagaaacaatagctttaaacgggatcaatatgctcaaagggtcgtttgggatctgtgtgacttgccttgctagccttggaactctttaaagtcttctcctgcaaattcggactctccgggaacgtcggaatctaaagagaaaagaacaaaatcaccaaaacagcacataaacaagcatgaacagtacatgtggatatttttaacatgtaggtctcaattttagaaaaatttagagacttgaaccaactaaattcgagctaagatgaattagttatgaattttcaaagatttaatcggattaaatcatttatatagattttaattgaattatgatgcaataatgaattatttttgaaaagaaaaaggggattattgcgtcagcggctagggttcacggcggtccacgggacacggcgacgatgacgtcagcggtgacgtcatcaccgacgacggctcgggcggcgcatgctcgccggcgaacgacggcgcggcggcgcgaacggacagcacctacgggttgcgggcgacgcggcgaactcaccggtgaccaaaacggcggcggaagatcaacggacggcgacggcggcgaggaagaagcggcggcgaccttcggcttgacgacgacggcggtgctccggtgacctaaggcgacgacggaggggcggacgaggtcggcgacgacttgacgatcacgacggcggcttccctgagcgacgatgacgaccggagcgggggcgacgcacggttggacaaacggcggcgacggcagcgctaggctgcacggtgctagggctctaccggcggcgagaggcgaaggcgagggtggcggcgggtagcgaagggcttgggggtccttttaaagcggctagggggcggcgacgaaggcccacggtgaccggcgacggcgatggaaagttagggctcgggagaagaaaacgaatccgaatcaaactcgaatccgatgatttccaaaccgaattaggcgatgattccaaaagagaaaagatagaggagatcaaggcgatcatttcccctctattgatttcaccggagaaggaaaggcgcggtcgaattggaagggcggcggcggcgctgcacggttagggttcgggcgcgaggaggacgacgggtccgataggtgggccccacctgtcagcggcggacgcgcgcacgcacacgagcggcgctcggctgcgggtcgacttgggccagggaggagagagagagggttttgggctgacttttggcccaaagccaaaagagagatttttaaaactttttcaatttaaattattcatgaaatgcaattctatttattaaaaatacttccttggctcaaataaatcccagaaaaatctaggaactatagaatcaagagaagtatttaataaaaatttatctggcccacttttatattggaatttattatttaaaattagatcttctcttctaggcttttaaaatcaaattctaataattccaattaaacaacaatttatatatttaagatttttagggtgtgacacgaggacaaagctttccttgttggaaccttttgtattgtttttgttttagtgagtgtgagaccatgattctctaactttggcctgatgatataatatgtagaaggtagtagcaactttcagctctgcatgggtgttccaagaagtgtttagattggtcgtgtgcaaataatgtttataaattgtaatttgcaaaaaaaaaaaaaactccagtatacttttctgtgtatttattccaacatgttatgattcaaagtagtatggtttcatcttggagatcatgtaggtgaccaaacacagcaatataccaagtgaaaatgatgatggtgatgtacaacttacgactgaaattttgaggaagaaatgaaatttagaaggacaataattgaatataccaagtggcaagagccattcaatttgcaagtcatgtttaagaaagatgatgtagcctacgaaatgctactgctttcaactataaaagaaataatttgttcctgttgacttacaaattcaaatattttttttattattgatggtgcatacagtatttggatattgatcaaattttatttgctgattctaagaaatgaagtgttttctgaagcagtttagacaatgaggactctatgtggtacatgtgtagacaaaaacgacaggagcattttgcattcccctatttgcatagaaagctaggaactgatattcgaaattgtttcagatggatatatcagttaatcatgtcagaacccaaatctcacggtaataatattatttatcaaggaaggcacttgatctagcacattaggcattttatataagatatgctgattggattgataacataagagagaaaaccttgctacttgacaatgttggcatgcattagccagagaacaagatggcctctacaagattggcagagcatccccccttcttaccgaaattcgaattccgaaattcgacatgactacccccatgacaagaaaactggtgtttgcacatccagattgcgtcgaacgacacggctcagcaagacttgcgcttaagctcaggtgacttctggaggatcatttggccttcgatgcccgagggcgtcggcttgccctcaggactatgcaggttgattgggctgacagagagctggtggaagatggaggagctcaatgtgtcagcggagccgcacatgacaccaccagagagctccgggagatcattgtccgagatgctgaagccgcttgaggcaagctgctcggagacgatcttgcatgccttctctagtaaagtgtcgatgtacttctggtaggcttccattctgatctgcacatgcttctggacctgatcatgggaaaatgaaatagtcaactattgtgtgttggacaatgtattcctgattacaatgaaaatcttaaaactaacagatcttcaatagagcttttcatgttgacatattgtgtggcatgctaagtgttaaaagtgcagttgtagaaatgataatgaacaagtgtgttccacatttttcggtaacacgagatgcagcgcacaaatcctgaaggaccggctgttctgaatattggtgaagtatcagcctcacggtatatcatttgttttaaagcttgagggctttattcttatgtagcaaatactgaagttggtgagcactagctcttctttcttgctaatggcatgtataaaaaccaaagaatattatgacggatcaagctttcaaagttacctccacttgttcatgcagtcttcgttgcatttccatctgagctcgcaatgcttccttgacctcttgatttctgtaacaagtacatgtgacattttaactctttttaaactagcacaacacgagcactattattaaaatattcgtatttgccagaatggagaaacaaatgtccaggatgagtatcccatggagcttactctttaacatcttgagtagaaactctaggcgacacactcattccaccttgggcatctagaagataggatgctgcaaaccatagcagaggtcagaggttagtaaaaggtcaaaagaactcttaaaagtgtggttttcaagtcaaaaagacatatctgcataacaaagtccagaatttgactagatgagcaaattcaatctacaaacgtttccatttgaaacaattacaataaactgcaattcaacgatacatgtaccaacactacgcttaatattgccaacattttgtgtataatttctcttccatttcccactgatgaaccttgatgtgattattcatgttagtactcctacttagcaatatgcaattattactggggctaaatttaactcaagactgaactttttctacacaaggcaaaagtacaacccacaaattctccctactggacaggacctatagcttctggatcagcatgtgtgccactacgaatttgcatatacccatatggaatcgctatatttgtggcgacacaaatattgatagatttcagtcagttttttatgcatggagtctttggtatttgtacacagcgcacctgttagtgctagttttgcaggtacatgggtgtttacctatcagtcgatttctggtttgcttctactacactgtcaatcctatataaaaattatggtgtaaatattggaatttacaatgtaagttttgaaaactacagtgtaaatttgtgtaatacagtgtaaatatatgtaatttacaatgtaaaaaacaattgactattttatggtgaaaaatgtgaagtcaaaaatatagctagtccctgaaaaagaaaagcttgtccactgacgtaaaatactcctccacatacagattccctctcaccattcagtccttggttgcctgcagaccactcaactacgaatcctcccattatttcccacatcaggtccactctattccttcatgtccctacagactggtgccccagaacagagatttatggtaagcttaaaggaaattcataacactgttaacatagctgccatctccaatccatacgatttccagcaatccctggtcttttaagaagttgctaccaattgattcctcccaagatgcatccaaacttaacaccagtaaacccaagctaccatctccaaatcatataacttcaagcaatctccaatcttttcaagaagttagctacatagtgattccttgcaatacatcaatattgatcaaattgcaatcgatgatcaaccaacttcataagacaccagttcatgagcagagccgtatttaacatgtccacagatcaatggtaggatagttgcatgacttcagaatgaacttccacaatgtgaacaaattggaattgttgcagcaagacttggaagttggaatattaatcgaaattaacagtgaggtcagtagattgctttgtgtaacttaccatctttagattgctccgatgcctcttttccagattgtttccccagtctatatttctggtcgaggaagatcaaacttaaatagctgtatttcaaactttgcaagacatgcaaaagtattatgaattacctgaagatgactcttcaagtggaaaagagtgagccccttcacacccattgtcctcaagatagttttaggtgttgcttctgcaagataatcatgcattgagtactcaatttaaaaatatataatgaaatcaaatcttaaactgttttactggattcccctggatttttcacattttagaccttttgggaaacttattttacaaatagaccccaaaaaaaacttactccaggaatagaccctttttgcggtgccaacatcattgacgctgtagtccaacatgatggcgccaatgacattggcaccgtccccctagcatccccacagaagctaactcactaatgtaaagggggacggcggtaatatctttggcatcattatgttggaccacggcgccaatgacattggtgtcgcgaaaagggtctattcctggaataagttttttaggggtctatttgtaaaataagtttttagaaaggtctaaaatgtaaaaaaaatccatcttgattcccttagcaattgactaatgataaaccagcaatttagagtgccaacatttactttttttagataatggaataattatcccaggcactgcaccagcaatttagagtgccaacatttactttttttagataatggaataattgtcccagggactgcactagaaggtgcacaaagccacaggcacaaccttttttagactacctacatgattcaattaagatttagaattttgatctagtgtgagtttcgctgtgctactgattatacctcctacaagaaaataaggaacagtacaatacacgcttttctttgtatagacagttgtccaggtgcatagctaaaactaaggccttttatggacggaggtagtaatcacagaagcacttgtaatgttggtctgagatttaaatggttcatcaaaataattagaacctaaaggtaaaagtgaatccttgaatttttataaagaaaatagagtaaattacagaaaactacaggccaaaatttgtgataaatttggtgttaaatctatagtttggtgatattgtggcttaaatatgtaaatttgcatagttctgtgaaatttgaaacaagtcccaagaaaattgacagtagtaaattgaactaaactcatgtcaacaaaattgagtaagacctcaaaggagaaaaatacagccacttctattcactgtatgtccttaataaattttaatgattgaatcaaagacttcttgcagacaccacagtccactaaaatcaaagcatcaagctaaactaaatcagtatagaactattatagctctataccataagttaagcattttggcatgtaagcaccagattctaagaaatacaccaaaaatgcctagactgcgcccaagaaaaatcaaacagtatcatctttgaacaactatgttgtttttaagataaatgaatgcctttattccggcctctgcataagtcatgcatcaaccattagtgattagtcattacaaagttttaggcatagactagcacagacaatgcatagcacccatctcacaaaattcaaacatgaacgaaaaacttatgcacaaaccctatcagtcaactatgtaatatagtcaggttaaaaatatgatgtgtgcagggattactgttcactagtgcaaacagctccatggttacgtgttgaaccaagattcatacatcagatgctagagtaatcaatcctttataacttctgcttctgaataccctttgccaccaaaaacatgattatatgataaaacattcaatgcatactctaggttgattatatacggtggcaagcgcctaacgcctaatcaccaatcaggtggctctaggtggaacgattggctatacaggtgaggcgggagttgcacacctatgcaagctaggcagatgtctttctgaagtactaagcatagcaggtgaaccgtgttggtggcaacaatcaagccgctaccttagggcttattcggttcataggaattccaaatcaaaggaataggtaaagttaagaggtctcacctcatgctaagaatcctacagaattagcttgaaagactacaatccttaggaatttggtaggatccattcctatgaaacgaatgatgcatataggaaaaattcctaaggattcaattcctacaataatcctatgaaaatcctttaaaccgaatgagccattttctccaaatactgatctgctctatgcctgtgccaatgtgagatactgcacctcatcatgtgggaaattgcgaaatcgctgtatttatcccactgcgttcacttacaaaccactgaaataaacccaaaatgagcagaaacttctccctcatccttgtcccaattctaacacccgaaaccaccaccaatttcgtattaacaaaacactcttgattgctaccggtgcagaattcgttaaagtacaggacaagcaagcagctcaaatcagtagccgacctcgatttttcacctccaatcagtaaactccccaaacttgtaatttgtaaacaactaatgggtacaagtttcccctccaaatcacaccaaaaccagcctagagcgggctaaatccgcttccctaagcgctggccaagcgggcatttctctccttgccaaaatcgaagacttattataaccaaacgaaaagatccaaagcatttcctgaatctccgaacaaacaaaacaatgccccccaaatcccgcgccgaaatctccgctcccaatccgagctttggcgcgaaccaccaccaccaccaccaagaacgaaggagcaacccacccacccaccaaccaaccgcgcaagcgcaacgccaatgcgccgcctctccaatgggggagctaagctaccggagatcggagagaatgggggggagagaagcaagggggaaatctcactctcggggcccccgagctgggcgacggcgtcgacgaagcgctcgtggaggtcggccgtccaccggaggcggggcttgggatcggcggtcagcaccaggttgggccctccccccgcccgacgccccgccttgccgccgtccggccggtggtggatcagcccaggcgggaacatctcctcttcttttttcttcctcctcgccggcaacaaggaagagaagaagagaggaaagacgagacctttgctgctcctcccaaaagcggaggatccaatgaaaagtcccaacgctttctctctctttcttgcttcttgcttctcctctgctgctgcctgctgcctctcccctgctgctgctgctttccagtggcagaggcagcgattctcctctctcctcttgcttctcttcttgacctcttctcttctctctcctctattgcttctttctctctcttcaacttctgtgtttatagattggagggttgtagtataatctggagatggatgggaacagcagtggccataatgatgcgtgttactactagtgcagactgcagagcaacgtcattttcttactgttgttagattattacgccctaacttactactgtcatcagagctaggagtaggtgataattatttgtgattagcacactacagccaccctccctccctccccatcgacgtatagtagcgagtacaatagcaggctacaagtcgagtcgactgtaagcacatgtgaaagagacgtgaaagagagaagataagagagagaaggaaagcaggatttatagccagctgcagcacagaatccaatgcattgtgtgtgtatgagatgtaggatcatacattaatggtgtattatataactattgataaactattagattggatatatacgaattagagctattagttggctatactattaaacttgctctaattgagttcaactcttaggctctgttcgtttactggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatagactgcttcgttttccgtaccggagggatgggttcccaactcaaccaaaagaacagagccttattaattaactcgtttagtatggaattaaagtacaacgtctcaattatgctctcctagctcggcttaaatcatgaaaacattagaatctggtcgtttgcttgctgttttagagcacgctctaaaaattaacgcgtcattttcaaccagtttaatagtctatccatgttataaatatatgatatattgtaacctgattttcatcttaaatctataacctgattttttttctctctcctcttctccattcttaacctaagcataaatttgatttggtaatttttagagtctgctttcatcatttattatactcgcttttaaaacttaatttttaaagttaattttgagattttttttatcaacttatttttagtcttcttggcttttaaatcgatagcagcacacatagatgttttatccatgataatttataggtgtttagtttatttttccactgacttgttagcactatatcaaactatcatagcattaagagcaagtttagtagtatagcccactacttactataagccaatgttaaagctaacatgtataatagcttatgctttcatcataagatactccctccatctacttttgatagtcatatttccaaatctaaaaattttatttttgataagcatatttcacttcaacaacttatcattttaatgactttctcagatttaatgcatgactctccattcttccacacatgattggctacatgggcattgagaaacgtaaatataaatgaatcgcttgtttacgaggaatgactagtagcatgtttatatggatgataagtagaattacttatccttggtctgtgtgccaagatgaaatatgactatcaaaagtagatggagggagtaggatttatttttttcatcatctctctttatctctttatgaatttaatgcttatttcttggagcttgtgtggagctagctcttgcatgagagccaacactccctattttttttatctctctttttcacataagcatttagcttgcttatagctcacttagctcactgtaatccttgctctaacacaaacacaagtcaattaattgtagaaaatatataataattgggtttcttgcactttggtgctgaggtaggtattgggagctgggcaaatgattggtgcatggaaaattcagcctggcctctcttatctgtctaccatctcccaatctctatctctgtgtgtgtgtgtgtgtgtgtgtggcgtttggtgatgctagcaaattgacaaatgggattagtttaattggggtttttttgtgccctttttgcttagaaaaaaagctagtgggtggaggatcatgtgagagctgaacagacagctgagtggcccttctccatttgtttaattttctttcgcgtgttatttaatttgtaaaaacccttgcttacatcggctttgcacatgctcaatgtccatatccagacgtcatgtgtgtttcaacgcgtacaaatgcaggaaatgtggtgcttcaaatggtctctttcaccttgctaagagtgtatatacaatagacctaaattagtaataaagctatcagcctgattacatcggaatttgtttgtcgtgtcgactaaaagctgtgttgcgctggggttttcaacttatctctctcattttcgcacgcacgcttttcaaactgctaaacggtaaataatgtgtgacaaacaacgtgtaagcttccgattgtgttctcttaatttgtgttgggtacttgggtgttggggtcaaaccatgagaaaagaatcaagtatatgattgttgggaggatgtatgtagtccgggtgagactggtatgaaaatggaaaatgtacaaaatgcaaattatgtatattttgttagggaccactattttgtgaagattgcttgtacggtgatgcctctagctatatatgatagaggtggtatgtagacaattgaggatgggagctaagctccaaattaagttcgatgggctgactctacggctatattcttctcgatgagttgggaactcatctcccaggcacacagaacagaacgactcattagcacatgattaattaaatattaactattttttttaaaaaaatagattaatatgatttttaaagcaacttttttataggaaacttaaaaaaaactgtttagctgtttgaaaaacgtgcacgcggaaaaaagagataggtgagttggaaaagaagggaagaacacaaactacgtatatatagagctaaagttgagttagaaatatttagaagagaatatatgccaaagatgctgatgtcatatttttttacaggagattgactcgaccagggaaatatatacaaaagacaaaataataagcttattaaaatttgatgtgttttgcatatattatccttccctatcaatacaaacgatgcaaagcttttgcccttttaaaaaagatataattaatgattgatgcatagatttttctatgaacttaacaaaccaaaaaaaccattttgtatgtcaacagtgtgacatgcagtctcctagcattgtcacgttatcaaaatcatagacagaaagagaatgtgaaagaaggtagcacactacgattttctatttatattttcttgaacctttttaattttcaattaaaaaataaaccaattctaaacttattttcaaatcttaaacttttggtcacgccacgtggtaagacaaattgctgttattgttttggggttgtgtggccaaaaagatgatttagaaataagtaatgatctattttgtaaattaaatcattaaaaagtttaaaaataataaaaattcgtaccctacaagatcctaatttttacctaggtgtttataccatcggccacctataaaaaccgtcggccttgtatatttctaagcgtatatcatcggccactactccctctctgtttcaaagtagttacttatgatcatctatgcgtatagcgtagaagatatgtttttcaaatgtaaaaattgctttgttttaggatccctttgaatcgtagggttgaaaaaatagagaaaaagggagaaacacatgattctgataggaattgaagtgtaaaacagaggattgtaaaacacataaaaaaactcaggaatgatcatttgattagaccgcaagaaaaaacgcaggaattagatgcgggagatagactcaaaggaaattttccaagaggttggagctcttgctaagtttcctctaaaatccacatgcaatgtgtcattacataggatttgaaaaacttcaatcctttgaatctgtgtcattacataggatttgaaaaacttcaatcctttgaatcaaagggctaatagaaaaatttcctataggatttaaatcatatgaaattcctacgtaagtcctttatttactttagagcagagataatatttctctcttgatacagaggataaaatattcttacgaacgaccggtatttagcaaatatcctatatttagcaaaataggatggacgctaattctaatagcgtccaaaaaaaggacgttgctttccatagcgaccaggtctggacgtcgttcacctcagcgtccagctatgttgtgcagcctaactatcccaaagccatatccattctatatacgagaaatagaagcgaggaatccctgcagggagaactggtgcggcatcgaggattcgaggctagggcctagggcagttactggcttactgccgccgatccaacaggaggagactgggaagtgggaagccgctgctgtccccgccttgtcgggagcctgatatggcgatatccgccaaggacacaagaaccatatctatcagttcttttagaaacgacaagtaattttaggattagtagtggaaatctaagttataatttttgcctggggttgtagttaatggtgctgttgtagctcaaagatgtgttttagtttagaagcatatgtatgtgtattcatgagagtttcagactttctatgactcttttctgtttgattggttctatgtgtactagtactgaattacttacacgcccatagtcatatgatctattgtttggtactgttgtgatattcttctgtagtgtgaagtttggaagcatgcacgtattctgaaatccgaaatactcaattatatgaatggacttatttttcttctgcttcatgtgaatacccacaaaaatagttacatctgtatttcatctgagttgcgaggcagtgcgtgagcttcttcaataacgattaacgcacaagaactcattgtgcctgttcccagcctgggcctgccatcggcggcacaggtgaacggcggaaacgaaagcttcatggacggaagcttcatgccttcattacagcgagatgccgagggcggcaggcgacaaacggaaaatttcaagggctgccgcttagtccaatcctgcctgggaggcgagcgtcgcctaccaaatactccagttgtttgtgttaacgacgagatatatgggtatacgtagttttttctttctgtattttatgggatataggttggtaggcggcgccagacagtggacgctgagatgaacaacgtccagaggtggacgtcgaggtgaacagcgtccactcctggacgctattagagttagtgtccatcctattttactaaataagagctcttagggagtgtttgaggagaaggggattgaggagattgggaagatatgcaaaacgaggtgagccattagctcatgattaattgagtattaactattttaaattccaaaaatggattaatatgattttttaaagcaactttcctattaaaattttttgcaaaaaacgcaccgtttagtagtttgaaaagcgtgcgcgcggaaaacgagacacaatctctcctatctccacctaacgaacagagccttatttaccacatatttaatttgtaaattattaattactataaataaaaaaattggggtctacaggctacagctccaatgagcatcgaagtggtttaattaatgatcgatgcaataaaaaaaatgattatccgataatatatatcactgtatcgggacgaattatcactccaggattcatgggcttaattcatcgtaggattcttgtttgattaattaattagataaagtttggagtttcttcaagacaaaacaaaatgagatcgagtaatgataccgtaccaacaactagtggaacttagaacggactaaaagtttgcatttaaaaattttgggtgatgctgatgagtggctcagtcgtaggaggatagaaaatagagcctgtgttactaaacactgccatactacaggtaagtgctattggctgtctacactctttggggtgggtaatgtttgtaatttataatccctcattttttatatatatgtttttcgaactattaaggtttgtacatgaaagttatttaaaaatatatatttgtcatttatgtaagtttttatagctgatacttctaattaattatgcgctaataagccatactgttttaatcgcgcacgagagaaagttccattgcacattgaagaaattaaagacaaacttgttcgaaattgggctattattcttcatttctggatttagtgcagtcgcttggggagctggggttgtgagaggaacgagaagacgaggaatggaggcaagactgcaagatacgcgaggattacgtgcatactcttgtgttgactgctgccctagtctctaatgggtctcaaacaaaacatacacatatacatggtttggggggcctccgtcgcccctctcgccatggcctaggaacggccctggtctagacttaaccctagctcaaaaaagcaaatgatcaacactcagactataacaagccgattatattaaataactccctctaggaaatccaacaacttgaaaaaaattccacgcttttttattaattttttctttttactgaaaattttggtgcagctcttttctttctttcttctttttttcaccttctgccttttcttttctttttgtttctctcttttttttacaagcagctgttctgcgcaaggagaagccaacaatcggcttataaaattacaaaccaatttaaagaaaaccgaaaagaaaagcggctactcggtggacatagtggaatgcatgcgcatgtgtactgctatggaaatattcatccgttggttgatattgaaggagaggttggtaccaaattaaacgagatagcgatcaaaggaaaaaattgcatgcggaaatctcggcaggaaggaaatggtcacgcaacaatttcaagatttcagaaacaaaaccaccgtatagaaggctgatcttctatttttcatgtgcacatcatgtctggctgtcagtagagatatcaatctaatctcaatgataggcacatagatgagctcctctagaaacactgtagaacaacacccagcacataatcctcaccaagcaattgacgatctgataccaaccgatgacaccctctctcgggcccgatcttctggtgagaggataactctcgcttttatcgaatgtgatatttgcgacgtggctaccaaccagaacaggttcaggatgtcgtgcaatcactacaccacaaacgatgtcataccaaccgtgacgcgtggttgataatccctgcaatgcaaacgagagaacattgcaagaacaagataatatacgatctaaatattgcgaataggtaattaagcacaacgaagtagttgcaattgaagtggtagatataatctacccggcaaatcaacacaccaactattggggtctctgaatctatagtcgccaactaatcgaacaaggattagagacaaggtaaatagcacttggaaaaattcaactaaataaaacccaattgttttttaggtgtacaaagctatttatagatgaaaataaagctagagataggtgttggttcatggaggtggatagagacacttctgagatgggactagtatattacaaggcccaaggcacaagttcggtttcagcaataacacaatattattttgacaattcccattgatttaggatgaattttgatatgatatcagatgggtttgaaaggtgaggagataggctttccaacaagtactagatcatccaaatcggagttggcatgaaggcgctaggtccgttcgaagtcaatgttgtctctgcctttggaggccgaacaggactttgacttgttattggaacttgtgaaattatgtgtgtatccgatgaagtgatgtcctcatcagcaaacaaggctaaaactcgacaatggattcattgtaggaacactcatttgataactaagcatagcttcaaagaagaagctgcaaatttgtcaaacaagcatcgaatcatcgcggaacaaaaaagaatatccaatccgaacaaaatccagaaatagctaaacccaatccctaatctgaatcattttgatacaccatacaaacagaacccaagccacatcacgcccaaatccaacccacgacatcgtctccgttagcgattaggcactcggcgatgttgtgcaagccacggagcgcggcatgcagttgttgtagtcatgagcattcatgagcacggaatcctcctccaatagcttcatcatggcgtcggcgtcattctggtgcatatgccacatgatcagcgacgtctgcaccactagcctcttgtcgtcgaaccgccactgctccctgctgcttctcgatgactccgtcctgctcatctctgtcacgcccagaaattcatgaaccagaatttctaagctgaatgtgcaataaatccctgtccaggaccagccagggtacacaaacgacaattgttgacatacagacccatgtcttacaaaaaatagaaaagattacaaatgcagcggaaaagataaaacaaactaaacttggacgcttgacttctgcagcagggcaactccactccacaggcatcccttgacggtagcgacgaaaccaaccctaacaagacagctccaacttggaagatcttcagctctggtgtgggggaaaagagagcaagactgagtactacccactgtactcaacaagtcataccggaagagaaggtatgatgcaggatataaccaaaggaggctaagggttcttttgcaataaagcaggcatttaaaaacaaaagttgaaagcagtaaaaaaattgtagtagattaagcaatattaaccaatcactgtccaacgctacaccacgttgcaacaggcccaaccaaccacctgaactacaccagttcattaagctaaactagggtgagactaatcacggtgaatctagttgatcgcccataaccgcgggcacgactattcgaatagttttactctggccagaggtgtacaactgtacctagaagacaagattccacacatgtcgccatgccccgaagtatcaccatgatactgcaaagggggaaatcatgacaagaccctccgcataaccctcccctaaccattcacaccacgctaaggtttcacccccacccccaacgggcaatgggcggtcccctcttgcgccgcggtaaatctggcagctggacaaccggacaccccggccgacccaactccatcacgcccaccctcgccaccggtgcctaggaaagggtcaagctatacttcagatcaagcagttacccactcccgcttgtggtaagcacagtaagtctcccagggtttcccgtgaaccagttcttaattgccatgggtgcgaccagcaaaaccatgcacccacagcccaccatttagtgtattttaattaactaacaccattgcggtggcaccaatccaaaactatgctattagtcaaagtctatgtaataatgtgatccccatttgtgtactagttgaactaggcatggctaagcatttcctaaaccaacatctaatctttctgatacccaagttatcaatggcataaggtaaacaatatatgcgggatatttgtaaattaggtataatatgatcaattgtaatgcatgacttgccttgctctcgcactgatgagaccacagcaacgtcttcgagaaaccgcggatcgacgaaatggccgaaatctacgcgacaaacagagcacataagcaaaacacactataagactactgaaacaggaaacaaaaccatttttaatggattctagggatttttatgaatttactgagacttgaatggacttaaacggagctcggatgaattacttatgaattttagaagataaactgtgtttttactaataaagaaaagcctaaataacttttattgcgcaatattacctagggctgacgtcagcgagagggggcggctcggcaggcgggccccgcatgtcagcggcacaaggggagagggagggggcgccggcacatgggccccataggcagtggctaaaagtgggcggggtggtccaccggttggttggccccactggggcagcagcacaaggcgggggagggggtgccggctgctggctcggcacggctcaagccggccggccatgacgaggcggcgatggcgcacgaccgacgacgacggcaagcggcggcgcgagaggcggcgcggacggcgcgaaaggtggcggcgtcggccgaaggcgacggcgcacacgcggagggtggctgcgctcatgggagggaggaaaggaagaaggagaggggatcccttaccgaggcgatgacggcgatcggcgcgggaagagacgagcggcggcgacggtttggagaacggtggacggggtcgggcacaacctgggaaaggcgatgactaggttaggagaagggaaggatgaccacggtgactagaacggccggccggagttgggcggaaatggagagctcaccggcgtgcgagggaggcggcgcttcggcgagtttggctgcaagcgagcggtggccgaggtagcacttgcggcagcggagctaacggcggcggcggcttggcgcggcggaggccctagcggcgacggcgcgtggccggagatgggcagcggcggcggagctcgggtgtggcgtggggagagcggcggagtgcacgggcaagcgcggcaatagcggaaaaaggtcgagggggctcgagggagtgatttataggtgcggaagggggcggacgtggccggggaggtggccgatttggccggcgatgtggggtggagagaaagagagagtggggtgggattcaaaatgaatcccgcccatttttgggcgcgtgcgagggcgggaggagcggggaaggggcggcgacgtgggcgcagggcgcggagtgggcgcgggaaggcgggaaaggcggtggcatgggcggttgccgccggggcgcggtcggctggaggaaggggacgaccccgacaggtggggcccacctgtcggcatcccggagggagggggaaggggaaatgggccggcccaacaaggggaggctgagcgcggggtgaggcgaggtggactgggccgatggcccaagaagagggaagatgaggaaaataaaagggaaaaaggaaaaataaattccctgggatttaaaattgcactttagtgatttttaattggtaaaaattatttacaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaaccaattttttttagcaagaaaagggggaaacttcagggcgtgacaatccccccctccctcccttcatgcgtgctcaaatatgagaccacatctgcggccagcccatctcctccccatctgcaaaggaagaagaagaccaaggaggaagaaagtatgttcttagatggaggttgacaaaatattcaactacaatgacatggcttcaattttacaaaattatagtgacacacataagaccaaggaggaagaaagcatgaccttagacggaggttgacaaaatattcaacggcaatgacatagtttcaattttacaaaattacaatgacatgtaacaggtatcacagatataaaagacatttttcctaattgaccaaatttgcaatgacatagatccaattaaccatttcctttttggccccctcccttttggtctcaacaatcaacatcaaggcacagccaaaactcaggtatcttgatatcattgataattgttgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4726 - DNA, 6122 bp, Oryza sativa
  unsure (1)..(6122): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttagtagatcaatttccttaaccgaatatagcaagaatccgacaactgacgacttgacaactctcatcggctaatctcaggacttcgaagccgatgctgactctaagccgatgactacttcgggcttgccaaatttcactgttaacacattggtaagtggtactaagcagtaacacatctcattgatgttccttatctcaggtagccctattatgctctacttcctcgtcaatgttgtccctcttacgctacctatgcacctcaatctgctgtttttttcccaaaccacatcactgccatttactacctccgttacgtaaaaaaccaacataatactggtgtgacacaccctagtactataaatctgaacaaatatctgtccagattcatagtagtagtactagaatatgtcacatccggtattagattcactttttatgggacagagggagtatatatcagtgtaaaatggaaatttgctaattccggctactccatcatccttcacaaaaaaatgagctataaaatattgggaatgtgtcttctggtcattagattgtttcctagaaaagaatcaaccgattccacgtttgcaatctcttcaagatcacccaattaaaccgtgcaagcacacaagaagatcagatcaacactgttacgtagacgtcacgttagcgaaactgtcatctaaaaccatcgagagagtcaaattgcaccagttttaatagttgcgggtcaagatatccggtattgcggttcaaaatacaaactagattcggtcactagttaagatagacaaactgaacttattccattttcagaggaaaaaaatattccaattgttacccacgctacgggcccatcccacctctcaggaatactgggcctcgtgtcgtgccaggcccaatacgcgtcccctgttccaccaacctcctctcctcagatgccacgtcacacactgtcacacacaccagccaaaacccgccgctaccgatcgcgctctccagatcgattcccccaacatattagggctcacgcctcccaaagtcaaaacagcccagcccgaacaagcatttcctcgaacacttcgccctccaccaccatggccgccgccgcctccaccctcgcctccctctccgccaccgcggccgcggccgccggcaagcgcctcctcctctcctccccctcccgctccctctccctctccctcgcctcccgcggccgcatcgccgtcatgccccacctccgcgctggcatcctctccgccgcaccgaggagggcggtgtcggcctcggccccggccgcggccaccatcgcggtcggggacaagctccccgacgcgacgctctcctacttcgactcgcccgacggggagctgaagacggtgaccgtgcgcgacctcaccgccgggaagaaggtggtcctcttcgcggtccccggcgcgttcaccccgacctgcacgcagaagcacgtcccggggttcgtcgccaaggccggggagctccgcgccaagggggtcgacgccgtggcctgcgtctccgtcaacgacgcgttcgtgatgcgggcgtggaaggagagcctcggcgtcggcgacgaggtgctcctcctctccgacggcaacggcgagctcgcccgcgccatgggcgtcgagctcgacctctccgacaagcccgccggcctcggcgtgcggtcccgccgctacgcgctcctggcggaggacggcgtcgtcaaggtgctcaacctcgaggagggcggcgccttcaccaccagcagcgccgaggagatgctcaaggcgctctgaagcgtgaacaactcaagccatcctccacttttcatctcaaatctccatagctcggttcgttgcctacttctctcaagtgttcgcttcttttcctgaataataaatcatgtaataaatcatggcaccaatggtggaccgtgcagagtagtgttgtcgttttgatgtgtgaagcttctatagcgaacatagtgtgcaatttttaggtaacatatatgagtcttggccttgcactgtttgtcaggtagtaacaacttggcacagctatagactgtagtaacagagttcctttcatgttgaatggtgaggctgtgatgtgttctagagctgaataaacgtgctctggtaaatactgtcaccagatcagactatggagtagtagtaagattttgcttggttaattgggcaatggctatttttcaggatcgttcagttgagataaacatgttttgctgttcagatgagttcgaaatgccgttgtttgttctttttttaatgccgaatatatggtgagagattcagcaagccaggggtcagatgccccttggcatgaaacaaaggctcttcttgcatttgctgacagtagtcactagtcagatcttatttatgtatggatttctcaaaatttgcccatttcaccaaccctactgaaaagaacagacactgccgagtgtaacacatgttttaggcatctcgggaaaattcctcagtaatgcagtgtagtgcactttggcgactttgttataatgctttgggtgaactcgttgtttactttgttagttgcgttcatagaggtttactgtcggtgatatgggcccgggggtatcatgtttagaggcccagagattggacggaggaggctgccccccaatgccacgtggccctcccccgaggggagtgaggcctgaggtggggtggcggccactccttcccaaagactagtcggaggaggttgccccccaatgccacgtggccctcccccgaggggagtgaggcccgaggtggggtggcggccactccctcccaaagactagtcggaggaggctgccccccaatgccacgtggccctcccccaaggggagtgaggcccgaggtggggtggcggccactccctcccaaagactagtcggaggaggctgcccccccaatgccacgtggccttcccccaagaggggtcgggcccgaggtagggcggcggccactccctggtcgagactagagggggaaggctgccccaggcgccacgtggccctcccccgaggggggatcgggcccgaggtcgggcggcgaccgccccctctcgtgactaggggtcgggctcccccaaccccctctctaggtcatcacgtacggtgggttaggtgtccgcctataggtgtccacttacccgcatttatggcgacccgagcggtcgcgccacgccgcatttaatgtgccgtgcagtatactcaaccggtctgtgaccggtcgaatcaccgatgagactgggtagtgcgcctgtgcgctgctcgtgtgtcaggcggcgtgcagcctaacatgtcctatcaaataatgatggtgagaggttctcatcctcttatcccagccggagtcggtcctcccgccctggtcaaagctaggctcccgtttcccggtgtaataggagcccggaagtcttcacccattaaaagcagctgacatgggcgcccctcgtgtcaggcggcaagatttgacaggccccatcatcaagatgacgtgcgcttgcttcccaagtcaagagataagacaggcatttaatgcaaaacacttctttaccggagctaggtttttgggcccatgtggtaaccccttgaggtatgaaaggagatccaggcctagtaaaagggggagggatccgggacgatccattttgatgctctagagcagtctctagccccgaatgatcaacaccacattttacttcaacaagaggatcttgtaatccttcacttaaggagcatagcacaggagtagggtattacgcttcttagcggcccgaacctgtataaatcccttgtgtctcttttgcctcgaaaacctcggatctcacccgctgcccccggccaaaccaaaaaaggggatctcacgatctcccgctagagaggatcactcctcgacatttacattagcatgccgtgattcaggcctccgtgtagactacttctgcattcttttctccacttcaattgatgaaacgaaaaaaaatcctatttatctctttagttattgtctgtccgaattaccctcctcaacttcaatacaggacattataccaccaaacttcttaaacctaatgaactaccctttgatcccagtccatgtaattttagccctacctggtagacactcgacagttcagttagcaaggttataaagatttcaaaaaaggtatagttgatcccactcgttagtctcttattcctcttaattctctctcaactcccccctctccccctcatggaggtgtccctagagtttagtgccctagaacccatggcagggttggagtacagaggtactccctccgtccaaaaaaaaaaagacaaaccctgggtttccgtgtccaactttgactatccgtcttatatgaatttttttttataattcgtatttttattgttgttagatgataaaacatgattaatattttatgcgtgacttatctttttaattttttttataatttttttaaataagacggacggtcaaacgttgggcacggaaaccagggtttgtctttttttttggacggagggagtagctgtgtagctcggtgtcgttgatccctgtggacgagctgaagccccaagcagtggcacttgtgtcaacatcaatcctgtcggaggaggagcttcatggcggtggtggcgcatgaatgggggtggttctaggagagactgctttaggaggggagcgtagttaggtggtgccgacatctacatgtgaggatggatgaggggagcgcaaacgccggcattgccgaggaggaaggggaggcgaggctgatgggagaagaggttgcacatcggagtacgaagaagaaagcagagaggaggaagaagactaggaagaaccgaaggggcggacaggtgtgcccattgtcattagggtaccacaataccttgggagtactgaagccaccctggagtaggcggtcgatgggtggggctgttcatccatgggttgaaagaaacctgcctaaccggccgtattcattttttctcgtaccatatgattatgaagtgtgttaatgtgttattggtacctagacgctgttctagaagacaatgacatcgatgctcatccgtgcgttttgatgtaaacccgtgcttttcttcagctaattttttcttcgctgccttcgctgcacaaaggcagccaggacatgggccttcatgggcacgaaattggcgccctttcatccctggaagacaaagtagacttattcctttatccagcagcaatacgaaagcccattaaaagatcagcccaaagaagcccacacgaacaggtataggtgcaatgcaatccacctcaaccctaatccccatccatttcctgccgccgcactcctgttgcgcaatcgcgtgagtaaacaacaggtagcgaccgcccaacgccgctcctcgcgcggtcgcgcccaacgctgcgccgcccattaggccctttacagtgcaacaccgtggaccggtgctccagctcgacacgtcggattcgagcttgcgtggcgctagggtccgcgccccagcagaggacctcgctcccgcggagggaagtgcgattactccctgccgcgagcccacgcgaggcgaggaaacggcggcttttctgcgctgtggagcgcgttgccccgcccactcgtgccctcgcggcaacaaatcaacaaatcgcagcagccgtcctcttgcttatgctcctcctcctcgcagcg

SEQ ID NO: 4727 - DNA, 7062 bp, Oryza sativa
gccctccgcgccctcgtcttcagccagaactggaggggccgtccttcgctgccgctcggcccggaggagaggagagccagcgccggcggagggaggaggggagagagccggtgttgagactgagtagtagttgggggatttggataaagtagtatttgtgggtgaagatttacattgttctctcgattttagggtggttactgtaaaatttggactcctttgcaaattgataaacacatgagggctgaaatggaaagttacaggggctgaaatggaaaagtaagtcactcatgaggctatttgcaccgtgggaataaaaaaacttgaatccgggtcttcagcctatgtggaatgggatgagggaacactgcactgtgaaaagccttagttccttgcgcccagcgccgcaccgtgttgctgtgccctcagcctcggcgcacattctcctctcctattcctcccgagttgaagcctgaaagggtagcctcataccctaaaaaaagagaatgttcccgtgagtccaagactgacgccttttgttgattccgggcccttagatgcatgatcagatgcgtgatggttgagattgtccccaacgtgcaggtcaagcacagctccaaccctcttcgctgcttcgtcattgccatcaacaagcttcgttgtgttgtccaccatcgttctctttgctgttgtgcatccaacgtgcggggccccgatcgggttccgaggacccgctagggtgagggtgggggcgggagatttcgccctaaactcccgaactcctggtcagggccgggggtggggcgaagaatgcggggacagggccgggggcattctacctccaccaggccccgactcatcccgttgccatcctattcacgtgtcgctatcgtcctcaccgctcaccccattgccatcctattcacgcgtcgctgatcgtcctcaccgctcagtctcttacatgcaaatgaggtggatgctgcaatcgggaacttagtcgagtcgctagatgtggagaaggaagatcgtgagattaggaattcgtggattggggcatgggaatatgttgtaatggttcttttttgaacccccaaatcccaaattgggatcgatgtgtggataccataggtgatgcttaccaaccttcagtttggaggtagtctttaaaaaagtttcgaggtggatagcacaatgtcgtctcgtctacatgcactctttgcaatccatatggtgaacaatgccgtcgtttaactgaagtttcaaaccattgacacgacagttgaaagtaacttcaataatttccaccattagcaaccagcaccgccgaagatgtactattcgccgctaattgccttccaagaagccattgttaacgtgatgagctctacgttttggcaaacttcagaaaccaaaacagtgaagcgttggtagttatccactacggatccgctttggatgagcttatcctgtacttcgaaaggccatatatatagccacatcacagatttccccaatgtacatatcacggaaaacattcagtatttctgatcactggaccatccagaccagttagttttgcgtgccatttcaagactagtatgacgaacctaagtctgcaggccagcaagcacccactgcagcaaaactggttcaccacgtttgtcccttccaatgagaattttttttatttataattttttttattaaaagttttacaaaaataattttccattttgaaaattgacggaaatagtcgcctaccgccctctgggaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacgataggaccgcgaggccgtgggtgtaccggaccagctgaaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttttgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcctatcacacccaattgctgtcaatatctgacctcggtatttacctgtcataaaagttccatctatgcatagaacaggtcgacaatgcacaaaagcattgatgcaagcacccaatgagaaaaaggctctttgcagcacactcttttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcgggcccccgcacagtgcaaaatcgccctcgcggagggcggcagggggccggctgcaaatttcatgccccccctcgccgcccaattgca

SEQ ID NO: 4728 - DNA, 19335 bp, Oryza sativa
gagggcggtaggcgactatttccgtcaattttcaaaatggaaaattatttttgtaaaacttttaataagaaaaattataaataaaaaaaattcttccaatgacgggttggtagtctcttatatatatttttttttcgccaggacagcggcaaaggaaacgcctgaccaattatattaagaaaaataagaagatttacataaaacaaccagcatggttgttgtggacacaaacagggtttcccaaactgccggggccggggttaccgcaccccgacggtaagcacggttatcgtgcggtaaccacgttaaccgtgaaaaaccgtacaaaatttatcaaaaattcaaattattttttaaatttatttgaatttaaggaggttaccgcagtatttatattaccgtacccccacggtaagcccggtaactggcggtaaggtaaaccctttacataacccaaccctagaataggaaaaggttttttaccggtaaacgcctaattacatgacacaactaggataacatatgtcttatctctcttcgttcgtgatgcctccaaagccagcagctcaatgttatttacaaatgtattttttttactcggcctttacatccaatcgactatataaagctatttaaattgagaatttagtctcgcaaataatccaatttaaaattcgctcctaacatgatacctccaaagccagcagctcgtcatggccaccattcttccgatatgcactggaagacctcgatggcgatcttactggctccttcgaagatcccggtgtttctgtcgcgaattaaatcatccaagtaatcaagatagtttgtacgtctaagattttctactgtgatgttttgtatggcagcctgagaagagtgccaccaagtttccatgtcagttgacatatccgggctccgaatgaaatgtaatcgggtgcagatcctatcccacacttgtcttgtgaaagcacaggccatgaagaggtgatggcaagtcgttggctaaacaccacaaagagaacagacttgttcttgaggccaacctcgccgtgccaaattctccgccgtcaaacagctcctgccgtcccgcgtagtacaagatactcctccttaaaaaaaaaatatatgactccgttaatttttcgcataacgtttgatatgttctattatcaaagaaaatatagtattaacttatagtttcatatatttatattaaatttttaaataagacgaatgatcaaacattatgagaaatatcaataacaatatactaaatttttgaataagataaatgatcaaatattatgaaaaaaaacaattatgccattcattttgaaaggagatgttacataaagaactttcatttcacttcttaggtaccttgaccttccaaaggaaaattagcaccgatggagagagttttatcaatgaaaaacattggtagtctctatgagagtatgatcattgtttttaattatttatttgtaatagtataatatgtgaatatgttttcatgataaatctactaataccattttcacatatcaaatattttttggttgcattttactagcactaggttcacattttgaattttgtctcaatttttttttcgaaatttgaccacactcattctaaaacactattcaagtataagcatttcttgccttccaaatttatacacggccatttgccctatactacactactaccaaacacctctcgtttaattattatccaattttaccctcaccatcctcctacatctaattacatcatatttaaaactaaaagggatatatcacagttttcttttcataaatttagcctccactaaacaacattccgcaacagatcagggaatacttttggtttgacaacacgacgagtaagaaattaccacggcaccactacgacgacgcatcccactgtaccactcgaggaccgaccagaccatcttgcgtgcggatttctcacctccctgcagactgcagtgaaggacaagatcttcacggctgcagagcgggtaccacccaaatcacaggaaccgtacatctgcctcatatcagttacccatagcatagcttattaagaaatacaaattaatttattgttaaaattgttgtatattttttttccgtagtaacttaaaagccgatattaaaaatatcttaaaattaactttaaaaaaattaaattttagttttaactttagtttattaggtcaaccaatagggcgatcgaccaaaaaagagaagccactctgctctggcattttgcctgctggatcgtcgctcccggccataacgggcaaacggacagggcttactacaaaagcatttcaattttgaagcgagggaagcaagcaagcaaaaggatggcactcatcccgtccactcagattcaatccatgcatgacaccgtcgtagctttcaaatatgagctcgcggttacctagttaattaaaatcaacttgtattaatgttgacgcccttcgatcatttagcatatacgtactatacatgtatctaagataggtaaggtacaacatatactgtgcataaccagtggcggagacaggataaagttatagcgggggctaaactaaaatgaccaagaacaactaagagagatttagggttgggttaggattttttagcctttttagtcttttgggccttctaacaacctcaaacaaagtctatattagcccctcatctataaatatatggattagaattttagagggtaggggggtttcaagaccccccgcccccacgctgtctctgcccctgtgcacaacgctttggagaagttgcaacatgcacaaaacccattgaagtttggtttcatggtatgaagtatgcctgttcaaatatggcttgtttttggttgcaatgatgatgaagttactaaggctgggtttagtaatctctctttccatcttccactcaccagtctttcataagcacacttttactaaattactaaacgatgtatttttaatataaaaattatataggaaagttgtttttaaaaaattatattaaaatttttaagtttctatagctaatatttaattaatcatgcgctaatgtgtcacctgttttccgtgttagtgagaaaaggttccaaaacctttagattctaacgcatcctaagggtttcaatggtgcaaaagaaaagacctcctacaacatatgtaacaagatcatccaaagggttgagtcttcttagctactccctccgtcccaatatactacaacctacccatataaaacaaataatagccaaatataattaatagccaaatatacctaattaaatctgatatatatttgctagattatttctataagaaagtgtttgctagaaatttgctaaaatcgacaaataaaggcaagtgcggcggcctcgcgctgaaggtgcttggatggtgatgcctgctattaatggtagggacgtaatcataatagtgggccgacgatttcaagcgaaaacccagtctttttgaggagcggcagtcccgatgcttttgggcggcgtagtccccccctcccaccccctcccgggggtgggggctttcgtggtatctctcattctttctctagtggaatccttcaggtgaaaaatcacatcctagtttcctaatggtgagcgacgacggcatcatctgcgtctctcgttctcttcatggtggaattctttggtcgaaaaccacatcctaattttccaaaagaggtgacgacagtgtcacaaccttcgtggaggcgttgtttgaaggttcgtttctatcaaactcttctccaaatggattgttctcttaggacgacaccatagccatcacaagaaaaccatgctggtgggagatcagatctattcttatctttcaccatatccccctccacccaaaggcatgaatggattttcattagcagtgggtgcttgtgttgtaggtgcatgtgcaacatagtttggtacttttgtttttcttgattataccctaccagtgctttggtctttttttctcactatattgatatgaaacctcgtactatcacacgtgaattgttttagaaaaaggtaactacaatacaataatatctttgttttcaagactactccattattgtagtttcaaatttaatcacacaaagtttacatacataaaacatatcaaaacacaataatgaaattttggagggttcgaatcatgaggtaaaatttctattaggtccgccaggatgaatcgtatatattataagtaagagatacgatagaaatatgttagatcaatatatgaaaggcacgttagtaacattgtaccaatcttgtttcgaacacatttgaaatatagcataggaaatatttcgttctggtcaaatcctgtagttgtagttcttaaacacaagttacgtcatgagtacagccatatcaaccacccatatcaataaatccaactaatactataaatgccataaaaatgcaattaaatatgcataagatgaatctatatctcaattactcaatactagaatcagactagcattaaatgaccatattaaccatatcaaatctggtggatacaaattcaataaatagagtaatatcacgagcaaatcctcaataaatgatatcaaagctctaacacatttatacatttaaaaccctcgtatctcaattactcaaaattgcaatcgaatttaataggcgcattcacacaggtagaaaatcatctgtccacatttgcatcatcacacttcgaaatcacaaaacccccaacccaacccacaaccaccccatctcactgacctgcgggccccatgagccagacagagccacttacagctgggccccaccatcccctcccctcccgcttgagcctatcctacccagtgctacagccgacggaagccggcactctcttcggctatttaatccccactcctcgcccgcttcgagctccaccgccaccgccaccttcttctcgccgccggccagccaccgccgccgccgcattccgcgcctagcgtgttctcgcttcttcgtggtctcagcatttgccccgagaatggcggcggcgggggcggtgttgccggagcagatcgcggcgatgtgggagcaggtgaaggcgccggtggtggtgccgctgctgcggctgtccgtggcggcgtgcctcgccatgtccgtgatgctgttcgtggagaaggtgtacatgtcggtggtcctcgtcggcgtccacctgttcggccgccgccccgaccgccgctaccggtgcgaccccatcgtcgccgccggcgccgacaatgacgaccccgagctcgccgacgccaacgccgccttccccatggtcctcatccagatccccatgtacaacgagcgcgaggtaaccaaaattattcaaatcaatccgccatgcatgcaatgcaaactcaaataaaaaaaccaaaaaaaaaggaaaaaaaaagggcactaaaaagttttttgggtttattttttgttttttttttggggtggcaggtgtacaagctgtcgatcggggcagcgtgcgggctatcgtggccgtcggatcgggtgatcgtgcaggtgctcgacgactccactgaccccgtcatcaaggtgagagccagcgtttttttttcctttttcacttcatttaattacagcgctatctgtccccgcgtgtcagtgacacaccagtggcgttggtctggtccaaggagtgaaattaattgcggctgtctgtcactgacagtcgccgctgcgtggtggggccacaccatgccggcatgaggcgcgtcgtattcttcaaaattttttcatcgctaagagctttcaaacttttttcatcacgagagctttcgaatttttcacacggggaaaaacgtattgtaggtacaaacaaattagaggccatgtctctgttgtcgtagtcgcaagaacaagcgagtctactttcactgaggaatttttggctggctgtattattttaaccccgagaaaaaacttggatttttttttgaggaaaatattggaagtgttcttcttttcttggcctagctagggacagggagggagtgacgtgatgcatcatgcagcgaatttatatttttctggtactagtactccattttacacgaaagttcatgggcaactcgactggctagctccttgtcccaccgcacgactcccgaggtggaacaatctgaaccataccgcatttaactagcaatcgttaccagaatggtttactgtagtagtaattaactagcagtaaaaataactggtggcaaaagaagagtcaggattaaatttagttaaaagccacttaattatagagcttgctaacaatgagacgatgagtgcaactgcaggagatggtgcaggtggagtgcaagaggtgggagagcaagggggtgaggataaagtacgagatcagggacaacagggtggggtacaaggccggggcactgagggaaggcatgaagcacggctacgtccgcgactgcgactacgtggccatcttcgacgccgacttccagcccgaccccgacttcctcgcccgcaccatccccttcctcgtccacaaccccgacatcgccctcgtccaggcccgctggaagttcggtgagtcagaagtcgtagttttttagataatagattaaaacccgacctctacatccacacacaaccagaagtccatagatgagtccaagtcacatttttttaaaaaaaaacacaaagtggctattggtaaaacgattttagtttttgaatggttgccttggctctcgtgttaatggatttgtctttgtcagaagaattgagtggttggttaggtttctgaatggtggtaagcagatataggaacagcataaaaatggcagttcaaaagggcccggataaagcacatgcacctaggagtacacacatactcctataatcaacagtgagtgcagcagataggagtatgttttaggaaatgagtgcactgcattagtttagtgttcacggcagttatagtagttggagataaggttagttgttgaagccaaagcatgggagcagtacacttggaagctggaccttggtttgtgatttgggggatcatgtgcacctgtgacttgtaactgtagtcctttggaccatgacattgacatgtgcgttgttctgaaaaagctggagtagtatagttaaatcttctgcatcactattggataaggccgagtaaaaattgtcagtatggttgactgaattgtttgacttatctttggcattgatgatataatgcccttttttaactataatatgatataatgtccttttttttaactatactatgatataatgtcctttttaaactatactagtgtagcacactggccttgttttggacttttttcttttggcatggtgatgacatgtttgttgctgctgacggtggtgatggcgtgtgagcagtgaatgcaaatgaatgcctgatgacaaggatgcaggagatgtccttggattaccacttcaaagtagagcaagaagtgggttcctccacacacgccttctttggcttcaatggtaaaacttgatctcaattcatcttgtcttttttcttctctcttgtggggcattatgtgtatccatttctcagttccatgattctgcctctccttctgtagagtacatatgtttattttacttaataatgagaaactgtttcgtaatctttggaaagaaaaagacatgttaaccacatctaaaaatcatatgcaattgcatcattctagtttattccttaaaaagtacaatacccagttagatcttacacaaagcagaaggaaagagtagtgcaagaatataacacatgcacaagattttcaatgttgagaacttattttctctagtaaaagtcatatttagcagcatattttgttttaccctgcaaaatgttatgtgaatagggactgctggtgtgtggcgcatatctgcgatgaacgaggcaggaggctggaaggacaggacaacagttgaagacatggatttggcagtcagagcaggcctcaagggatggaagtttgtctaccttggtgatctcatggtaaatatgcactagtagcctaacaattcatgcaatatccaatgcatcaatttgcgcttctatatattacattgttattaagctatataaggaaggatgtaactaacctggtaatgttgtttgaaggtgaaaagtgaacttccaagtacattcaaagcattccggtatcaacaacacagatggtcctgcggaccggcaaacctgttcaggaaaatgttggtggagattgccacaaacaaggtcccttgcaccaagctatattatggaaatattttataagttataacacacatgcatcttgttgctaacaagccattgatcttgatgcagaaagtgacattgtggaagaagatctatgtgatctacaacttctttttggtgcgcaagattattggacacattgtgacctttgtgttttactgcttgttgtcccggcaacggttttaattccagaagttgagataccaaggtggggttacgtctatttgccatccatcgtcaccattctcaattctattgggactccaaggtgccaaatcttctccatagctttgcagttttactttcagaatatgaatccaacctacagtacccaacctacagttttacttccagagctttgcagttctgagcaacctaaaaatttacatgaaaatatgcaatgatgcaggtcattgcacttacttatcttttgggtcctcttcgagaatgttatgtcactgcatagaacaaaggccacgctgatcggcctgttagagacaggcagggtgaatgaatgggtggtgaccgaaaagcttggcgatgctctgaaattaaaattgccaggtaaagcattcaggaggccgcgcatgaggataggagacaggtacgcagtcgaaacattttagtcctgcattttccaagttccaatccttgcagctaaactttgatcttgaaccagggtgaatgcattggagcttggtttttcagcctacctgtccttctgtggatgctatgatattgcctatgggaagggctattacagtctcttcctttttctccaatccatcacctttttcatcatcggtgtgggctatgtggggacaattgtcccgcactgattacagaacctcgatgaggctatccatcttggatcaacgaccggctctggttctttccagtctcatggtgttaggtatgcaacaagatgacagatcaagcaggcttctcctgtgtgcaagtgcaaagtttcctgacaacaatgaagtgtaaaagcactgcaaaacaagcaatagataaggcttttagctgctaggaatatgctgttatgtgcattacaattgtgatgatctagcagtctgttcagagtctctgtgtcaccttagcagaatctgtagtgggaaagataggagttgttaaaagctttatattttctgcaaacaggaaaaaaattggagtttttggttttagcatgtagctttagttctgggaacaggaagaaaaaataatatgtattggttcctcaatatgctcacctggtacaaaagagaggctgtacatctttgctttaacttttctttctcctaatgttcaagtgtaatctgggaatatccatttgagatacagtattttgaggagaaacagagatactgacacagaagctgacctctactgttccatctcttgtctcagactctctttgagttcaccagtcaccacactgatgattctgtcatgtgtttcattcagaaacttcctcttcacatggtacaatcagtactgtctgtctgcctgtctgtatttctgtctcctggcaatccgcatactgacatttgattcttactgaactgctgacattcgaggatctgcatgtgactcgagaacagtgaggatttgtttcatggctctgcaagtctgcaaggatccaaaccacagactaggaccagatgtcattcaaagtgttctgaatctcaataacatgaacaggtgatgtgatcttgtgttacataatgctagtattctggaagcaaggtcgtgatcagtgactgggatagagcaaaagggtaaatacattacaatggtgtactttcatgtcgtttgctccggaccttctcccatatgtttatcttggcgccaattttctcatgcatcagatttctccaagatgcaacttttgtagttgcagcccgaacccggctaataacagatcaaaattgcagtgggtctagaacaagggcacaacagttctcaagttgcaaaaaatctacaggccctgtgatctctttgaaccctctttgaaagaggatgcaaaatttgcaaatgttcatgaaattgagcgagtgacaactgacaactgacaatcgatcatttagcaggcttgttgcttcatagaagcaacatctcaaatgatgaaaatgcaatgccacttcacatcaccaatcagctcagctgcaatggctggcatcatctccatccataaccggaggcacggactgctcggcgacggcggcggccaacgcgttgcaggccgcgtatatcgccgagcgctcgtcgtggtacgagtcgccggcgaggaaggtgtgccttttgccccggacctcgacggcgctccaggccggatccttcttgattcccagcgaccgcatcgcctcgtgcgcgccggcgacgctggcccacatctcgcgcgcggcgtacgcgttcgccaggacgacgtacttgccggcgttccccggctgcagccggaagaagcggcgcgcggcgagctcgaccagcctcacgtcgccgtgcttcctgccggcgccgagcagcgcgccccagaccaccgagtgctcctggcagtccggcaggttcttgacgagctcgtaggcgtcgccgagccggccgaccctggcgagcatgtcgaccgccgccgcgtagtgctcgcccctcggcgtgaggccgtagcccgacgacatggacgagaggtggcgcagaccctcgccgacgagcccggcgtgcgcgcacgccgagagcacggcgaggaacgtgacgtcgttcggccggagcccgtccacccgcgtcatccggtcgaacagcgccagcgcctccgcggcgcgcccgtgctggccgtgcccggagatgacggcggtccacatggtgacgttccgcgccggcgccgccgcgaacgcccggcgcgcctcctcggggctgctgcacttgaggtacatgtcgacgagcgcgctgtcgacgaagacgttgccgccgccgacgcgcgacttgaccatgacgccgtgcacgcgccggccgtgctccagcgcggccagcctcgcgcacgcgcagagcaccgacgcgaacgtgaactggtccggcctcatcccctccgcccgcatcgacccaaacatctccaccgcccgcgcctccgcgccgccgcgcgcgcacccggatatcatggcgttccacgccacgacgctcctctgcggcattccgtcgaacaccttccgcgcaacaccaagctcaccgatcttgacgtaaaagatcagcagcttggtgacgatgtagacgccgccgccaaaccccaccgacaccatgcgcgcgtggatcctcttccccatcctcgcgtcccgccggttcacgcattcctgcagcagaagcgcgtaggtcccctcaccggggcacaccgtactccgccacaggagacccaccgccctagcgagatcgccggcgacgcacagcgacctcagcattcgcgccaagccaacggagcccatgatccagctgcccaactctcttctatccgaattcgagctcgctctaatggcgtcgcatctctgcgccgctcagattagtagtgtatacaagatgaaatccgagacctaggagaaatcaggctactacatttacaacaaaaactctcgggtcaattacaagatcgaggatatacaagcgaaacttcatttttgtttcgattcgtctcctgttttgtctctcttcttgttcttctatctatctatggtggtttgattttttttttgtattagacatagtaaatcatgccgacctcgagggtggaggcgtgagggatggtgacggcgtagttggggccgcggctgttgcggcggaggaagtcgtagcagaagttgatgaccagccgccggaagaagctggagccgctcttggccttgacgtaggagtggccgaggatgaacgccatgccggcctcgcgcgcgtccatcagctcctgcagctcctcccgcacgccggcgtccggccgcgggctcgccgccggcagcacgaaccgcaccctcttcctcggcgccaccaccaccggcggcggcgacggcgacggcgacatgatctcccttgcgccgccgccgccgcgcgagctgcctctgccgctgccgctgccgctgccgccgacggtgtcctccgacgacggcgcccccgcgccgccgtcctcctccatcatccgaatgctgccggaggggatgacggacatccgctcctcctcctctttctccgactcctccgcgccgccgccgcagacgttcttgggcttgaaagaggccgcggcgtcggccgcggcggcggcgccggagcggatgaactccgcgacgctgcagacgagctccttctcgaactcctgatcgtccttgtgcacgtcgtggtagccgtacctgacaatgcaccggtagattctgtactccttggggccaattcttccgacgaggaacctctcctccggcgagacatgcggtatcgggacgttcttgatgcagaggaagatgagcacctgatcatcatcaagaagaagaagatgatgagcactgtaaccaaaattctgaatttctgaacaatgacaacaacttcagaaggcgaggaatgatggctgatgagcaagattacttgatgaaatgcaggtaggttggtgacgaaatgcgagaagattgccgggatcccagagtcgagctcggtgtggatgaggccgatgccgcggactcggacaatgccgaggttggggctgaggccaaggagccagttgatggagaccttgttctggagatcgaactcatacttcttgatggtgccatagtgccagatgcacattatcgccatgaagatgaaggccagcacaattgggacccaggctccttctctgaacttgatgagtgatgctgagaagtagagtgcctcaatggtgccgaagaagatgatgaagccgaatgcgaggaagatgctcttgtgccaacacagaactatcaccagggacatcagacatgtcgtgaccagcataacggttataaccgccaatcctgttcaaaggacaactattgcatatcagacaaattccttactcattagcttcagtatgcataggtaattcgaacatggaataatcaggtggtttgatatgtcaaaaactaaaacaagtggtacatacctgacgcattgcccaggtgttttgtgtctctgaaaccaatggtaatagctaagcacagtatcatcaggatccaattgatctcagggatgtaaatttgcccgtgtactttgtcagatgtgtgaactatcttcacccgaggaaagcagccgagagcggtgcactgcttgatcattgagaatgtgccagtgataacagcttggctcccgacaactgctgcaagaatggcaattgccagaactggccacctaattttctctgaggatggaaaacttttaaatattaataaacagtactaggagaatgatataatatcgatttcgctgttgatgaaagatctggagaacatgacttgccaggcacagacacatagaacccgatcctgtagtcactttcaatgatgtgatgcttacacagataagcagcttgccccatgtatgcaaggatcaaggatgggtaaaccatgcaagtaaaagcaatctgcaatcaggaaatgcttatcagagacaaaactattgaccgcatgtccgcatattgctactatgatgaaaccaagtaaaacaaaacattgagattgcactctatttcatcacctgtatcgacagctgattaaaatgccccagatctgcaaacattgcttcagaacctgaaaaacaacactcaagttagtaaagttgtacacttcagagatcattggcatatggtagaaaatggttgttgatcatagtaccagtgatacataacaatattcctcccagtgacatccaacctcctctctgcgtcttcttcaaaaacttgtacatataatatggagataacgctcgatagacattgggctcccaatgcacgatattgtaaacaccaatcatgcttatacatagaagccatgtaatcacaattggtgcaaaaaggaaccccacccggtgtgtaccatagtgttgcagacaaaacaggcaaaccagtacaaaacaagcaataggaacctccacatctgcagattcaaatcagtaaaaaaaactttgcacagttagtaatgggttaaaaaagaaacaaaacatattagcaaaacaagaatcagaataaaagcacatgcttaaatgattaaaagtcaaaatagagtttctttactccgcacttcagaattcagcacttattttattactttcagcatgtgtagcttccattttccagaatttccgaaccttattaccactagctgaccatatttctgcccagagtgaactctatcctctgccaaagcccaagagaatatgaactgaacagatacagtaatttagatgatgaccggcttatttaggaatcgctcaaatcttttctttctgtttcccactacagttcttcacaagaatcacaactgcttgagtagggtagttccatttattgtagtcatcaatgctactagataagagtattaatcttctccagttcgtaggctaatagcattatagcaacaactgttaggcatacattgactaacaacagtacggagttgattgttggtgtccatgcgacaacgctgcgttgctcatggtcattccctgtcaaagaccttcctaaatgaatttggcacgcaattgatcatctgatatctgagccgataagctcgcacggaaacttccaaaagtatcaatcccattgaagcaaactgttcagacttcatcagttaacataattcctggttttacgaacaccaaattgcacagaatccatctcttgcgtgcatcttacaggtaaaatttactcgaattgtggtgcactagtatgactgaaactgcacacttttttcaactaaaaaaacaagaaactgcacccttttgagtttgaggtggaccctgaattatctaaaaaaactcagaacatgatgatccaggaaacagtagttaacaagatgaggaagacaaatctacaatcatatcaaaagacagaaacaatggaagggacaaaggcatggttgggtgttcagatccttacatttgtgctgatgcttttccatggacaattccagcccggataccgccgagaacactgcaaaaacagaacacgccatctgaaaatcagcacacgacaacccaagaacacaaacaagccagcaaatcaagcgggggcgcgcacgcaccggagatggccggcgtgagcacgccgtcgccgatgaccatgcacgtgcccaccagcgccagcacgaggagcacgcgctgcagcaccttgtgccgctccagcagcctcctcacgccggcggcggcgccgcctccgccggcgcgcccgctcagcgccagcgcattgccgttcgccgcggctttcttgtcggcgcccgcgtccaagaactggtccttgtcgcccggctcgccgccgccgccgccgccgccaggcgggaggagcgcggcgcgggcgtggcggcagaggagggagtagagggcgaaggtgccgccctcgccgttgtcgtcggcgcggaggacgacgcagacgtacttgaggagcggcacgagggtgagcgtccagaagacgaaggagagcacgccgaggatctcctcgttggtctccgagtgctggatgtcctccgcgaacgccggcttgtacacgtacagcggcgacgtgctcaggtcgccgtacaccaccccgaggctctggtacgccaggctcatcgtcatccgccatggcagccgcctcctcttgctgctgctccctccctgctccatccatccacccacccaaatcaaatcacacgcgcacacacacattagcaaagaatccaagatcgcaccaagattcaacaacaccatgatcaatcaatcaatcacgaccaccacaaccctcgcaaacccgacaagattagaccattaaccatcaaacatgacacgacctccaccacccaacccataccttgcaatcgggagaactcggcgactcaggatccacgggagacgggctcttcattcctcaatcccaacacaagaacagaggaagcaaaaccactcctactcctactcgtcctacagcagctacagggtttcttggctctctctctctctctctctctctgaatccctgggggtatcaaatccaacgattcagaggagacggtaatggggattattaggcggtgggaaaatttggagttattgaggtttttaagagggtcaaagcggaagcaaaacagggggcactttggagggaggcagcattggcgtggtgctgctgctgctgcgactgtgaggcagggagggagaagcggaacaatgaagaagaagaagatgagaagcagcagaagagagagagagaagaagagggccagggaggattggaatatttgggagtgggacagcaaaagagaggggccaacaatactgggggaaaccgaaaaagcagcagttttttttttctactgcaaaatgtacttcctgtttggccggctcctctgcatagggtccttgtgtggactcacaagggatgaactcttgtttacatcctgctaaaattgtactacttcctccatcccaaattaggctgtgttggataccaaaagttcccactccccatctcgttttccacgcgcacgctttttaaactactaaacaaaacagtgtgtttttttgcaaaatatttctatacgaaaattacttagaaaaattatattgatccattttttaaaaaatagctaatacttaattaattacgtgctaatagaccgctttgtttttcgtacggagaagatatgttcccatcctcatcctccagtaccaaacacaaccttagttatctttctaccatttaatttttgtctcacagtacttgtcacttccaagtattacttgtctcatcaatcacatatcattcaaacttctgtcaaccaaccttctattcttaaaacataattttttttataagggtattgtagttttttattctaaaccttagaatatgccaaacaattttaaaggaaaagcaatttaggacggtggtagtatactctatcggtctcaaaataagtgcgatgtgatatatccaagaattataaatttagataggtatatttgaaaagaaacacaacctaaataagatagttcatcaaagcatgattaattaagtattaaaaagacttggaaatagatcattatgatttttctacagtaaaatttcaacaaaaatgtttcaaaaaaaataacatcgtttaatagtttgagaaacatatacgcaggaaacgagggtatagtgttcttaaaaagttgtgatgatattaacacattattttcagtgatgatctatttataagaaactgacaattaatgttgtgaaaacgggtttcatacttctaatagtagacgatatcaggatttatgatttgtgtattagtttggcagccataatgcggtttctagtagtagtatgatacgggtttgggattatgtaattgttttctaattaattgaaaaaaatgactacctctttcaatgttatcgtagtaattattgtttattaatttaaaataaatgtattgtgctattaggagacatttattaggtggcatagatagcagggcaataccagtttcatgtagatgctctataaatatagaggttctggaattagaggtactattacattcatatgttagttacacttgtttattggcctgaagctaattttagtgacaacaatagttcccagttggcatatatttactgcccctaaactggatcagtatgggagatagtaacctagttgcttttgtttattgttggaagcatggatttgtcatgtgaggtagatgtttcctttgtagattaaacctttttagtacgagtactgtcaatcattttgctattaatgcatgaaagtaagattcaaagtactatctactagtttagaataaaactcaagaaagcatctactcctgcattttacccttactatatgtctatatcccgcgggttattcttgaagcgcataataacataagaaagtcaacaggtgaaagttttctgcataattttttttaatacaatgcaatgctccaacctttcacctgttacatactatattttattttttccatgttcatatgttgttggggctctatctatataggcattttttgggtcttttttccacatctaatgaaatggctcacaaagcttttgcgttcttgggagaaactccaatcatttgaactaagactgataagctctgagaaaaattaactaaacaaccaaaaatatttaatgagcaaaacttttatacatttgttattaacgatttgaaagataatgttaaaaaaaacaacgatgaaatgcatacatggcaacctttgaatatgattttagtgattagggatgcctctttgaatgtgttttagagaacgaacttatgtgttatattgtctacagcttgaaagaggcactactataaaacatcaaataggtgtcaccactataggtgccggtagtgctaaaaccggcaccaataggccttttcataccttcgtgggttgaaattagaaaaaaaggtatctttaagtaatcataggttccgttctaaataaaaaccggcacctattatattttgtgttggttttttttaaaaagccagcacctttaatatattataggtgggaaaaagtacgaattaacccccccaactatcgcggtcgtccgaattactcccctgaaccacaaaaccggacattcttcacaccaaactatgcaaaccggacgaattaccccttggatccaatccgcggtggttttggtctacgtggcggtacacgtggccatcccagtcagctgttttctaataaaaaaaattgggggacccgcatgtcataggcttcgct

SEQ ID NO: 4729 - DNA, 7272 bp, Oryza sativa
tgcagcccgccactcgcctctccaccgccgcccgcttcgctcgcctctccgctgccgctcgtctcgcccgcctcgtccgcgcctccgacgccttgtccgcctgtccgccgccgctcgcctcccctgccttgtccgcctgtccgccgcctcccgcctcttcgccgccgctcgcctcgcccgcctcgtacgcctgtccgccgccgcccgcctgcctctacgtcttgtcgatgccgtcgatctcgccacgggacgcgcggagtggtatgcggcgaggcacctcgtcgcccgcccccatgcgcgttgccgcgacgccgccgtccgccgcccgccccccgtgcgccatgcccgcagccgtcttcgctcacttcgccgcgacgccgccgtccgcccccgtgcgccggctttcgccgctcgccgccgctcctccgtgcctcccgccgcgccgatagagtgaagaagtgaagagtgagagagagaagagaggaagagtgagagagaggggaaagtgaagactatgacatgcgtgtcccacaattttttttattagaaaacgctgactgggatgccacgtagaccaaaaccaccgcggattggatcgagggggggtaattcgtccggtttgcatagtttggggtgaagaatgtctggttttgtggtttaggggggtaattcggatgaccgcgatagttcggggggggggggtaattcgtactttttccttgtaggtgtcggttaattaaaaaccgacacatactatatattataggtgccagtttatttttttaaaaaaccgatatctatgtgaatcaagccgagatggcatcggatgagccgaccggtggcccccacacgacgagacgagcatcggataaggttcgacgtcttgctctcatcgtctattcgtctcattccctctctctctctccctccctctctctctctcgttcgctctcttctccctcgtctcgctctcttctctctcctgcacgctgccggcggttggttggcggaggcggcagcggcgaccgcgtcctcccctcggccagatccgacgggaggggaggcggcggcatgaggggaggcggcggcaagtggcgtggctcacagccatcggcggcggcggcggcgacctcccctccgccagatccggcaacgacaaccatctcctttgcttgcggcaacgatggcggtgggctccccacgggcgacggtgagccccccaaccatctccttcgcttgcggctgcttgattctaatgtttgatgtgagatgaatgttgccaaattttgttgtgagatgaatattgcttgattcaaatgtttgattcagtgattcaaatgtgattcagtgatttattttgtgagatgaatgttgccaaattttctttcttgtggatgtgggaggagcgactgctcggctcgatgcgtcggctcaatcgagccggcttttttttattcctcgaacctaaaaggtgccggttctaaggatctggcacctttttgatttgcaatctgtgccgcctctcttgtgccggttgggaaaactggcatcgaagatggtttcccaaccggcactattccccttttctgtagtagtgatgtatccctaatcactaaaatcataaatgtttcaccacagacaacatagccaataaagtatgttttatttcgctatggtttgtgtaagtattactccctctgtcctaaattataaggcctatatttttcttacgcggtcttcaatgacatactatgacaagtattttattttatgttatgttctcaataaatatgaaattagcatcataagaaattacttcaaaatattaatctagtgatataacatgcataatacttagtttagatatatagttagtatgattattagtaaaaaaaaatacaagttcaatttttgttagaaggggaggtcttataatttgggacggagagagtatatattgtgtgtttttgtttgcgtaatcgaaataaaaggttcaccacgttaccgtcacaatttctgttgtactactcaccactgccactgcccatgttcgttaactgtaaagatcaatagaatggaggagattacaatatcattcacattcgctttctactactctgttcgtttcaaaatggaggagtttcagctggacgacacatatactaatattacaaatatatctgtttagattgatagtaatagaatatatcctattcaactaaaactttttatattttagaacgaatggagtaacattaaacactaatatcctgtttggagaactagcacaaagttattttgagagctattttttaacataaggaaatagccctcaaataaaatagtaggcctatattgtttagattcaaaggttattttgagagttatttgatatttaatacacgaaaaagcctctcaatgctgctgtgggaggggcaccgcccgcaacttctcccaattaacctacgcacgcacgcacgcgcgcgggaacccacccacccctccagtctcagccaagccggccccacaccccggcaatccgacgtgggccaggtcaatcggatgacgctggctaggtggagcggtggtacccaaaaaaaaaaaggaaacagagaagaagaagaagaaaaagagaagacagcctcggtggacgtgcgtgatatgcgagtgcgcttctcactcgcaagcgttctcgcgtggcgcccgcgtccccgctgccgcagccagccgccactggtgtcgggcgcgaggcgccctggcggtgggacccacacacggtggtggtggtggcccccactggacagtgacagtgacctggctctctcgctcgatgcgacgcgacacgacggtggcgatgcggaagctttttttttttttttcactttttcaccgccccacgtcgccgcacgaggtggtcggtctcggccggggactgagcaagcatctggttgttttattatgggggcgtttttgcctgtattttttctttttttacagtgatccgacgacggcgacgcggtggcggaattcggcgggatcgggtttggacgtttgctcgccggagtttattcgcgcggcggcggtgggtggttaacgtcccggattcgtacgtgtcggggcttacgtatatagatgatcgaacatctactaagctatatactactatggtactactacttcaacggtcttaagaaaaggttgtggatcttctgtcatgcacgatcaacgctgatagagaaacaaattaatagtatagcacactactagatctaaattatctattgtcaatataatagccagttcacacaatacttgcttactatactattaatacctggtctcacctgtcatacacacattatgtatgagagtccgtgctatagctggctacagatctgtagtccgctgctcttctctcttcctttatctctttaaaatatgtttatagctggcttatagcctgctattatacctgttctaataagatacaccctccgtaaaaataaaaactgttcctatctacgaagatacgaagattcatggctaagttgaaacttttttttgacggaagcccccatcgtttcgtttattcgtggaataagctaaaggacacatttgtaaacgaaaaataatttgtgaataaaacttttatgttcatgttcttagtgatctaaaagcaaaggccgaaaaaattcgataaaagaaatctcaaaatcagctctaaatttaaggttgaaaatttaaaatatggctgataagcataagcataaacgaaaagacgagattcaaagtatactccataaaaaaaagaaacatgaagtccgatattctgtatgatcttcaatatgtgtgaaaaattcattctgcggtagtgtacctgtagaattagtataaggccctgtttagtacacaccaaattttctctaaacttctaactttccatcacatcacatctaaaacttttctactcacataaactttcaactttttttttctagactactccctccgtccaaaaaaaaacctaatcctgggtttgaatcaagattgagttttttgggacggaggaagtaccaactttccctaaacttctctccaatttcagaaactaaacacagcctaagtgtacctgtagagtagtgcccatttcaattctagattgatttattttgggatgtaatgagtatattacattatattacactataaacaaaaggatatgcaaattgtcttttcttttaaatgccaaaataaaaaaagatcgggattggttagtgcatcaacatcttcacgtagcattcgtttcctatttagtgccaccgaattttggcacttttgcatggacaacttcattttccaagcaattatctctacacctttcttctccaactaatgtatatagtattaaaaaaaataatatcttcatatatatatatatatatatatatatatatatatatacatcagaaaaatcacaattataccatgatatcagtggagctttgtagatataaagcttttgatatgatattctacacaactctaccaacaaggagtcaccaaaataccaatttgtagatataaagcttttgatatgatattctacacaactctaccaacaaggagtcaccaaaataccaaagcatatctcttccggccattgacaatgaatattgattaggttccatctccttctgatgtgacctaatttggtcctacctccaatatttgttttcatgtgcccttgctagggtgaccatcctactttggttcaatgttggccgacccaccaaggtcagatgtgaccaagcattgcgtgtgcctaggtcacatacctgtatgtttattagtaatatttttttaggctttagaacgtccaagttttatgtacgtatatctcaatgtactgattaatgtagtgccataacaaacacattgttgagtgtttgccattttcttctatttttgttattgctagttgatttgtaacatactaccaatttagagtgacatataactataatagtataatgttattaaaagaaacacttctagttcagctcgtttgtgcggaaaaagggatattttgggtaaaacaagagaacatggaatcatgttaggcatagaaaaatttaggacgtactactttagaacaccgaagaactctatttcttctaatatattgacgtgcaatttttttgcgtattaaaaaaaaactttagaacacaaaagaatggtttttacgttctgcgaggatcaaactgattcatgtaaaatttacactccagattgccttgatatgcaaagtgcttatacaatttaggattattgtcacggattatgtgcaccatatcttgaaaaatatatttatctgaaaaaactttcttctactgcattgattaaattacttgttttgaactatttgataagtttatttttataatatttattctatctctataattaagttgaaattcgtggcaataatcaagtgaaaaatttgtttcatggccttaccttaccttacagtgtacagtgctatcacaatttttttaagaagggtctccaatcttgagaaccactgactttgggtgcgaaatttgtctgcatccactggctgtgccaactgccaagtaagcctcaatgtcttaaatgtgcacacgttttctatagtcaggttgctgcacattttggtcatcagtcatcacatcttcatgtacgtaatgcatactacaaaatagatttatttagtagtgcccctttctagtgctcatgatgattagcagatgaaggtagtatccggcctcacctacatctggggcagaacagtgtaaagcaatcttaaattaagtactccgacttaatttaatgaacatcaactaatcatcaaagaatgaggacaaaggtgtttgcctcaaagcatggcccaaaaaagttctccctttgaataaaacagtggaaaacgatgcaaaatccaaatggcatatattcttggttaattcaaatgcatgggtgagatgccttagttctcaaacaatataaagatactgacacacttggttacaaatacattaaagagggtatttctattcagagatgtcatgactttgtatttgcccatactccatagcgaggcttctattctttgggctgtgtgcatactaagttggtgcagaagttatttcattacttgatgaaatatccattatattaaaaataggattatcatttttaatttcatgtttttttttgaaagtagccctgagatttgatagagatgttctttcaaaccactgcttgttaacagttggatctgtcaatgtttttctcaaggacacatcataagatacctacaaacaaccgatgaaggatacatcaactgacttagaggcatcacccctttggaatatatggcactcttgattcgcatttttttcatgtcccttagctaatggaattgagtgcagtgtatcaggcggatgagaaatgcgttgatctgttcttgcacagctggggtgaacatttttctaactgcgatctgatagtagtcttctagaggatcaagcccaggtgaacaatgttttatgatgtttgattgcgacaatatttgtaaaaaataattcagagcaatacaaatggacaaaaagaaaactattacttaatgggaactgtccatgcatctacctaatttcctgcaccatctaactaatttaagtggctatttccactatttaattaggcccctttagaacacacaggaaaagtaaaagaaaggaataggaacaatacattattttgatagaaatatatatgaaaaaaaagaattacataccattttgaaacctgcaggagaaacatagaaatttaatgagagatagactcaaagaaattttttctaaaaaattatagctcttgttaattttcctctgaaatctatacgcattgagcgtaaggggtttcatatgatttggaaagctcaataatcctttgtttcaaagtgataaataggaaaattttctataggattagaatgctacaaaatttttgcataaattctttgtttcaaaggaggccttaacttcaacggcctaaatacatttttcactatttccacagagattttaattcctacaagaacaataaaagggaagaaataaagaacatcatattttcttttgaggaatacgcaaaaggtattcgtatcattgcatcaagacttattctgctactatatttatttatttagcatagcagttggcaatgcaggtgcag

SEQ ID NO: 4730 - DNA, 37573 bp, Oryza sativa
  unsure (1)..(37573): unsure at all n locations
ttccccaaaagccactgaaaagctgtactgtgccttgtattagccaaactgaactggtaaaccttaaaaaaataagttaaggagaaaacgaaagccgatctgaactatcgaagtatataatgaaggcattaggtatcttggcgtcactctgaagataacaaattcatgggcggtgatatgatctgatctcagcagataaaaattatacggtcttacagccacagacagttgtgctttgcgtcagcatgtggttacaaaaactcgaatttttaattttgtggttatgtagcatcctattatggccaggaccagtgtattggtcatgtcttatttcaacgagttcgttttcactactctacttttttttagaaaaaaataattttactactaccttcatgtttaaatagacgatgatattagttttttgacgtttgctcattcgttttattaagaaatatatacagatttataaaagtattacataaagtatatgtaataataaaacaagtcacaccaaaataatagtacttacatttttctctaatttttgataaaacaaataatccaacgtgcatacatatctaaaagttgacaacgtcataaacttttttaagaaccacttaagtgtatcaaccgcagaaaaactcagtttgatacactaggatggcttgatactgagtgtatcaacttttttaaaaagtgtatcaaccgcagatacttgagaaaaacgtcatatactaggatggcttggtgtcttctcaagtatcataaaaactcagttttaagcaggagagtatacctacgtacaccgcaccgggtagatcatgtatatttcctgttcttttatgttcttttagactatgttaattattgcaaaatcactcaacaatcagactattacttggatatacaaacccaaggtatttttgttgtaagtttgccactgttcccaagttatcaagtatgagcagaaaacactgttgctaaaaagaagaaaaaacaatcaacctccatactgctctaatgttctatggccagcacacatatcggatgacaccagaaataatcatagagtattagaataatgaggatcacagacaaaaacgtgcaaggaggcacgcatcaaagcgagattgcagatggacaccctgtagtgtccctgaaaatgtctcgttttccctgacatgagctcaactactgcctgggcattgctgcttctgctcctgcaagctgcatgctgaaatgtactatatgaggatgatcacatcttcatatatgcatggctgtcctggatctatttgtttagtaggatgatccatggaattaagaactggaattattggagagggatttctatactgactgaatctttatattccatccaatattttccaacaagatacagtacctgtatattattatatcatgattatcccttgatttatatctaaaccaaatcacgcttccgtgtacatcataagctgaatcatgacacgcatgtttcctacatatgccccaaggtatcagtatttcaaaagaatttgcttgaagagaaacgaccagaattaacgggagctatctagccaaacagaaaagaaaggcactcagctatctcacccttgcaaaattgcatcaacatctccatcaaaaacaggccaaaagaacaagaagatgctggtgtcaccgtcagtctgtccttggtgcacaaatggacccacgttttcatgccacgttgaaagtgaagcgacatcgccattttcaggaaatacaccgcactgccaaaactgaccacaaagaaaattacatcgcttctctagagtattaaaaaggaaatagaaaagaggatatctgcaggtattctgcattatttttcaacttccgatatgccaaaagtttcttcttctttttcctttgaaaaaattggctctgtcaaaagttttggagtgtaactaaggtcatgtgctggcacaaccgaatatattgtcttgtgatgtgaagcgagcaaatcttttctttttttccttacctgaatattttctcaagctgcataatgaacgtacaggatcaacaattcaacatagtgacgatgcttttggctttggagctgtatgtgctagtaaaacttttcatagttgcggtcattttcgcatcttgtgcctgtcagtcgcggtaggtgcagaaagtactcagatactacggtattagtgtttgcaaatttttacaagttatctttatgtgtacatctaattgaaccattgagataccacttctttttttttaacaaaagaaaagaatttctcgaatgtgtcataattttttatccatcttagttcacaatttgcacaacttgtgtaacatactatctgagagtcttatcaaggccgtaccctacggtgatgaatatggctagttcattgcttttgatctaacgaattttattaagggcatcctcaatgtatgtttattaagtgggtagtaaggtgggacccacgaaactaggttataattgtttctacctcttacaatgtgtgggaagtaagatataacccacatgtaaaacaatgattggatagaaaagagagtgagagaatgagagaagagagtttaatattttttttatgcttgttacctggtagtagtactattgcctgctatagttattacctcctctactacccacctccacaatgttaaagtaggtagtaaggggtcttactacccacttttcatccacattgttgatgccctaagtactgtgaaaacgccctatttgttacaaagacaatgaacacaatcgtagtggtaggtagacatggtgcattttttcaaaaaaaagagaagaaattatagatcctgatatctatatctttaatatacgtatccaagcgtcgccataatatggctttcgagtttattgcactgagaacacccaagtccgaagttgatatcacccatggaaaagatagcaaccggtacttcgattcataaaaccgctttctacatctgtatggtacagtggatatacagtggaagattattatctgcaatatgatctggtggccacaagttggatggcccaatccaatgacaagctccaacttgtctacggaactcgaatagacatctcaattattggccatcgaatggaatggagatcgatccatcgatcgaacatctcacctcttggcatcgattcttccatcttcagagtatgcacatgctctgatatgctcatgaagaagtactcacaatcatggtagttacatacaacccatgcttcacctggagatcgattaatcagtagcttctgtagctctgttcctatagcaaattttaacttcagtaaagaaaaaaaaaaccatctctgaacttaattctctcgctgatgtccatgcatatgtacttgagtctacatgacatttctctgtcatgagagacaaacaaacacaaatgtacggtgtgagtacggtgatgcatactacaccctgctacgtacaaacatgccgtcacagttgacgatcagagtgaacagtttgactgatcgacagtattgcaacaatcgtgctccaggccgtgtctaatccttgaacagtattcgagtagtgatctgatctcagagacggcaaagatttgtcatctcaagagggcgacatgaacaaggtacatcactattatgtgtttgttgctttggaaaatccgtatcatcatactagtaatactactgtacccatctaatcaggttagctgtacatcttagatctttttcttctcgtcctctctaaaaaaaaaagatctcctttcttttttgtcatgaaagtagctataggtttttcatgatggtccaatgaccaaaaccaaaaaaagagtacacttgatggcgccttttccgcttttaagtttcagcaagttggagacgaatgaagcgtcccccggtgatccggtccccttcttatcccatcacgaattcgcgcgtggccgggtgactcatagtccactcaatgctaccaaggtttattttctgagtaaggatgcagattctattctcatttttattagcacataatttaaaccgctaaacaatatttttttaaaaaactttctatcgataaattcattttttcaaatttatagtaataattaaaacttaattaattacatgctaatgttttttttaattcgtatcctaacttcatgctaaggttatcctaagagacgcactcgctgtgtgcggcccaaacgagcagtcttttcgatgtggaggtttcagataaccttagcgagctctaaagcgaaatttttcataaatacaagtatacatatatgctttgcttatctcggtggagaagttgattccagctttggttttgtgtgatttggcggcgatcgatctctgtcggccggctggtcagatagattaatccggtaacgttttaggtatgttttggaataaagcgagagcactatcctgctagctttatggaagtgtgtttagtgtgggttattaattacaagctaatgatactccagctgattaatcagggccggtttggtgcagacatatctctgtctatcagctgcgacgtgtgatgtgtatatacatgcaatgctttggttaattgcttgtgtggtcgaattagtggcttgctaaacctcttttttgtggtgaaagtggctcatcaatctttggctatagtactgctagtgcttttgtttttgattgatgtgctacacatgttgaatcctctgttggctttggctcatgactgtttggaaacgtcatttttttgcgactttctgcagtgctttttcactaggtttgattgctgcggtcgtggaggaaaatgacagcacaacgcaacactgtgttccctcattgtttttcaactaaggagacaatagtacagcgatcatgatagaactacagatgtcacggtttgtgcttataaaattgatgacacgagatttggcctgtctgagatgcataggagcccagcccagatagcccatcaacctggcccgatcattcagaccaatttgttttttttttcttctacattttacccggtccctacatacaaccgatatatgcagcattttttatatactcctttcgtcccataatataagggattttggatgaatgtgacatatcctatgtctagattcattgcactaggatgtgttatattcacccaaaatcccttatattataggacggagggagtatattgaatttagtgcttcaaacaaccccttggaacttagttactcaaacaatccaatctgaaattcgatcctatgaagatttcaactcaggatttagggtgctactcatgtcattgtaataagagatcttttacggtgtttgcgaggtatttagaggtggaataatgtgcaccgttgatcaagagaggggcaaggtacggaacaaaattattgtaacatgatggcatttgagtaattaactagtaaaacataggcaatacatttgaattgaatacctccttccattggtcggtgtatcgtagtagctattggtatcgttgtagagaaaaaagtaaatcaaggatactccgttgatttagggattgattcgattatatcaaaaagtaaatcgtgtctcctttcttctctccctttggttcgttcgtgctctagggtttgaaccagttcatctccgacgttgtcgccagcagcggagccacctccgctgccacctaaagttcctcccatcacccacaccggtgccggtgcggcagtgcaacctgcgtctctcccatcgctagtgccggtgaaggcccgtacgttgccatcttcctcttccccaggttggacatggcgctaacgaccagattaatggcactcaccggcttgccgctagacatggacgtggagaccaaatctgcaagtgcaattcacgcatgtgctatagatctatggaaatgtcctctctttgcaactccatctgcttcgttggtcttgcgagaactagttcatgagcaagcaaatgacctaaatgacgatgacatggatactactgaagctgggattggtgatgaaaatgaggctttcatagatgacgaaaatgaaaattatatggatttcgagtacgttcgtcaccaattgctagcccaaggccagaaacatgttataagaacacaatgtaaatctaaagaaaatcacgtaaaagagaacatcaaacaatacaaagtaaatctagagaaaatgaattaagaacctgttacgctagtgccgtgtaaatgacctaactcaaacacaacgtaaatctacaggaaaaccacgcaaaagtgacacaaataagaacatgtaacgctggtaccaggtagatgttaactcgtacagtcgtacctacttagtacctattataatttgggggggggggcaattttaccctttttgctctattaacaaaattatatttttatccttagtacctaagtatctatactaatacttaaataccttttatatagtatctgtgattgagaactgttggatctttaccttttttggaatgcaaacaccgtaaaagttctcttgtactaaactatatgccctttagcagaccagctgttttggcccgatcaactaaattttttgcaactggtctagtcttatttacaactcttgacagcagtagtacatggtaaactaaggtcaattttgctatatatttgtcaacaaattttctcctaaaaatttgacggatgttgtaattacactataacttatatgtaattacattgtaactataatgtaacttgtatgtaatattcaaaaatctcttcgtaacatgttatttcggtaaaatggaggtcgtgggaacaaatcttctcacatatgtgtgtgctgtgattttttttcttcctcagcagaacaaatcttgtaagagatttaacgattcaaaattacgtgaaacttacatacaagttacactgtagttacatgcaagttacagtgtaattacatacaagttatagtataattgcactacgattgtattataattacacgtgtcaaatttttaggagaaaatttgtcaacaaatgtatagttgatcccaactaagataaagagaccagctatagcttagggctatgtgtaatacagcagcgggcacgcgtgggacgtgcacgaatcggtctcgatcgcatctagtaggcactacgcggcagagcagggcggcgatcgacgcgcggaagatgcggccagtgggaatcgatcagcgggggaagtggatgctctgacgttagtgttcgcggtgacgttacttcatcgtgactgacatgtggaccccaccactcttgagcccacatgtcaaccaccaagttagtggaagttacgtcagaggatctcaatccattggcgggggtagcgggctggagtgggtgctaccaagcgtcgcttgactacacgcaggtgaatgacgtgcaagggatgaaccagacgaggtcattgctgatgtcgacgaagagcgacatggagcaggccgtggactgagagtgacatcgtgtagttgcttcccggcgcaagagctggcacaaatggggaagagaggggagagggaatgtgcatcccaggttatttatttatttattaggatgccacatcagctaaaacatgtatctatacgagaaaatatataatatgtcactgtatatgtgggggtttcgatgaaatgccatttaatagaatgcacagaataaaataccactcattatgttgcctatcggaggaaataccactttggggggggggggtttaatcatttctatgcccgaaatgcccctggctatgggagggagggagggagagcgagagagagagagaggagcgctggggaccgagcgggtaacaccagaggcctcacaaggtggcggctgcgggcgacaaggtggcaagcgggcgaatgaacggtggcgggtacaacagggtagagaaagaggcgacgacatgtaaagaggaggatgggatggcgaccggtgagcgtgctcgctggaaggcggcaacaacggggggagggaagggaggaggaggaggaggagacgacacgggggaggaaaacagagtagcagtgcctaagtggctatggagacaacgaccatctgaagctccacctctgccgcggtgatctcgtcctcatcatcgcctactcctccctctgccccgttgtcctctccactgccgtgtcctcctccccccatatattgtccccacaagctctatcgctttccagcgagacctctagcgccgccgtccctagtgctcccctttccccctctctcttcacagctagggactttttggtcatagagatggttaaagctctccaaagtggtatttttcatccattaggctacgtactaggtggtattttatccggtgtattctattgagtggtatttcatcgaaaccccatatatagagtgcatattgtccattttctccttagggcttgatttggatgattttgctaggtgaagatttttggtattgtgatttagggatgtcaattaaacatgacgtaaagataggatgataagtggtcctattccatgtacaaataaagaccatgggccacatctgtatgtattggttgagatttttcagatactatgggcctgtttggtaggggtcgaaactccaactccagtgagagctggctcctataagagctgaggtgggtatagaaaatgtttggctagactactcagctctacaccaccacattcctcgtcaccatttcatggcaacctaccgttgtcgccgcctgcgcaccgcgccgcctggcaacccgcgggccgccgccacgggtcatcccacgtccaccgctgcggggtagcccgcgagccgccgccgccagtcagcccacgcctgccgcctgtcgacgttgccacctcgagctgccgccgccgattagcctacgagccgggccgcagcctgtcgacgccgccgccatcgcctgctgccctcgccatcgcgtgccgcccaccgccgcgttcgcggcctgccgccacgaccgcggcccgtcgccgtccgccgtcactgcctactgccgccgacgcgactcggccgccgcctgtcaccatcgacacagacgcaggcgctgctaccacatccggccgtttgaaggaggatgggggaggagagagaatgggaggagatgggataggaaggggtagttcaatggaatttctgtgtaaatacactaaaaaaataaaagggtagtgggtttttgaggtgcagtggagctgtggagcagcaaaaattcaattccacccctatagtacaaatttgtggagtagctttgctaactccgcttcgaaaaataaagaatttgtattgtttggcacagctcacagctcttggtaagttggagttgggagagctacgccaaatggagcctatgtgcatctcttaatgtatgactaaatccataaagttaagaaacaacttagaaaaatttatctaagcaataccgatgtacaattcttttgtaagaaatcttgtttttgaaagcatatcaataataatccacacctccattaattggtaaaatatacttgcaactcactcagaaaactgtcattccaaaattccatcagctttgttatagatcaccaaaatctttatttgtcactcttgtggaggttgatgccaccaaactatcacaacaaaccatcgccaccaatcggagcgaaaataataggatgttaactagctaaatctatatgaaaagtaaacataaatgtttggtgcaaatttttaaaaattgtatacatcctgttgggtatcgtacactcatccacatattattgaatgattgttgaagatactctatcgatttaagaaggttttattatttcccaacaaaaaattcaataaacaatcatagagcttgctgaataagcattttctgaataagagaatgttatatttgtttctcaccaagatctcacacaaaatatataagctttgaaattagaacccattaccaaacagatttaaaattagaactcacctatggccgaagatttatagtgtaccaatagcagcatattcctatacttttcccttggtatgattttttttcagttctaagttttcacatgcaatttgtgcgacgaggatgcacaagctgcgtgtctcgtcatgttttttttagcctgccggcattgcgacatggtctttagtttctcaggcgactcggcacggacaggcggcggtttagttacagctgcttgtcggataagggtccgatcagctttacttttacctgaaattttgcctgagccaaagacagacgactcaaaaattaactatgggtaatataaaaaacaatccaagaggtgcaaatttgaatttttttttcttaaagagatgctgaaacctcagatagttggtttgtatgggcttgttccatacataaacgatcgttagtggcacgtaatagaagagttacagagtagtagtagtactatcattcactgagtatagtacagaaaattggtaggaagtaatattattcagcagtacagagaagtatttatcgtgcgacgcttaccatagaagtgcaaacagtaaccgttacttagagcaattgtgtgctacctctaaaaatgacacataggattagattatgaggtagagaagagaagtgaggagagagatgaggaaccacccccaaatcaagaggtagcctccacacaaactccaaaaaaaaatatgagagtactaaacgcattgatatttgtttattagagtgaatgaaataaataaattagggatagcaataatcacatctactgtagcacttgccatccgtagatcgaacaaaaaaatactactactgttttataaagaataggttcaattcccttaaaacaatcctataaaaacgtacatttataacatatgatataatatacgcttgttaaaaaaactaggaaggtaacccgcgcgaatgcgcaggtaagtatgtttttttacacgcgtttgacaatttgtcttatttaacatttttatgcaaacatgtgaaaatgtaagtcatgcttaagttataaagcaagtcacatcaaaataaactaaatattatttattttcaatataaataaatcatcgaacttgtactgaaaattcaacagcatcatctatcgaaaattgtacctttaataatcgtacaaatttttcaaaaatattatttatcgacattgtttatttttaagctttttgttagatacacatgtttatcatgtttatagatcaatactcactttgtaaagtataagtatatttggatttggtacggtgtttgagatactggattgtttgcaatttagaaaaaaaatattttataaatagacccctagaagaattattccagaaatgatattttttatgtgccagagtggctagtgctatcatccaacatggcggcgcgtccccatgcaactatggtaccgcgtggccgaccgtagctgacatggcaggagaatggcgccgaccccctccccttcataaggcatcaacgcctctgtggcgcgctcaccctaaggggtgggcagcacttaatccgctcgggccccaccccctccccctccccactcattcgccctcttctcccctacccgagcccgagaagagttcttgctttctttccccctcacctttccttatcaaatccactcgttttgaagccattttttacgagaatttttgggtacattgaagagcaaggtatactccacgcccctcctcccgggtctttttttcgttttacttggtgaaatttgtagatcggaggttaaccctataatccattctttgcccaaatttatgaatttgatcattgaaattggggatttgttgataatagtgttacatgtttgctatgtactcactggtgctacgatttttttaagtatgtatgcggtaatgttgattaagtttaacatgtttgacatatcactattttaaatacgcttacattttgcttctaaaaatatacttataattttggaacagaaaaagtgtatgataggataatccacatattaaattgttctctaatatttgcaaatcggtttatggcatgtatagtgtaagaatatggatccatgtaccatatattacttataatataactactaattaaattattttttatattaattattagctagaaaatagaagacgttagcttaaaaaaaaggacacgggaggggagggagtacgtacgtgtatttctaaacaataatagatctaatcaatttaattagtgggtccaccagttaagggaaaatcaatggttgggattttttttcagaatatttaggatctttctaatttattagaggccacgtggcggctcaggagcgcttatagaaatcccacgtgacggcttgagagtgtttctagaaagtttaatggacttttagtatataatagatagatagatagataattacattcatcaaataggataaaatatatgcttcattttttttgaaaaacgtgtttcatagagtgcgagttcataanataaaaatgtntnttatatgcactcttaaatgatgatttgttctattaactatacatgtaacacatctatagtaatggcgatggtggtggttctgccaccacactaccaactgacatgtgggattataggtccatgtgaggaaatagacacaacaaatatttttaaccttatctagtgtttaaacaaaacaatggacatgatttgaagttttgaaccatatttttttataacgtgtcaatttgacatattaagcatgaaaaaataagcgtgaaaaattatcttaaaaatcaacttttgaaatttaaattttgttatggcttataattaacaggtagatgatgttaggtaaaaacttgaaaaaatattttataatttctaagaaaatccgatgcagcgcacatgtccttggctagttgttcaaaaatatctttgaatgaaacttgctcctatgctaataatcatccggaataatgaatttagacctaaactcattgtttatatttaaaaataacatctagccattttagatgccactaatcgccgtgcttcacatatttcaaagaacaaccgttttagtgtattcagaattttcttttcttaacaatgcagtctgtgaaattaaaaggacaatcaaggtatttattggcagaggtattattgttaaccattcacataaactacatgagtggttgaatatatatgaccatccacagcattaagttatacaacaacatatccctcgtctactttgcttttgatttgcaagagagtagtagatcggaaggctctggaatctgaatagagtgtttctttaatcattaccaaacgttttttcgagtatgtttttcaaaagttatttagttgttgttgttattggagtatcttctagatattactgtgcatgtgtgtgcatgagaaagtgtgcattgcacagcccatgcaagtttctatcttttttttttaccactggtaaatccttgatttatctcaaatgttaaaagtgccaagtggcccaatcagaagcgggcaaacctgccggcttgagaatatttgactagaaacaacggcgcggccttgccgcgctcaactgacattggaccaatgtaatttgtcgaaattaacagtagctattacattaagaaaaatcaattatatacccctccaaagatctccatgccgcttatgcaccgtaggtccataacaacttgtgattttgctaggaaccagcagtattcacttcccttgcgaaaatcgattatgtgcaggaataatttgctgctgctgctgctatgctctagaactctttggccactgcaaatcctggatttgtgcacattttttccacagctagagcacttcctagccatgcttattaatgattgatgatggaagatggaacagatggcacaataagctcaacatagagttcttctccctgtccctgtggctagataattaagctggtgtgtgtacagtgttatagctagaggcttaataaaggggcaataaaatgtgataggggctagttgggaaatcatctagcactcccgcgtgaaagaaatggacatcttggcatcacctccctatggtagacatttcagggcaaaaatatgtcctattttttttcaaacatgtgtatagaaccaaccgaatgagtacaggtgtctgttaaactgaaaatgggatagcccacatgaacgtattaaggatggaccatcaagctgctaattaaggacaaaaaggaagagcacatgatcaggtgcgttcaacaacaaacctttatttccacagtttcactgccatcttaaaaagtcattgtatcactgaagtgcagttgtgctctgcaaattatatataactcgtggaaggtaaaaaaaatcgctataaatagatgaagtgtgatcaaaactttcaaaaatgacacaattgctagctgcggcagctggcagattcttttgttacccctgcttgcactttggcaagtcattccttgcagttgtaaacaaataacatttgttgtttggcaaatttaaatttgtaaacaacatacatcaagtcattccctgctaatgtttcccatatttccagcaattgacagtatatataaagagtatgaattagttatgtgaatatctgaaatttagaatgcactaaacagaatagagaacttcaaaataagccttatctgtgttcatcacacaaccacctaacaaaattcgttgtgcactaatataaaaattcaagtttagcaagaacagaccaacattttggctattcacttcatacaaatagaatgaaaggtgaatgccaggttgagggacaaaccaatagaaagctgagtattgcactgttggtccaatttctcacatattttcatgcaaaattataaaagaaactgtatattcagcacaaaccaaaccaatgatatgcaattaggaacctgaagacattaatttttcaaggaacagtttctgttacaagcatgacatacattcctttgtaatcacaactcgtccaatagaaaactgagatattattttccttcatggaagtttgcattgcatcttccaagtgttggctcagtgctttcatttaccgtgtagtgagaagaccagggtataacatatctgttgaaacatgtggcatgactaattaagagcattacaagcaaaattaccttcagcatataagaaaaaaaaatagcagctaactggaaagggacagtatagttaagaatacaaactggaaaaggaatgtgtgtcatgcttgattaattccataagtaaattacttccgtagttgcatctccatgttctcaatggatgacaaactgtaaattatcgaagacataaatatagactgtctattacatagacatacattgttcaaacctgaaatgatcaccgcttttgataaaggtccatttcaattttctgataagtgcatctcaaaattataagatagatcacatcacaaagtagctacaggttttgaccagctttgaccctcatttcatctacatatcaatgttctgacctctaaccttatgggcaactacctgcagctaagctagatccaagaatacaaatcggaatgttataatacatgcataaactaatgccacactctacaacagaagaagacctcagatcttctagcgcagtaatgatttgctcacgcacaagctccgtactcttcaaataaacctccagattgagtatctgctgctgccacccaatcttggggttcgcccccccccccccacccccaaaatcccattcccaagctcattgctgaagcagtctacccagccacagcgattgaactgatgaactccttcagaagcggtgacggagttggagtgctttggacagcctcctcgttggcacccctggcatatgcgcaattagcggagttgagttctccatagcagcaaggagcggctttgatgagctccatcagttgaagtcaatgcaggcgtcaaagacaatgctggggcctccggctcagttttcgtttcgtttgaaacagcaaatcgctacacagccaacaataaccagtaggagtatttcaaaataatctaaggcagattactgacaaagtgacaagtttatgcacacttagcgagctaagtttgaaagcataacaagctatcctccattacttcaattgcaacagggcacctgaaaatatgatacacaattccttcatataacaaggaaaagacataactcacacaagtggttgaccatcgggtctgctcgccttcttggccagggcgctaatcgtcacgctcggccgacgcgcgcaggctcgtcgcgggggtcgctgtcgcgcgcaacgccgtaattgccgcgaccaacctaaggctggcgcgcgcgctcgctgtatacgcggtgctccgggtggcgatggtggtccggcgcttgtcgccagggcgctcgccgagggaggatgcgctaaccttcgcagcacgatggtcgacgccggagacgccgtgctcggcaggtacccgcgcggccgcagcaagtggaggcggagggggtagagagacggcacggaggggtagaaatagctcgtcatcgtgacgtcgacctcgtcgcgcgactctgggaggaacgcgcgacggccgccgcagccgtgttgcggacgcactccacgccggtggcgagcctcatccacctcacgtccaagaaacgcgtaatcctcggccttctccaattccgggtgaaactcccgcgcgccgtgggatctgcctggccccgcgaggccctagccggtggtggccgccgagaggccgcggacgagcgcgtccggtggagagatcagggcgaaacgggcggaggtttgtggcggcggcgcacgggaggggatgagggagcagaggatgggtggatagggattgctttgcttctgcaaaaagactgttcaaacatggtatattacaacgaggtccacaacagcgaaccatcaccgtcgatcagcgatccgacggctgcgcgtggggactaaatgctagaatcgcggtgcgccacgtggcggggctttttgcacgagaatccgcccagaattcggtattagagattagcaataaaaaataatttatatctgtgtttaaggtttaaaagcctatgctcaaaaaatataatacgacaaaaaaataaattttagttgtggctgataagttaaagagcaaacgatgatgcagtatatatgttctttgctttttcaatatatatattctgttttcaggaaaaatacgtagtgtaaacatcaaaactctcgctttagattctatagtattttaattgtattcattacatgtttcctttgtttccttcattccgatcgctacctccgtatcggtttgggatggggcagcaaccaggccatggcccatgggcctagtaaagggatgactagggattgggaaaagtacacccaaggtccctcaacttgtcatcaagttacaaaatcgtcccccaaccaaaaatcagaaacaacgcaacccccaacttaaaaaactagtgcaaactaggtccctcggcggttttgaccccggctgagttagtatgggacccacgtgggccacacatgtcaggatgccacgtcggcggccagcctctcccttcctgtcctgaccgggcgcatggtcgggcacaatgggtcccatatgtaagtgaattaaaggtaaatgggtggatttaacagagaaactaggcatggtggggcccgcatgtttgtgagacattagagtgagattaggggaggattacagtgcggatctgattaggaaatcgtggggcccacgtgggtctacacgtcggtgtctttgctcctcctctccatcctctcggtctctcctaccattcccctttgagttgagagtgaggacggcggaggccggcggggcggaggaaccggtgtgaggaggctgtggccggggtcggcatcctggaggcggcgctccccctggcgcaccagcagcggagagcaggggaggagcggtggcctaggaagggtgtcgccgcggggccggcgatggacagcgcggcgcggaacgacaaccagcgtcgcaacggcggagggcaacggagcatagggggcgcgggaaggagtggacgcggagccgccagtcagcgtccgcgaagaggcgcgcgtggaggccgccacgcgggcgcctggtgtggtgcgacggcggtcccggagggcggcggcagcctcggtgatgctccggccgatggaggcaaaggggctaggtggtcgcggaggcggcgcccgtgcgggccggctatggcgtggagcgagcccgtgataggatggcgcaatggcggcggtggcaagcttgctcggggaggtggaaagatggcgacgggggatgggaaggtggtgaatggtggtgcggggcggatttcatggccgacggtaataggccagatgtggggaggaggtcgcccacgccttcggcttccgcttctgggtcggtgccggcctcccctcctacgttggcagccaccatcgccgccgcctctccgccaccgcgcttgcccgccgacgccgcctcaccctgccgccgccctacccttctcccgtgtctccgccgccgcgtcacctccgccgcatcgtcggccggccatcggacctcctcgtcctggcaacgtcctccacaccgagagaagagtgagagagagagaaaggaggaaaggagaggaagggagatgctggcctgtcgacgtggcatcctgacatgtgggtctcatgttgactcagctgccacgtcgaacaaaatcggggtcaaaaccaccgagggacctagtttgcactggttttgtaagttgggggatgcgttgtatccggttttatggttgggggatgattttgtaactcgataacaagttgagggaccttcggtgtactttttccctagggattggacatttgatcccaatcaaaactcagaacggtgtgtcaccgtacaagaaaacatatcatcatcttcttcccctactccagtgactagatcagtttgttctccctactccaatggctggatatacttcttcctccactctggcaaccgaatccaccaaatagtactaccatttcttcataaacatacctcctccacctcctcttccaccgcacaggtaccaacatgttgatgaaaaatccatgcttggccgatggtgccaaatctgtgttggcgcgaactaagttgatgaacacaatggccagagatatctacttagttctagtgcaggtccaaaatattgatgagatatgggcctgccggtcagtttgatcctccaactgacaagatagataaatatgttgatcaccaaaaagccgatcggctaacgagccgatagaacgataccagctgatgttgatagggttttgaagaattggctatatatccaaagtatattctaacacttgagtaaataatgatataaagacagtcggctgatgataatgtaataaaatgacaatataaactagtagaaaccaatcggctaataatgataatatagaataagcgttgatccgaaggttaaagcatacatcggctggaggtccaatgtcattaaatccaaaagattagataaacaatgaaccctttcttgcgaacgactaaatccaacttgtatataatccttataagccgatgcgacgtctagataactcatcgtctgaaatcccgataaaacctttattggcaatcaaaaagtaggctagagactatggttctaagcacgacttagtaggtcaaacctaattgatgtagcactaagtatgaaaagaaacataatacctgacaatcaattcttgactgatttttagggtggtagatattttagttaatctagattgacaaaataatttagtcgataccggcaaaaccgttgaaaagatatgacagatacaagtaaattgaataatcgacatagattaactaagatatatgataaataggtaggcaaatatatcaaccgaaccagagcgatccaagaggtcgaagcgatgcagtcttgaacagcaccaatgtaggcgacacaattgccagccccgtgtcaggtgccaagttccgccagcgataagtaaaaatctcggaaaaagggtggcgatgcaccaagagtagttgtattgatcgagagatagattatgtcgatgagggatacccgtagactggataaataaggtattggagtatgttgataggaggatctacacgatatgacatcactactagaaaaacaatttttcgtggcgtcacactataattttcaccggcggttatatgctaaaactgacagcaaaaacgtaaggaggggtggggggtataggatcaccagcgaaaatcgattttcgttggcagccacgttaagagatccgccataaaaaatactatatttttcgaggtggacctcttaaatgtccgccagcgaaaacgacattttcactggtggctactaaagagatccgccagcgaaaaacaaagccacgctaaaatttttatgacggtatttaaaaccacgtgcgcgagataaggatttcacccacccacccatccacccacttcctctctcctctatatccttctctccacccacctacccatgccctctcctcctcgtcccccatctctctcccctcctccttccctgcgcccctagcctcctcctcctgccggtgactggcgacggcgatgacggtgaccacgacgggcaggagggctgcgggcagcggatgtgcacgccgacgacgctggcctgccctccccttccttttccagatctagccgaagggaggaggcggcggccgccgtggcggcgacggtaggcgggcggcggcggagctgacgacgacgacggcgacgatgctaccggatctggtggctccttccctcccctccctctccctctcccagatctagccagagggagggggcagcggctgccgcggcggcgacgccaggcgggcggcggcggagttgacgacgacgacaacgctgccggatctggcggctcctcgcctcgcctcgcctcgcctcgcctccctccccctctcctagatctagccggagggaaggggcggcgatcaccacggtagcgacggcaggcgggcggcagcgaagctgacgatgacgaccgcaactgtggtgacggggctgatggtggcggtggctaggtcgcgggagagctctagtcgcgggaggggatggggccaatggtggctagggttccattgctagatgtgaatttttttgtgcatgttgttccagatgatgcctatgttttgatttgtatttcatgtttgatctgtgtaaatgatttgcatttcaaatttcctctctgctggcagctagggcagctacattgggtctacttttttggcccaaaataattttttctggcggtcgttgtaacatagccgccagcgaaaatgaattatcactggcggtcggtgtaagacacccgctagcgaaaatggatctttgttggcagttggcttaagacggccaccaacgaaaatgaattatcgctggcggtcgatattgctttgtgacggctccaaattctgctagtgaagactcaaaatggccgccacgaaagatggtttcgtagtagtgcatctaacaatcaaggagacaaagattatactagtttaggctcctcgtaaggtaatagctctaatccagtttatatgagattgatatggaaaaccacatagtacaaagggaacagatgaattcggcgtttctggcgagatccttgtcgagatgattcgacaagatctctcggcgggtaggcttcacgtcctcccgcttcgtaaactatggtgggtgtgttggtactatgattcgatgatctgaacaattcagggggtgtgctttttataccgtgagttgccttagtctccaagtagaactcggagacaacgaatcctgtatgatatagaataaacccaatcctcttcgagtaggactctgatagtcacttgcccgtgaggatattttccataatatcttgtagattttcttatcgcatatggaaacacatcatatacatgaaggtatacccagattacaatgaatccgggtgtacatacttatgcccatcaacacatgtttcctaaagataaaagtaaagatataagtcctgatcggacactaaataaacacttcctaaagataaaaaggaatttactaaatcctgcctaattaatagatagaattaagccaacatgccatagtcttcacgatttattcttgagctcggtctcttctggataagtttccatcggctgattgtgctatttccttaaccgaatccactaaaaattttttaccaaaatttgatgttaacacaacaccagcgaagcctccaggcatcaaccctcccgttgttctgctccctctccttcccctgctcgccaccagcacgccaacgtgccagtgccaccattgatgacgagttggatctccctgccacgcgacgcccttaaaatcaattggaggggatgaagaagattgtggaggagggagaagggagccagcagggaggagggaggatcttttggcggaagtggtggctttgcatcgaggggggggggggaggggttgttgttgcttgtgtgggaccatcgaggtgaggataagggacactcgcgtccaagtcactactacagataagggctatagtagcacaaccttgtaaagcatgaagaaagatgttgctgagaaatattgcagtagcactaaatatgtgttacacactaaggttgtaacacattctaaagcaagtcagagacagtgttacaggaaagacaatagtagcatataacatgtgttacgatgggtggttatcagcttcctgcatggaactgcgagtatctttacatttgtgacaatggtttgtactaaaaagtacagttatctaaatttactacttcaatgcgaaacttgatggaacatgctatgcacgaaacacaaaaattgaggttttgttgacggagttatacagagaaatcaggagaacccaaaattaataccagagctgttgggccatcaaaactattgaggttatgctgaatgtgagctaaaattggttcatgaagcataagaatcttccatgagagcaaggttgcctaaaagtgatgatatcatcaaacaattgaagcaagtggtgcttttgaaacattttcatgtatacaaaagctgtggctaacatacatgaaaaaatagtagaaagagagacagcagccagagaagatgttttacagtccagtttgtttaaaaattaaccatcttgagcaatacaagggaaaatcttctatacgccgatctgaaggatttcttgtgcacattcacagttgacatctgcataagatcaaagagggaagacataaaactaaatgaagaaatgtatttgtgtaaaggaaaataaaattctataaatggataaacccaaacttttgttctaattgagttcagaacttgaaacataacaatgggaaatttttacaacaaacacagcatgcacatttttgaaatgcccacaacaaaaaaaattaagtgcatagaactagaaaccagacaatgaaaagagaagtacagttaacattgccttgctacattaggaacaaatatcagttatgagcagtattcatctaagaaaaacacatcagtgcaaaaagaaagaaatagatgcatattactatcatgaattatgtacactgttttgtgcatagacaaaaaatcatgacttgagttttcacattgaagtatggcatccagctttatttcattgcactattctgaaacactgtcaagagtcaagactattgaagacaaagttcatacactaattctcatccccatcattaaaagtttagccagttatgtaacttttttaactggacttcaaactctgaactctgtaccagtaatctgtaacttttgaagttatagcttcagttctcccttaattcctacaaatattcacatttttcccagtatgtacatgctaaaataaatcaaaggcatcaaacatgttaatacatgcacttattcacatttattccaatatgtatttgctaaaacaaataaagaaaacgcttgtcataacatgctccggcattaagattcatggcattggctcattgatgcaaagaatagtttttgtgagcatacctactgacactagtcactaatgtactttcagaccagcaatatacttcaatcagaactatgcacaagaagaatgactgcatcaagctgcatctgccaattaaatgaaatttcatctccgcactgaagcagaacagagataaaaccatccatgggtgcaagaacagatcaagcctgttcactccagattatgggagaagcaaatatgttcctttcgataagatgagaagcgaaagagctaccggtgagaggggcaccaatgcaggaaccggaggtggaggaggtctgcaacgtggctcagcccaatgttgaataaaccccggcgcgttctagttaggatagttagttgagtttccttgttttcagctgagcccgagttttgggcttgtcttgtacagaggctcgacgtgtgcacgttcacgcgggagtctggtagtcgtgagcgagtctcgcggcacgctcgagctgtgggatggcgcagttcgtgaagagcgtggcgtgcggtgcgcgcgtcatggccggcatggccatatgtctttttctcctataaatagcaagagctacagaaaacgcggtgattctgttatggccgcactaattccctgtccacgttcgtgtgtgttctgtgttgtgttgcagctcccactccggcgagcgctccgacaccggcgagggtcggaacagttggtatcagagcggaagatcgtctggcggccattctccgctccgtcccatcggagatgcttcccacgctccgtggcaagcgctcggcgcgagctgcgtgggacgtgatcaagacgatccgcgtcggcgtcgagcgcgtgcgcgagagcaaggcgcagcagctccggcgtgagttcgcggcgctgacctggaaggagggggagaccgccgaggacttctccgtgcgcatcaccggcctcgccaacaacctccgcacgctcggcgacaacatctccgatgccgacgtcgtccgcaagatgcttgacgtcgtccccgagcacctggaacagatcgccatcgcggtcgagacgctccttgacctgaacaccgtttcggtcgaggaggtgaccgggcggcttcgcgctgttgagcaacggcgtcacaggtcggggcccgtcgtcgacaactaggggcggctcctcctaacgcaggaggagtggatggcgaagctcaagaaccccggagcgtccggagagaaggggacccccagcgggtccggcggctccggcggaggcggcaacaagcgtaccgggggatcgcgcgggcacgaccgcggcaaaggcggcactcgccaggctgccgggcctggagacggctcgaaccagcccaagaagacggacaagtgctactgcggcaagaagggccattgggctaaggaatgccggtcacggttgcgggacgaggcccatctggcccaaggcgaagaagaggaggagcccatgctgatggttgccacggcgcaagtcaacgccatctcgtcttcttccccgcgccgctccacatcgctgccggcgcttgaacagatccacctcgacgagagtaagctcttcgttcagctgggcggtgagcacgaaggagaagccaccagatggatcctcgacatgggcgccatcaaccacatgacggggacgcgatcagccttctccgagctggacaccggcatccgtggcacggtcaagttcggggacggctccgtcgtcggcattgaagggcgtggccccgtcctcttcaagtgcaaggatggggaacatcaggcgctggagggagtgtaccacattccgcgcctcaccgccaacatcgtcagcctggggcagctcgacgaggagaagttcaagtggagctgtgaagatggagtcctcaagatctgggacaagcagcgtcgactactcgccaaggtggtgcgctcgccgacccgcctctacgtcgtcaagctcaacatcggaaggccggtctgcctgcggcacaagggagcgacatcgcctggcattggcacgcaagattcggccacctcaacttccgcgcgctcgaaaagcttggtcgcgacgtcagggtgcgcgggcttcccctgatcaaccaggttgatcaagtctgtgacagctgcctggccgggaagcagcggcgcctgcccttctcgtccaaggccaagtaccgcgcgaaagaaaaactcgagctggtgcatggggacatctgctggccggtgacgccggcgatgccaagcgggaacaagctgttccttctcctcgtcgataacccattggcatcccactgtcatcaatcattacgcctccaccagtcaacctaacccattggcatcggaacagagggaccttgagaggaccatagtcaagttcccatatgtcctcgatggcaccgtaatacgtgccagttgttccatcgtgtcctatggcatcgatacgaacagcgctgttttggttcgtgctcttcatgtcttgggctctcgtgtagaatgtgtacccattgatctcatatccctggaatgtcgcgatcgacccagattgtcccctcgccaggaaagccagttgttggttgatcgtctcgttacccatgagaggttgtcataaccacgcggggaaagtatcaatgtgatgccgtgtaatccatgcatcggacttaccgatgtttctggcgcgaactagagccaagtgctcctcgatgtaaggagctaccaatgaagattgttgcagaaccgtgaaatgggctttacggaataaattgttgtctaccgtcattattgctttccttccgagagttccctttccccatagtctcccttcatggcgtgattcaggtaccccgattgggcgaaggtcttcaataaattctacgcaaaattcgatgacctcctctgttccataccccttggcgatgcttgcctctagacgagcacggttacgaacatacttcttcagaatgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccggatcaatgaccttctgcgaaattgcgttcatgaaagcacatagctttgttattgttgcccggacattgtctggaaggataccccttattacaactggtagcagttgtgtcatcaacacatgacagtcatgagactttaggtttgtgaacttcttctccttcgtgcttattattcgcttgatattcgtggagtatccagacggtacctttatgctatccaagcattcaaacatactttccttctctgccttgctaagagtgtagctggctggactcaagtaatggcttcctttctcctttggttctgggtgaaggtcgccacgttgttccatatgcttcaaatcattacgtgcttccagtgtatctttcgactttccatatacacctaggaagccaagaaggtttacgcaaaggttcttagtgaggtgcatcacgtcgattgcatggcggacgtccaagaattcccaatagggtaactcccaaaatatagagttctttttccacatcgccgcgtgaccatcttcgctctctataggctggcctccaggcccctttccgaacactactttaagatctttaaccatagcaaacactgttttcccgctgcgatgtttaggcttcgtacggtggtccgccttatgttcaaagtgcttgcctttcttccgtaccgggtgatttgctgcaaggaatcgacgatgacccatgtacacaaccttcctacagtgcttaagatacgtactttctgtttcatccattcagtgagtgcaagtcttgtaccccttgttggactgaccggaaaggctgctaagtgcaggccaatcgttgatggttacgaacagcagcgcttgtaggttaaactcctcctgtttgtcctcgtcccacacggggacaccttcctttttccacaacagtttaagatcttcgaccagtggtcttaggtacacatcgatgtcgttaccaagttgcttggggccttgaataataatcggcatcattatgtacttcctcttcatgcatagccaggagggaggttgtagatacacatcgtaacgggccaagtgcagtgctatggctgctgctcatctcttcaaaaggattcatgccatccatacttaaaccaaaccgtatgtttcgtgcgtcctttccaaagtctttaaattttctgtcgatgtttcgccactgcgaaccatcggcggggtgtctcaacatcccgtcctgttgacgctcttcagcgtgccatcgcatcattctagcattccccttattcctgaacaaatgccttagccgtggtattatagggaaataccacatcaccttagcaggaattctcttctttgttagctacccgtcaacttctcctggatcgtctcgtctaatcttgtatcgtagtgctttgcaaacaggacatgcttctaggttctcgtactcctcaccgcgatataggatacaatcattcggacatgcgtgaatcttctgaacttccagtcctagagggcagactatcttcttagcctcgtacgttgtctcaggcaatttgtttccctccggaagaatgttgttgacgagtttcaataaatcgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttcactttcgcagtcctccttggtgtcctgcaacatctgaccaagatcatccgcaacgtcgttaccatcagcatccctttcctcctcgcccgtttgatttccttcaaatccaacgtactgagcaaagtctggaatattatcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgtatggacaacaaataaaacccttatgcctgttagcttcggccactctcaaaaaataatgcatgcctttaataaactctttggaccgccggtcagcgtacatccatcgccgatccatctacatgacatgaaaaaaaatcatacacaaataattattcttacaataatgacagtcatacaataattataaaataattacaaactctttcaacaatcatacaataatgacatatcattattcatacaaaaattataaaatattacaccaaattattcttatttactatttctaaagttttaaactaatattaatgtgttttacttcttttaattttcattttagtttgttttctattatttaagattaactttcactattttatccttctcaacaattttataaaaccttctttagcaaataaactaaatttctatatattctttcttccccacacaaattttctctctcatcaacttacaactaaattttagagacaaaaaagtgtgcaaaacatagctccaaatgtaatacgaaaaaaaaacattggaggatgaagttgctaaccttttaggcacctccgatttgtatataatcaccaaaataaattcactagaaattttggcatgacctcccctcttttttgaagaaattttaaagcttgctcgggcagctggaggaggaagaagacatatatatataggggtgggactttagtcccggttggtgttaccaaccgggactaaagttacgatccaatcgggactaaagatcaaatatgcccgttaccccttttaaccgagactaaagatcatctttagccccggtttttattgcaaccgggactattgtggaattcagccgaccgacgaaagatggtttctccaccagtggctccaaccctcttcgctgcttccccactaccatcaacgtcttccacccgcaagcttcgttgtgctgcccccatcgttctccctcgctgttgtgcatccagtgcgggggcccggtcgggttccgaggacccgccgggggcgggggtgggggagattttgccccgaactcctggtcggggtcggggcggggcgaagaatgcggggccggggccgggggcgttctacctccacccacccccgacccgccccgttgccatccctagttgagccccttcatccattttttttctttttcctttaccagatgagtgggcatcttttttttccctaaaaggggccgaatgtgagtggtggagcaccacacatacatgggccttaaaagtccacatgcatgatttttttaatataaattatttttctaataaattttaaatttgtatgtataaactttatacatacaaagtttgtacgtgtacaaattttatatgtataaagtgttaaatatgtgatccgaatttcaggcccacaatatattcgaattagttatctaataggattagttatccaataggactctactttatagaattagttttctattaggactcctagatttctcctatatatatatcccttgtaagccgtacggggagggtgcgacaactcaatgtatcccgtatcgaactccacaatagtgatcattgccggtccgcgcccgttgttttttcccgcaagggttttccacgtaaaaattcgtgtctccgttttgcatctattttcataacaagtggtatcagagcattggagatctgttccgcaattcacccgctgccgtgtttcacatctacgtcgtttcgccggttcggcgatatcgatcttccccacgctgttgtcaggagttttcggcgaaaacgactctgcgtagtcgaatcgatctgtctcgccgagatcgatcttctgccgccgcatggatttgttggctcatcaagtccgacgcggagtcggtgtttttgtgcgaggataaaaaggcgatgcagcagccgtcgtccacgcctacgcagccgcacgcgtcgaggaagcagcagccggccggtgtcatcctcgagcacacacaggtggagaaaaatcagaagccaccgagagccattgcttctgttctgatcacgtgaattaattttcacggttggaaatttgtggcacacggagtttaccaggaattaaagttctgtgcattgcttggttctgtcgaggtgaatccaaattcactttcaaaatggctatatttgcaagccaagtttactaagaggttctgcacggggatcaaaatactttgttttatgcagctagagtgtttcgcgtttctgctagggttttacaaattataccagcagattcaggattttattctcaaggcgagtttgaagtttgatctaccgctcttggattgagatgcaatattctcattatggtaagtgaagttttattatggcaagtgaagttttgcagcggggtatttacctaggaggagaagtatgctgaaaaaaaaaagagaagcacattcaagtcgtcgagagggagcctcgctcctgtctagatcacatggtgatcaaattgtccggtgaattttgctaccattgtacccaacataccaggatgttatcggggatataagtacttcgttttgtgcacaacaatttttcgcgtttctgtttggattccagatattaacgccaacagattcatgattttattcccatggcgagtttgaagtttgtgcatcagtttcacgtctctgctgggttccacaatatcataccagcagattcaggatttcttcccaatgacgagtttgaagtatggtctaacttttctggatcgagggtgttatagtatagtcatgcagactatttggcgcacattgattttatcatcatgaggttcttcggagattgaagatttttatgctacaagagaaattcgtctcaaggtggagattgttaaatatgtgatccgaattatgggcccacaatatattcggattagttattcaataggactctactttataggattagtttcctattatgactcatagatttctcttatatatttcccttgtaagccgcacggggaaggtgcgacaacccaatttatcccctacgtttgtatcgaactctacaatagtgatcattgccggtccacgcccgtggttttttcccgcaagggttttccacgtaaaaattcgtgtctccgttttgtatctattttcataacataaagttgtatggctttatacatatgtattgacttattttaattaaatataaagtgaatatatactttgttttgcttatgccaatgttaatgtacaatttatcgggctcaaggctcaatgggaagagaaacctactcggaagcgatcactactgtaggcgcccaaatacgcgtggcccatccaatcatgcggattataaaggaaaccctttctcctcgacgggcaagtctaatgggcgggtgatctctcccctcttcctcctccccttcttctcttcttactacagtataccaaaaaaaaattttaaaaaaaagttaaaaaaatttatgtatagaaatactatatataaaaaatttgaatttaaattcaaatttgaatactttttacttataaactttgggtctataaactttaggtgtctaaactttagatgtatagaaatactatatatagaaaatatttgaattcaaattcaaatttgaatcagatataattcaaattgaaatttgaatcgggcatgtaaacttttgacttataaattttggatctataaactttaggtatataaactttagatgtatagaaatactatatatagaaaatatataattcaaattcaaatttgaatcgggtatataaactttagttctataaactttagttctataaactttaggtgtataaactttagatgtatataaatactatatatgaaaaatatttgaattcaaattcaaatttgaatcagatatttgaattcaaatttaaatttgaattagatataattcaaattcaaatttgaatcggatatataaacttttggtctctaaactttagatgtgtaaacttgaggtgtataaactttaggtgcataaatttactaaaatagaaaagtaatacggtgccaaaaaaggaaacttggtggagggagggagggggaggaggggggggggggaatctgattgctctgggcgtcgcccactagcatttccgctcctcgacatcggactccgatgtcttctattatcatgaaaacaatttccttcctgacttgtgtttccttccacacattttattcccatatttgaatatatcttcaatctaatatcaggtatgcggtatttctatgtattattatgaatccatgtataaaatatatgctttatctgtaacactgacactcaaatgtacgagtaattattcttttgatggtaggtgacgtacatatgtcgatccaaaattatttaccgatgttcattaatgagaaaatccaaaaaaatgtcattaacaagcgtctaattggaagaaatgtcattgagaaatgcgagttccatgaaatgtcatcatacaagtgattttgttctagaaatgccatcaccattaggatttcgtcggatgcaggtctagtaaacgcggagaacactgtttgaacagtgatatgtgtcttgtgctacaatgctacagtagcaacagtgctcaaatagtaatccaatttactggtggatgattttttactgtagcgtgatactgtagcagctgatatgtgccgttcgatagagatccaatggctcaaaatatgagccaatgcaacttatgtactgtagatcctctgcattttactcttcaatgcagaggatctcaatccggtttcgtccatcccacgccgttaaatatacccaccttaccactgaacaattaataaatggttatctttagtctttttacacgagaagactaggcgtcgggtgctcgatggggtgtggaaaaatctggcgcccacgtcatgctgatctcagcaagatgcatgcgtacaaaaccactttaaactattttttctcttaaattatttatctaaatcatgatccgattgcatcgttaaattcgttacaattaaatctttaaaacaagaccacacacgaatatattccgatgaaaaaaatatttagcttattattgaattatttttaaatgttgcacattgttgcaccaagtatatcggaatcgtttcactaagtagatcgaaaatgtttcaatcgtttaaatcgggcgttatttcaccttatataaaaacaatgtttcagcaaatagtaaaagaatgtttcaagtcactgcaacatttgatccatacatagtgaaacattacaagtacactaagtgaaatatttttggtggaagaaatcatgaaacaaattctcttaatagagggtttccataatatatgggtgatttgttgcaaaagaatgtcccaattcactgcaacattagatctatgcatagtgaaacattgtgagtacactaggtgaaacatttttggtggaataaaaaatgaaacgaattctcttaatatagggtttccaaaatatgtgggtaatttgttgcaacggagtatgtggtggggacacgtggcagatgtttacaggggcacacatggtgcgtggtgggctggcacggcatgcgcgcgtcgtgcggcgggggagcgcccgattttttgctcccccgccagttgaccgatccctgacgtttcccctttttatacctctcattggtcttaaaaactccataaatttatagttgtatactagtatattttaaaaggaatagagtaaacaaaagtggtacaattattccgtaaaagtacataaccattctatcatactagtaatcatgcacgtgcaagacacgttatgttcaatatataaattaaacccaatatattataacccaataatctgaaagaagaataggtaaataggaaatagatcataagaaagaggatctgcttcaatcacacttgaagctctaactattccccgctgacttatgcacaaactgcacaattttcataaagtgcatgcatatatgcattctgattttcatattagatacaagaatttgctcaaaaataaatatgatcttcagccaatgtgcagaggtatgcataagccaatgtgcagaggtaatgtctgagaaaacaatggaagaacattagattgatatctcaaaggaagaagatacatagcacaataaattattgaaatggaagtggccactaacactaattatatttcataacagcaaacactacatagcataaaccaaaatccatagtttatcccttgttgccagtgcgctccttttttggcaatggctcaatcaccacttcatcatcttcaactatcaccacttctggttctcctggagcattattttgttctgccggttgcagcagctcttggttcctaaagttcacaccaatcttaatggcgtcatgcaggactggttctttgaacagggagtttctcacctctgcatccattagaacaaagattacaaacaaaatatgctagaacaacaaaaataacagtgtcctaatcaatattagttttagaattgcactcaaaaataaattggaattgacttacttggaatccatcaaagcgacctttctaacactgtttggaaaatttgcataatggtctataggaccgacatcagacacaatggcagcaacatctgtacaaatgtaaacatgtttcagagttagtttcagcaagaaaagaacaaacacaatatacacttgtggttcgatataccataccaacaattgcgccattaggcagactgaaaacttcagcaaaagtcatagctgattcttagaagagagaccttactaatgatctatggaagaggaaagatgagaagaaatgcagtggtgatgtactgtaccgaagtagtgggattggggctagctttataggggggacagattgggagtaaacagcgccttgcgtccgcggcgctccagtgatccgttggccagaaacgatgctttcctgttttacagtgttgataacaaaccttccactgatgaacacttcttgaaatacacaattagattgaaccccaaaaaacgcaaagagtaatttgatattacaaattgattccacgggatattaccaggtgtggaggaagacataggtgtggaggatggcacaggctgaaatgatggctgacaatttacagtttggcttccttcatgcaaactctgattcaaaactacaattcaattgaatgtgcccaggttttagcattgtttgccataaaataagcttgaccataataagcatcgaatgaatatatcatcacctgtgcccgatgtagatgcagaattcttcctctccctgttttcagggttcctttgaaccagcgcacccttctcctcaacgctgagtgccgtgtaccgctctcgggctcgctgactttttaattcattcgcagttagtttagaaaggccgtccatcgcaaggatgtacaaccttgaagaacacaccatgagcatataaaagcagttttaatatgcaacaggttttcgttaatattgatgacagtccgctcgctataacaaaatcccaaatccacattttctaagcatcaattagaacctacatgttacagaataacaggacctactgaagacttttcattttctaagaatcaatttgaaccacgttaatcagaacaaccggaaataactttttcagcttcaaactggaacaaaaatatttaccaaggtagtataatggtccataattcacatttcttgtagaatagaatcatcgacagtattgtacctgaaaacaatatttgctcgaagggagtgtgtgagttgctcccaagtcccaataatcaagcaacttattaagttaaatgagataagtacctgaaaacaatatttgctcgaagggagtgtgagagctgctaccaactaaatcccttgtgtgaaattgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4731 - DNA, 6352 bp, Oryza sativa
ttttgccatcaccatcaatgtatgtcaatgctgttcttttgtcagtaggattgaatggcaggaaatgaacttcttgaataccagcacgggcctgtgttaaaatgtaggcaaatagtcatttcacaacataaccaaggtgatatcagccaccatttcaaaaaccttcgacaaagcaatatacctcttttggatcagctagcatcccaactattgcagtatcaatagcatcctggttttctgttcgtgatgctctagcagccatgagaatcacttggtcctgagtgattcctctttcaaagacctggattaacaaatttgatgctttttaacctagacatgaaagtgttaatagaatagagatttgttttttctcacatcaatgaggttcttgtccacggtgagcttattcaaggtcaaagttccagttttatcactgcaaagaacatccatgcccgccatctcctcaattgcagtcattctctttgtgatcgctccctgaatattttaagtggttagcacattatacaaaccaaaactgaaaagtgacatacataaagcaacagatgcaaacctgttgagacaagcggtgtgacccaattgccatagtcacagataagactgttggcatggctatgggaatgcctccaatgagaaggacaaggaggttgtcaatcccggggcggtatgccctgtgctggatagggtacattacaatgatctcaacaaacattcccacagcaattgagcaaatgcagaaattcccaatagccgtcaggacctgcgataatcagataataatatgagtgaattaccatgatagtttgatgaagaatacacacatgtgaggtgagcatttcaaactaaccttctggaaatgaccaacttggttagttgagtcaacaaggtgtgctgcttttccgaagaaagtgtgaacaccagtagcaatcactatggcttcgatctcaccttgcttgacagtcgaaccagaatagacaccatcaccaggacctttggtgacaggcaatgattctccagtcagggcagactacaacatgagagatagtgaggagaagccttgatggatcatcaaaaggtgaaggcaactttaagtcgagcaatgggaagaacctgatcgatcttcaaaggatctccctcaaggagacgcgcatctgcaggtataatgtctccaagtttaatacttacgatatcccctggtacaaggatggccgcctcttcctcagtccatcggccatcacgaagcacctgaagaacacaaaatatgtctcatggattcagaattgtgaatgggccttacaggcacatgaaacctgccttgagaacatagtgaacagcataaaaggtaaaaccttggcctttggtgcaagacgggccatgagtgcagcagcagcattgccagcattgttttcctcaatgaaactgattgtcgagttgataacaagaagagttatgataccaacaaagtcctgccaatccggtggcttcccctgatgatacaacacaagacaacaaatgtgttatgtaatcaactcctgaattctaaccaacaagctaggcaaaatcggaattggctcagatatctaactgccttacccctccattcgccagcgcaatggccatgatagctgcagcttccatgacccatgagagtggattccacatgaaccccaaaaacttgaggaacttgctctcctgccagtgccaccatcaaagtcccaactcttaagcattttcagacatctcagatgcatttttttctgaaacagtagataaggaacaaagcaaacctccttctcctcaagcttgttggggccaaagatttcgaggcgctgctgcgcctgctgagttgtgagaccctcgcggctgcatctcaggttctcaaacacttcctcgaggggaatattctcctgcaggaaaaaaacaaacaaacaagaattcaccaatccaactccatggacgaaaacggaaacacaagaagcatcagcccgcccaccgaattgtcagccgtcacctattaatgcatgcagccattgccactacaactactatttcgagaacggctgagccagaagcaaacaaggctggagctggagatgccaatgtcgccaccatggaattatttggcagaacgaaccgcagaaacccagatttacaagagcaaataaacgaattcttacagaacgaaaaagggaaagaaagaacggcagccatgcagggtgctaaagaaacgctagccagtcacaagaaacgccaagaaaacaggaaactcgtgagtgattgccacccaagaaaccaggagcacatgcccgaatttcgcggaacaagaaggagcaccaatctagtaaaagaacggaaaagagagcacaaagacgcaagattttggcgccgccggagtagaaagtagagagttgagagtgagttccttaccaagtcgacggcctccttgaggacggcgtcgaggttgccctccttctcagccatgaaggcacctcgcagatggatctcccaccactgccttctcacctctctctacctgtatcccacctgttcggctcccttccagatttatttatatgtgggataagcaaaggaaatcttgcttgcaaacgaatgaaagttagtatatggataatttacctgtgcaattgcaatctggatggaattggatgggggtaactgaaggtgaaggtgaaggagatgagatggttgtggagagtcacagggagaggagtggtaggagtgggactccactccacaaatgaatgaggaggtagagaggaatgtggaggaacagagaaacataaccttttcaaatacacatggaataaattgtggataaaaagccacatgaggaatgaaacagaaaaaaaaaagggatatttttctggaacagagtaagaaaagggggatttttatctcgtgctgcatttggatttagggtttgttggaaccatgccaccctatatttgtaaaatttgagatatgtcacccgtatctcaatgacatgtatgacccatatgagtcaatgacatgtgggtcagggtggcatatcacaaattttgcaaattttgtgtggcatgattcaaattgtcccttggattggatgggatttattgtagatttgtagcccttccgagaactcgtttgctaaaactccaacttctaaatttaacttaagaagttggatctggagtggagtcgtgaagcaacataaatctaactccacatttctagttcatgtataaaatcgttagcaacaagaacaaaaaattacttcatatgttagacattgctatcaaaattatatataaagttggtggcaataagaaaaaatatagtccactccctagcttaaaacattgtcgctagacgatgctcccacgtgtcagccttttaactacaattaataactcctaataatatgtggttttacctttattttttatttttgaactttcttgtttttctattttaaaaataaacattttagaaacttatttttaagatcaaccaaacaacaatatcacgtcagtctaaaataacctaaaataacctgagagcattacttagctagctgacgtggaagtgttatttgttcttactggcgtagcaaaacaaaactatcatgtccattgtgggtagcgtgacagtattattttgccacgtcaggtgagttggcgtagctaaaaagttcaaatttttggaaataagttttaaaagagtttatttttaaaacaacaaattaaaaaggttaaaaaaataatgaaaaaaactatttaattctgcttggttgtaacttaacttttaaccaagcccgaggaaaaaaaactaattttatccaaatggcatggtcaacatatcaacatctaagggacaaggtttgaattcttgtttagaaaaaaataaaaccgttgataaaattaaaaaagcatgttttgcaccccaaaaaaaacccagcattaccagtccatgaagcatcaaaaaaatggatgctaaaaatgcttgagcaccaacaaatcaatcaactcaacaatatgctattaattctgtgtaaatctctcttgatgttggtaatcatcgaggcaataggccatactttccattattaaactgaaaatgaacagggattctgcctagaactctgtgtatgtatacctaattaacaatctgaaggagattaggttaggtgagcaaacggtgtcaagtttcatcttagcaagtcagcatccagttgctgattgcatgactattgtcgtttccctgtacggatcgtacttgtgggttatcctgaaaatgaaccttccaatgcttgcttgggttacagctaatcccattttcacacatctgacctacttcctgaccatttctcatttgaaatctcacactagtttgtctgttcaactaaatgagctcaaaatgatcctacccttgttatttttcggttattttaaaattttgagaatgcaatcgcctttttttcccgaaggatatttggtcaatcacggtcttaataatcagtcagtcaagacaaaaattgttgtcaggtaaggttcggttgttacttggagactggagaggtgtaactttgtttcatctagaggtaaggttaggttaattaggtgactccgttcaactgtccatggaaaatgaatgtgcagtaaatttgcaggctccctacatttaatctggctgggtaaaacatcagcggattctgaatatatgaatcctcccagaaaaaagaatatattgtcccagcatcaaagctagctaatttcttttcgttctacatctgatccgttttatcaaaacatgcagctatgtcattttgacatcgttgtctcaatgatatgaaatgattacagagtggttcaccgaaagaaacctttccttcaattagattacctgtcaaacggaatgttgtgtgcgtgtcgagtgtttagcatgtttagatttgtacctgattgatatgactagaagagttggatgaaagaaaagggtcggtacgacatgtacgccataaacaaaatcacagagattgtgaaaagagctggacgattagaaataatgagatgccaataatttaagagagaacgaaataatttaaaagcaagcttcttctcgtgtgtcatttggaacctaatcactaattaatcagactcttaaggaaggaatcactgatgaaatctgagtactaattgaacaccatgcggcaagttgtccagttggagttcagaacaatttgatggttttttccatttggagtaattaggtaatccagatagaattgcttccaaatggcgggtaatcatactgagaactttaatcatcgagcacgtaatcatctgtgagaactgaagtgaaaatatatatatatatatatatatatatatatatatatatatatatatccttgggtctgccgctactttcatgcttattagcataaaaagtttctcttcaaagttgttcaccagaagcacaatagaccttctgttagcataaattatagaacgcatgcatgctggagtgctggatacatttccaatcacacaagtaataaaccaacaaatgaattagttatttgctggtcacagcacatcataatttgcaaggttgcatccacgatccaataaaaatactaagcaagaagggagaacaaacttggccaggctctgtccttgctttctttccctcttcttttcagaaaagcaagagcacaacttttccctttccttcttttcaaatagtagcaggataaaaatttccagaaagcaagaaccaaagatgaaactaaagataatctgctttaggtggtgcactcacagtcatgcgtgcaaaggaggtagcaatcttgggggtaccatttctgttttacttttgcaaccatgcattcattcttggtgacttggtctcatccttttcttttatttcaagttaaaccatttttcataatcctaattaattttatttatttcctctcagtgtcttgactaatgcaaaaggacacatactgttaaatgcctttctgaaacccaaagaaacattttgcctgaggtctaggagccaccaaaccaattaattccaactggctaatcaaacatgatatcaggactaagagtaataaccaaaaaggagtaagataaattttcaactttcaggcttctctcactaaaagaaagccaatactactatatgaaaatgaaccaaacatgtaacttgtgagcatacttttatgacaacaatgaagaggtggtaccggatatggaggttggcctttcagacagaaaaggtgaaataagggagttcagaaaggactctttactttgatggacag

SEQ ID NO: 4732 - DNA, 7814 bp, Oryza sativa
gtacacacactaaggctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctaaggcagcttcaatttcacccaaaatctcctttagatgttccctagctagccaatcatcatcttaatgataataagattcaacctggatcacatggttctcgctgtcatcgagatgagatagcctaccaggccgatagagctcatattcatatcatcatatgaggatgatgaactatacggttggttgattgatcgatccattcataacactgggtatactatacatgcatgtgatgtgagcattatgtccaaatgtacaatcacctttagattctctaatagccagctactacaaatctcatgcaagcagtttggaatgcccacatggcactaaggcaacacgcggggaaaaattacgagatgaataaaaccacaaagattcagcaccaagcatcaaacaaatcacagcgggtcgccgatcaaactcccaccaaacgcaggatacgttcagtgggttcgtttgtttacggccagaaagaaaagacacaacaatatgaatgatagcgggcaacagccaacaggattccattcgcctaagcaaaggaccaatctacaaggtagtaagtgatattacatggatattcagatagatgtcagtggtgggcgccagcgttacacaaatttatcaggtccataagggtagagtacaatacttcaagagaaacatagcccaaaaacctacgcttctcaaactcctgactatctgctgacatcttcccatcctccgttgggtgatcaatagtaaggtaccaagaaatgcatccacaggtgtcgtccgggtcaacattcgccaccaggccaagcgtttcaccttgctcaagatcaaagtaaaggcacaggaaatctctagtcacattcataccgagaaccaatgcttcttcatgaagccagtggattacttgactagcaacctgaacagaaaaaacagtgagcacatcattctgacaaaatagacttaaaaagcaattgttgtgacatgggtaatattcatgggcagcacagtattacttggaaacaaatccttatgatgatccacttggattaaattaaatagcccatcaagacaaccaaagttgaacaatgacaggtctatcaaagcataaacatcttgctccctttctcgcactgtattcagtgctttcagttttatattacatgaatggccactgccttccagacctcttatgtgggacaatattaacctaaaaaaatgtggaagcatggcaaggcactagaatgtttgtactggtgtcctgttcaactcaacatgcatgccacattcattttgaactgttaagcaaactaatcctgtaggtcaataggcacaaatgaagatttcctcagggaaaaaaactaagaaaaatgcattaccattgtgcatttcacattcaaatgcaaggagtttatgttacacatttgcaatgcaagaaatagtctggctcattgcattatcaatggaccataatgaattccaatggtaataactttaataatttcataaacatgatctaccaagaaataatttaaatagtatcatcagaagtttacctgctgcagaagcattgttgggaggtcctccaagtcacaattgtagctatttaccaaatatccatcggagggcttcccagtcaatgatccagcaatgcttggggagccttcacccattagactaatttggctatctttcacgatcaccttagtattgaactgtgacctggatttgtacttaagttcatggttatcagaaggctttgcaatccgatctgcagcaaggataggctgaggaactttcaagcatagagaccaggaggaagttcgagaatgccaagtaggaagagaacgcaaatggagatatggaaccctgctgacctgcaatacagaaaggaaatttaaataatgatctacatgcaaatatgtagcatcaacaagcttataggagctataccacactctcaagctccacgagtactttgttagaaaatatcctgtgagccactgtcaagcagaaatgacctagcaggccataatcatcacctgcaacctgagcaggactttggtagcgaccaatgttaagggatttctccctgaccttcctaagaatgttctcatgaaacaattgtagcaagtaaatttccagacttctgggattaggaaaccctgtcacgtcttttcttaaagggtccagcttcccattcatagtgaccaacacaagatttgaggcatcctctgaattggcatggtcttcatggtctaccatttctgagtcactaccatctccagaatgagcaagcgagaggcacaatgaacattcctgaccaatagctaattggagaaaatcttcacgcattccagtcacattgatgccttgagattggacaaatgtctcacggatcaccatatcaaatacctacaaaggcatacactaagctaagccacagaacgatatacataaataaataatgataaacccggggagggaggggtggtggtggtgcaagatgtcatcacatgatatacaataattttccatgatgctatagttaaaacttaattaagagcattctatacaggaattcttagcatgccaagcaaacacttagctgacctgctcctcaaatattgacttgtggatgttgcgaagaatagaatgtgcatgtttgatggatttattgacatcatcattgtctgtttcagaggaagtgatgcttgagatgccatctttcagtttatgaccgtagttttccacaccattggcactgtcccctcgaaaattaagactcaagaaacggcaagatttttgagggacttgtacggacaaagtgcctgatgagtcttggtcaattggaatcaatggtaatgatgacagtcgaggcattgctgctgtgtccaattgagaagtgtcgatcagatcaaacatgaagccctcacttcctggaccacttccaccaaaccgttgccgcttcactttccagttctgctgcaatctgccaccaatccgcgagtaattcatggtgcaaacttgggtgaagtggtattgaaataacaactcaagttaagcaacaagacatgcctgattaatgagccatagaacctagactctttttggaactgctgctccattgttttggcagattgtttgaagtagcgtgacaaatgctgcgaggacacaaatgaagatcacaacaggaagcatgatagatgcaagacggaagaggaaagtggcaagcgattacagaaacaaattgagtttgttttaggttccattttgttccttagccgtgaattgaagtaatcaaacataggcagtagggtgacatacccgaacgcgctgaagcttggtggctgcagagactgcggtgtcaactaaggtttcggttggcagcgatttgggcttgagcatcccagcgactgccactgcatcattggcttcgacctgcattatcaagtaggattgtctcctctgtcaggaatacaaacaatcgcatgcaaatagaatggggtttgcagtattgtgtgtgggaaaactgacagtgaagatgaggtcaatgacgacggagagctcctgctgcgcctgctgcaggctctccatcatgccctgccacggccatgcctgctgctgctgctgctgggcggtgtccttcttgggcttcttggcgtccttgtcgatgacccaggagaagtcaatgcgccgattggcggagaggcgatgctcctcgctgctggtgtcgctgcggaatccgaatctcagtgaacgaagaaagatgggggttagggtttcaggggaaggcaaaaggttggtttggtttggtgcttacggcgggtagtgctcgttgccggcctcgtcgatggcgtggaggcgcttgatggggaccatgtcgaggtccacccgcacggcttcctccatgaagaaggcgaggcagcggcggcgaagggcttaattagatcggagacaattttttgagtgaagaaggcactgccttggggctcacgagtcccgctcaagagcggaagggatccccccgcgggaagcaaaaccgccggccgtcggggtggggccgccccccggcgaggtcgtcgggcggcggagtgaggaggagcgaattctcgatcgagtttgggtgctggactttggagtttcttctctggaagagagtatgatgggccttttttgactttgggccggcctaacaagtaaatgttgctgggctggcctggaccagttccagacttccactactccgaatgggccggagtttctttttttattttccatttctcaaggcccctcgggagcaggaattatctcctagcaatggtaaaacgaaggcttatatcagagagctttttcttatcaatgcctacaagacaacaaggcctgttcttctgttgttcgtccatggatcacaagtttcagggaacaaaactctctttggtgccggtggcaatgatattccaaactcaaccgcaagttgtgatcaatctgcaacgtatcagggacgacggatatttcacaaaataagtagtagtatgtcgattcttcagtccagcttctgaattccaggccttttgaagttgagcaagcaagtaaattcagataatctctctgcaaaccaactatacagtgagtgactgaatttctacttgcgcggatcgatgtgccagagcattgccaatcacagaaacaagttgcagatgagattgtcatactagcttacaatcaatgccaccatccgctcaaaactcacagcaatcaatcacaacctgaagaaacaatgaggacaaaccactgtccaccggatcgagttggcaaaacctggacgaccaagggggttcggagaataaaactccgacccctattcatgaaaaagaaaagcaccgcaaacaattcgtatcataattcttgcaggtaacaccgtaacaccataagtttgagagaaatgcgccaaatacaacaaatttggcgatttgtttgttttctctttttcaaaggtagcatatagatttgccttgataatagtatcaacagatgcagcgctataaccatatatactccatttcttctccattcccttgcttcattgatttatgacatactcagaaagactaaaataagcatcaatttcacacttcacaggcctgttgttcacaactactgagctgctgtgttattgtattgctactaatcaataccagcatctctttagaaaaatcattagcgatacacagcttacattttattggatatcactgtcattgtatcacatccactcctcccagatcaacatatgcaatcatcatgcctatgccagttttttgcatggtaaattctactactaccagtggcccagtgccatgtgatgtcaaccccaacagctttgtatattattaccccttattataaacgcatcatactcactattggggggaaaacatgatttttcatgctgctgcgagagggctagaaaaaagaagttgcagtcttaatatatcacacacgcagcatgagagcagtgacataataacggctacggactaccattcacaatagtttcaatcgttgctgccgaaatcgtcaaaacatctaatttatcattagctcgagattggcagctataattgatgacagcgacaaacagcatagacaataagacatctaactacggatggattagaataatccatgcggtagggggctaatgaggattactagcagtagcagaaggcccggtgagcatcttgtcaacttttgccaaaagcccctgcatttccccaagaaggttttctggcatttgctttgatccatctgatggagttgccttcttgacagatgaatggccagccagggatgagatcatcctctccaggtttttcctaatatccgtaaggggaggctttgaagctggcgaaggcacgctcaacttgattggaggaagataatgaagccttggtgtagcaaacgggggaccaaacataccaagagtttctgcgctgttgtaagccgcctcagcttcagcacttttcccaaacacaacacgagcgctatgggtatcttttacgatgtccgtctcagactcaatcacgagaccaaacttaccaaatgcagagagcaattcctctttggagggcagaacaacaccctttgcaaagtccaaaagaagggctgctgggtttccaaagtgctctgcaattttcttcttctttttcttaggagtagaataagctatatcagggaaagcactattggtagcttcaccagaggaatggtttacattagctccaggaaccatcttcttcaggctaggctgatcggccctctggccctcatctttgagggaattgcttgctgctgctacattagtgccattggcgacctccgctttcataagcatttccggcaccatcgcttcaagggaagcataagattcttggaccgtacgcacttcggcgcttgcatgttctttatttccatctgtcggctgagatagggatacgtcttcacttttaggaagaggtgcacttttgtcagtcacatctacagcagcattctgcccatctctgtgtagaggaatattagcttcagacttcactgcttccaccggaacacatctgacaggcacatctactacaatgccttgcacacctggatctgcttgaatgttggtatgcaactgtcttgcttccagcatacctgcatcattctgttttgcaggttggtcagataaattcttgcaagcattggctggggtcttcaaaacagatccaccatttgctttgtcctgctcctgtcctggttcttttgctaccttcgctgaagctaatgtagggctcttaaagtctggcttgatcttctcaagctgcacaccaactgccataccccttgcaccattctctggtttcgtcgggcttcttatgtcttctgccctcgcttgcctgataggaatagcaggggtaattgttacaccacagcctagggcagccgcaggagatttcttccccctcttctcggtcttggtcgaagaactcccaccctcattttgcccctgttttctggtcctcttcaaagcacacttgcctggtttcagagcagcacgtgaatttacaaaagaatcagatgtctccacagcagcatttgtaaaagcattctccgtagaacactcgtgtgctataaaggacttgtagtcagcatcctcgaccaacaatgaacttgtatacaaagaaaggaaggcatggacggccttcattgaccgtatcctatggaagacgtccagcccagtcctgcgcacaaaaagcaagacctcttgtggagaaacattctcctgcaatggctttggcaataccttgtattcatcatcttcagcggcagcgggtggcgatggctttggcgaatcagacgccttctggacaagggcaatcccgcccaagttggtgtagggcggcgacagatatttgctcttcttgcgctcgcgcttgttggacttggagatggtggtagcgctgtcctggtggtgtggcgtagccttgtcatcgtcattgtccatgagctcggcgacgctgcgct

SEQ ID NO: 4733 - DNA, 13871 bp, Oryza sativa
  unsure (1)..(13871): unsure at all n locations
ggggcggaggcgcaggggcaggtgaggtgggcgtggaggagagcggcggcctgagcctgggcgtgttggacggcggcgacgaaggcgcgggtggtggtggcgcgggccatgaggtcggcgtcggggtgggcgaagggcctgaggtcggaggcgcggcgaggggcgtggtcggggtcggggtcggcgaggtaggagacgaggccgtcggggaggaggtgggcgggccaccagggtcggcgcttggacttggcccagacgaggtccccggcggctagggtttggggggttagggtttccgccatggcgcggaggagcggagaggagatcagggatcgcgggtgggaaggaatgggagtagactccgtttgtttgtcgtggaatggaaatggaacggaaggcggcggggcggcgagcggcgcggcgggcggcgggcggcggcgggatcacctaccgctcggagcggtgcggcggtggcaactgacactgactcacactcacactcgtctctctctcagctcaatcaaccgccgcttactaggctttgtggttgggccaaattctaatcacggcccaaaagttcctgtacactcactcgacttgactggatttccttactaggcttttcttttctttttcttgacaggcctctgttccagtagagcttgggcttctcctacgattgtcatatgggccgttggagtttgggcttctccaatgcaatccaacggcctcttctccctcttatctctgcaactttaaaacacagagtcatctttctttcatatgttttattctcaatcatcatttcagtacatttctatttatatagccctgcctcgttacgaacattacaaattacattatagtatgttcttatttgtatgcaaattagggccatattaccggtactataataatataagaaagcaaagagaaagaaagagagacaagtgttgtttggttcacttgagttgggttgcacaccatgccatatatacgtggattagtagcactcaccaaattcaatcatttgcagcatccatacatgtaagcttacaatacaatatttatttgaccgagcacgtacgcaaatgcactctttgacaaattaagcaagatccgagtgatcgaccatgttttccggaggacttaactgaagtagatagatattcagatactccatctaactactactagatgatactatatgcgtacgtcactcagtcaatgggacgatcgactagattaaattattactttcaccatcctaattaatcctatcttagtataaaattatcccccactaactccttaagcttaacatgcaaagatgtcacatcatcatccactaacaatcatcacatttaaatatcatgcaaacatgctatatctttatagtttttataatttaagagatttcaaatacaaacatgttaaattatcatccaacataatttacataatgtttcaatgtatatctttattatgttttatgatatcctatatagttttatagttcatccttatttagttagtgcttaaatgattaatctatggtccaaattatctttctcattttttcatctaattaagtcatatcacatcaattatttttaacctttagatgattaatctactttccaaaccatctccttatttttcttcttccaaaaagtcataccaccttactttttacatttgaatcaccattgtacatactatttaaatttaaattatcataaaccacattaacttacttcttaaactgatgttatctagctatcttacaggttatttttattgtttccatactaaattttccacagcaatacgcgggatttcacctagttaatgagatatgcataccacaatcgttcaattcagtcatatttttactatcaatcacttattaatccattcattttaaattactaatcgttacgttatatattagtttaaatcaaacattttaatctttaacgttaatttctataaactcatacagtttaacatcataaaatttatatttttatataccatagaaataatttcataatatatgaatcacatgctaaacaacacatatttttaaaattggcatatatgtagtgctacataatatttatagttttcatagaaatattacttgtcgcatgtacttctagcaggttttcgggaggaatctagaaattaatggtaccactgtacgacaataaataaataaataatgctattgataggccactcggccagatgtcaaaaacctaacgctactcttgatacatgtgggaatatgtgtacatgcataaaatatttcacgcgagcttcaaataatattttatcctaaacaacttatctagcgcccgtttcgtcatggcgcctagtgggaaaactatctcttaaaaatcctaaatgcaaaaattgtttccttgattattgtccagtgtccgtgccattccagatctcaaatctccaatccatcgtcgaatccaaaccctaatctcaaatatgtcctaaatcaaatcctctcgaaaagtctactttgcctcccttgagtctgtgggccgatctcttctccccggcccatttcctctcagcccatctctccctcctcctccatccttgcccgcacgtgcgaggcacgtgcgacgctcgggcgctgagcacgagagagagctcgctctctctttctcttctccttccctctctgctcccgctaccgcttcctgccgacgccgcccaaatcgccgcgccgttgcttcccgcgcgcgtgcgcgcgccatggtggccgacaggccagtcgccgccgccgtcagcgcctgccgcgcctgagcccgcgcctgccgccctgtagccgcgccctttcaaaccggccccgccgtcatcgccgtcgtcacgacccgggcccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaagnacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgagggaagtctgtttcccctccctctttcgttgctaattcaaaaagggtttaaataaatccttttcttttagtccaaaaatccgatgatcttagaaattcaatatcttttcaaccatacatccgtttgactccgttcaacttccaaaattcctcaaatctcgagatctatctaatggcacgcttagaggtcaataatagggctttaatttcgccgtttgttgagtcatctcgttcgcgtgtagcttcagagcccgaagacccggagtgcgcggatttcgaggatcaagctcaagatctcgagcaaggcaagtcaactttgatcatcttgcacctataatttaaagggacaattcgaaccatgccacacaaattttgcaaaatttgtgatatgccaccctgacccacatgtcattgactcatgtgtgtcctacatgtcattgagatacgggtggcatatctcaaattttgcaaatatagggtggcatggttccaacaaaccctaatttaaatctaagtatttcttttccacaaatattgcatgaataggattaacacaagtaaatcggccgcggcttgcgagatagcctgccggcccaaccctaattgttgcaattaccctccttgaattattgaacacttaaacctcctttgtcgactgttgtgcttcgatgcacgggacttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcgaggaacgtaccgggagtacggtttcccgctcttgcacttaaggaccgttttccttggaatttcatccgaacataaggcaagtgcgaccacatgggtggaatgggatgcccctggctgagtaattagctaatcgaggcagccattatgccaagagacatgtggattcaacggggtggtgccagggagaacccccgggcttcctggcacagtatggtctgggacctaacctaatgtcggtttgggacccctctcgttggcatatggtgaacctgtgtcagctttcgaaatgccttgtcatgaaagcctcaaggtctctagacgtggccgttctgcacgggctgggtgatccgggttagtaatgtcgtgtgggtaaagtgtaccccctctgcagaggttattaaactattcgaacagtcatgcccacggtcatgggcggatgtgaggtgattcctagcgtagttttgtttgactactgcttgtgaaattactgttgtggaatgggttcgatgtttggaaaatctgcggctgatgggatcagccaggcccgggtgcccgtttgaaagccgttggccgggtgccaaccttgaatcaattcaaagactgatacattgcacatactccgaccggacgagacgcactacctcatccgtgtcgtttgagaagcactcacttagttgtttcaaaaaggagtttaaataaaatcaattgcaaaaacaacagtctttccttgaagcctgcattaaacacttaattcccatggcttgctgagtactcctgtactcacccttgctctatataaataattcccccccagttgctgaagaagatgaagtggatcccgctgatgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactttactcctactctgtaataaagagacctctgttgctgtgatattctatcttcctgtgataccagcagtgtttcctgggactggtattgattaacaggttaatttggagtgtcacgggctagttccgttcggggcccttgctctatataaataattctcccccagttgctgaagaagatgaagtggatcccgctgacgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtacttctactctgtaataaagagacctctgttgctgtgatattctgtcttcctgtgataccagcactgtttcctgagactggtatcgattaacaggttaatttggagcgtcacgggctagttccgttcggggcgtgacaacttatccaatctatgatccaataacactgttatactcattgcaattaaatgtttgcaacaaggtactatagttaattctttacatatatattctaattaaaaaaatacatgtttttatcatttaggtcggatgtttcacacttcaaactgaaatctttcaactggtctgttactatgttgcacattttaattttgttttataatatgtctttcttaatgttgcatatgaaattatttggatgttttaataagtgcttttcccatgtgttactagttcatttgaaaacattacatggtaattatattttagttaaaatatacatgtttcaattatttgaggtcggatgtttcacacttcaaactgaaatgtttcaactggtccactactgtgttgcacattttaattttgttttcataatataaattttctaatgttgcaaatgattttcttggatgttttaataagagttttctcatgttttaccagttcatttgcaaatattacatagtgttgtttgaatgtttcagcagatattttgtgatgttcttgatctttcacgctttatataaaaatattttaactacaattataatgatatactatttttctccagaacataatcatatgaggtcttactgtaatcatttaattgcaacaaacaaacgatggaatcgatcacataacaaataagtagtttacaagaaaatatattgatacaaataaccgtaataatcaagaggtccatatatgatatatggtccataccaagtaaatatatcacacgactatatatatccctagcagccacgaacacacttcaactaggttattgggatcaagatacttaatgtgttgggcttttttttttccaaacaattatagaatcagttcgtaggatcaaagatactaattttatcaagtatatgatttatgtaaaatttgcaatattgtaaagtttgaagatgataatattagtttggtagggatcgagctaataaccttgagtccaactgcgagctactaaggagtactccctccggttctataataattgacgttttggacaaggttgagatcaaactttaataactttgaccatcaataacttcaaaaatatttagtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcgatagagatatatatatcgcaaaagtacatgcaatttgtcagtcttgagtttacacttgactacacacgtatacgtgcaagcggtaaatggacgttgctctcagttagtgtatgtggcaacgtgacggccggtaatctagctagctgctttcttactagtactagtactactactttagctacaactttcacaagatagctaataagatagatagattcttctcacttgctcttgtgaaagggagaaactgaaggcatcgagcatgtacatacgttcagattgatccatacaaatacaagtacagctagcatgcatgtatacatatgtacagatcgatcaatataatgtaattaatgcgtatatatatgcatggcgatcgatcgagactgcagacaggccggcatgcctgccgatatccagcttacgactcaatggccagcagtgacaggttttgactatagagacgatggtcaggagagagtgactgtggcagtggtgcacgtaagcatgcggacaagtcatgtcgatcgagtcaaagctagatctatctcatgaaaatgccaacatgcatgcatgttcaaccgccgtatcaacacatagggaaaaatgtttctatctcccgcgacgtcgtatcatgcatgcatcttaataatattcgttaaaatatttaagaaatatcaagattaatatgtgatatatttttttctcaacaaacatatgcaataactataacttacacaaattgaatttaagcttcgtacgtttatagaataatatatctcatattaatttatatatattttatataaagatatgatacgtaaaataccaagagatgtgtctggagacatgcaaatctatctctgtatcgatcgtgcatattgatcgacgacgacgacggtgatgtgcactagctctagtgtactgtacatcatgtcgatcgatcgatcaatcggtagtctatatatatcgatccggaccatcatcctcctgtccactgccacgcgcgctagctacttgttgagtatatatccatcgatgatgcatgtatgataggagaaaattaaaagctactctaggtttgttgttatcctgcagtacgtttattggggatcgatcgatcgacaggccgccgcgcgtacacacatatactaactccttccttaaatgtttgacgccgttgacttttttaaacatgtttaactgttcgtcttattcaaaaaacttttgtgaaatatgtaaaactatatgtatatataaaagtatatttaacaatgaatcaaatggtaggaaaagaattaataattgcttaaattttttgaataagacgaacggtcaaacatattttaaaaagtcaacggtgtcaaacatttaggatggagggagtatatactccatcgatcgatcggtggcttggatatataggatggatgcatcatccatcgatcatgcatgcgcacctgggctagctgcatccagaagctactcatcgctttcatcctgcgggattcctgcccaagagtagctaggactcaactcatatataatttgttcaatttttaaattacataatatgatgctagtagtgatgtttgagtccgttccaacgccataattaaactcacatgtaggatcataagttccccacacgtgtatacttttgctttggatatgacatcatatacctaatcaactaactatactataaacttataacgtttgcttttgctttatcacttataatatttatttctctcaaaaaaaatataatatttgttttgcaacatacatggcctttagctagtataggatgaaggagacaagccaaggacgccccatatcgatctctctaactcggtggtacgtgtcacactacacaaaccatttttctacacacacccatttatatttacaaacaaaacgtataatgacatgacaattataataaactttacaggcaagactcttaatatatctgcataaaaaataacttattttcctaggtgggcttcattcttctttattcaagatagtccatgtatcacaaacccacacaaacctcgaaaaaatgttaagtcatattggaggacatgtggcttcttcatgggcaatggggaatggggaccttggttcccaggtcatcaactttaaattttctgaaaatatcaagtgttcttctgttgtaatcaaataagtatatatcttctgttcttttaagtatatatatattaagttgataaatggctatagcgattgagatgtatctttccattttatcgactaacttttatagcacgcatgatataaattactactcaatcaagagttccgtagaattcttcacctcaaattttgtttgtaattggcaaatataaagaggaagaagtactgtagcagtatataattaagttaggaaggagaggactcatcggatcgatcgatgaccatcgagtcgcgtcgatggatggatcagctagcgtcagacttaattcggccgccgcatatatatgcatgcgacaaacttaatagctactccatccgtttcaaaatatttaacaccgttgactttttagtacgggtttgactattcatcttattcaaaaaatttaagtaattatttattcttttcatatcatttgatttattgttaaatatactttcgtgtacacatatagttttacatatttcacaatatttttttgaaaaagatgaacgatcaaacatatatcaaaaagttaatggtgttaaacattttgaaacggaggagagtactatccagttgcactgtatactccatatatagtggcagtgctagcaaagtcaaactaatttaattaattattaagaagcactcgtatgtatatatacgtacagttgccgcgctcgctgcagcaagttgatgatatcgactagctaagctacccagttagcagccggcaggaccgatatatccgcaggcggctaaagactggagtaattagcaagccagtttgagtagtaactagagtaactaataaacacatgtgcagaaactgagattttgtaatgagtagaagtatgtatctagcttcacgagcaagctaatttaattaaggtagcgtccatttttttttaaaaaaaaagaaatcgtagctagagaaggaccggccgggaaaacaaaatcagctgattaattgacagtatatacagtatagctactgtagtaaattgctttgcattgacgttgaaatctgaaagcagaataatctgcagtccatcggtactctctagctagtctgtacgtagtaatatctctctctgtctactactagtactgcaacttgttttgactgtcattgctggagtatactatatatgattgataataggagtagtaattaataaataatgtacacttgccgccggaatacatccatccctacgtactattcaccagctgcggtcatcttgactccacacttgatcagtagcactcatactcaaactaaccaccatttgctagtacttcctctgtttcacaatgtaaattattttagcatttttcacattcatattgatgttaacgaatctagacatatacatctatctagatttattaacatcaatatgaatataagaaatgttagaatgacttacattgtgaaacggaggaagtaccaattaagccttcttttcctttggtcaaataaagttaactgaaaatgacgttgtacacatacacatccatatacagtttccggccaaaaaattactaacaccgttttgactaatctatgtgtatatcctgatactggccgacatcaacttaattacatcatatcgacccccctgcccaaactatcggacgaactaagctagagtgtagcaaaatcacacggtacagctaccatatattagcttgatccacaagctccccaaattcccattaattaattaacctgcagcctcaattatttggtctctgactcgtgcttaagtatacactatcatgcgcaggaagacagatttacaggtggatggatgatttgtgatgattattcgtgatttgcgataaatggtccctggtaattaattatttgagagtacagacgaaggaatgaattaaaattattaattatccaaaaaaagtagtatttgtaagaaactcatgcatgaaaagtctttttaaaagaaaaatggcaccattatttaagtacttttgcagtgagcatatggtacttaattgagcactgtgcatgtggaaggaaggcaatctcacaacaattaaattacactctgttcatgcagttcagtcgacgttatacatgcccttgaatcgaatcaatatctttgtgtctgtctgtctcttgctggactctgcttctgctaagcttatttataggcctccactcactcatctctccttgcactcctccctgcatgcaagctcctctatctagctagctactctactctactcgatcaagatcaagatctatcatggacgcagcagcagccatggagaagcagcagcagccgggcgagaagaagatcaccggcggcgaggaggaggaggaggaggaagtgatcagcagcgtccggtaccgaggatggaagtcgatgccatacgtgatagggaacgagacgttcgagaagctgggcacca

SEQ ID NO: 4734 - DNA, 12283 bp, Oryza sativa
  unsure (1)..(12283): unsure at all n locations
atcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaattaattttattatcacaatcgatcactctactgtagatggtagatagatttagaggtacgtcatcgatcgatgcatcaccatacacagtaggagtataatatctgtatgtatcagacgcaaaaacactataatctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttaataaggcgaaaaaatcgatttttttcaagcatgtacttaaagacttaaaacaattgactacacaagatatttgagagtcccattggtcggtctaataagctaaagaaaaactaaaatttaaattttttaacttgattttaagatatttttaacgtaattttttttagcactgactcttaagtcgctaccaataaatatacaaaagttttacctacaaattaaattttattccctattaaatgttttggcttattagagaatatgggcaaccgatgagacactgaaagaaatggtaaaagaaaaaagtgttttggcctcgatcctcatttgcaaaatacaatgataaagtcatcgtcgttgccacgacaatctagtgtcgtggttggatcccccaagccctgtcgggactggcggaactgccaggtcatcatcgtttcgccggtcccaacgaccgtggtagattgaactgcttcctaggcccacgaccattaattcgccgcctcccaagcatgtcgccaccatcgattcgcggcacttggcgaccgccgacgtagtatccatcaggctctgctgcgcctgtcatcgatccaccacttcccaagccggcctccatcgatctatcgcacctggcctccgaggacgttggatgcgccactcccaggtcccatggatgcctcctcttcatatcaccaaccgatccgtaggttagagagaggagaggggagaggtggttgctcctattgttgagattgacatttgagacggatgggggggagctagtgaggagaggagagggagagaggaccggtggattcgatgtgtgggagagggctggggatttggtgcgtgtcactacccttgcgtgcacctagcccgattttatatcaatagttgtttatttctagcaggcagacgtgtattttcacgtgttgttgtctaagagacccgcatgtaaaaatggatctatttttacaggtggtcctcgtaagacgaacacctacaagaaattattttcactagcgggtcttgacagggatcccctatgtatttttgcaggtggatttgctttttttaaaaaaaaacacatcaactttattaagcaagaatagaattaggggataaaccctgttacataaccaaggataaaaattgaaagcaaaagagccacccctgagaagggagggttaactgaactacagaagccatcttcctgaaataacctaacagcagaaaaaggagcaagtcaacagggatctgtggcgaagccgcgacgactgctatcctgggcctcaaaagatgtgcactccgcttggcaaaccgttaatccccatcggctgcatctacggaaacggcacaagactgaggtttgttgctgagccgtagattttggtgtgtgcgtcaccggactcagcgaaggatccccatgaggctcatcattgaatctaaagagctctaacatcgaccctgtcaaccgaaattgcgcaggtggtccgagctcaacccgaatgacaaacccggtatggtttcttctgttagggaacaacaggaagggtgaatccgaagagcaaccaaccttcaacgatggagcacttgaatggctgcaaatcaacttctgtcttgctgagatgatggagatggttgaggaagaggtggatttgctttcagcccgcgtgcaaaagtcaagagatcatcgggtgtccgcgaaaaccatttgttatagtgtattaagacccgacatagatcatcactgcaccaagctcatcacaatagacaagcaactctaacttattatgacggacaactgtctcaaaccacccaaatatcccaaccgtggagtagaaacttcaaagtgaagtccaccttccatagagaatacaaaaaaaaaaagagaatacaacatcgatctaggatgctggcaacacccgaacactgaacctgttatttacccgaagagagaaccaggccacttaaaactcctccatcatcgctaacaccagtcagagactgggaaaagctagctttcacccgcctaccacaattgcttcgtctgaagtgtagcaataatatgtccctgtttggttaactgatcagtgccaaactttgtctcgatcacgtgtgactagctagcaagtttgatcaatcgaattgaagttaattagcgtttcatgtaacagatacgatgtgccacacggtcttaggctgcgtttgacgtaacgatttggtagagtaacttggtggcacgtgaaataagataaattgttagtatataattaattgagcattaattattattaacttaacaataaactattttttttaaaaaaaatgcatcatgtcgtttagcggtttggaaaacatactatcagaaaggaagtaagttgtcgttttgtgtagctggaaagaactcggtcttatccaataggctcatacgtcgtagacacgttgctttgacgcaacttaacacgagtgtcttggcacattatacagaagtttgtgtggcaaagtgtggagatgtcattaaagcagagtcctaatcttgggatcgatggaatatatatggcgatgagatcgactagctagtgacaccatcttgcagtgaatgaccgatggtgatcttcatcaaagatcacaattgggaccaagatactgtggtccgaaattaagcaggaaaatcacttgccaacggacaaattattttatttaagcaagaaatttcaatccattcctgcctaacaactccacccaacactgcaatctgcacttatgcagtggagatgcgacgtggctgcaatcataaagctttattgtagctaggggtcagctttgtgattaagcccatggttgtctgtagcatgggcacaccatggttgctaggatgggactcaactattcattccccttttgcgtcaaaaagaaaaaaaaatccagtcaaatacttggaccacaataaagtgtacatgaatataaaaaatggatttttcttttacactttaaagtgtaaaaactccaagtatttgaaatactaactactactagtaaagtgtaaacactttatataattaaaaaagagaaaaagaaaaagaataatgggcagtagacgggcccctttggttggcccagtccagtagtacaggtagaaactaaagcccattccattgaacaagaaggagtagaaaagcaaaattgaaggagaaacgtacgagcgtgcgaattggatgcagctgagaaggtgttcgtccgctgcatccgcatccaatccttcccggcgaccgaataccggccgggaaacctccaaaatcgagctggccggcaaggccgaatttcgctacatcggtttcatctatttaagttgagtaagagggaatcatgcgctggactttgaactatgtaatgaacttcattatcattattatgacgatgaactttaaggttgtggagtatgtaggactttagatctgatcgttgttgatggctaaacatatagtttctcaatatttattcatcaggacaatatttcgttagaatattctactagtgaaaaattttagtcttctcaactgttcattagtaccaactaggaaggtggcccgcgcgtatgcgcgggcacttatattattgaaaggtaagatttttattgtttgttcaaagattttgtctcatagattaagggaaaactaaagttcggataatgtaattttataataatttaaggtttctatttttcttaaagtatcttaaaaatccattcacaaatttttaagtaggagatggattaagtacttacgacttttgaatcatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatacatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggacaacagaaattgatgaattatctgatttatgtgatagctatttgagattataaacaaatgaattaacttctaaatagttaaaaagtcgtttaagaaaagcaccatttataaacttggaaaagcgtggagcgtgcaaatgaaaatgcaaaagatggaatcaataaaaaaaatagggccttaaaactcccttattactcttatcctagtacgaattctattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgacatatatgtggtggcttaagattttttattaacaaaagcggtagcgttgcagcgatcgtgatcacctaagatgcctcagacacgatgctttgtcacacgtgcgaaaggcaaaggtgtagacgtgcattgtgcagcggaccaaaaagagaactttggacactttagttattaacaatagatatgttgatttaaataatgggtccaccggttctagtgtaaatgtaaattagttaatatatattttaaattgttaatttaatgggtacacaatatgatggtgtagaatttattttaaaatagtacattatttgagaataatagtccaaattaataaaaaaaaagatcccatgatttaaataatgggtccatctgtttaagtgcacgtataattagttaatatagatcttaaattatttatttgataagtacacattataattgtgtaaactttattttaaaatagtgtattatttgaaaataatagtacaaattaatgagtacaccggtttaattggaaattatattgatttaatgggtaaacatataatggtgtaaattttattttcaaagattgtagagctaatttagttaactgtgtttataaagaattatatgatggtatattctttgtttgtaaattatgtttatttagaatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttaggatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataataatagaagatagataatagatagatagattctacctccgtcctaaaataatttaaaataagtacagtgggtatccgtatctaacgtttgaccgttcgttttatttaaataatttgtagaaaaactaaaaaaattagtcacacataaaataatattcatattttatcatctaataacaataaaaatactaattataaaaaaattttaaataagacgaacggttaaacgttgcacattaaccgtgtaaaattacacttattttaaaacggnaggagtacttgtcctaatgaacagttgagaagactaaaaacaatctgctacattctctcattcaaagctagcagtgtattcatttatgattatgaggtggagtagctacctacagtttatagaatattgtccatatatatngaaattttcttaactaagggtgcatttgggaggaaaagctcataactcttattttctcattttcatgtgcacatttttaaactattaaacattacttttttaaaaaaaatatagtaaagttgctttaaaaataattttaatttttttttattttttagctaatacttaattaattgtgtgttaatgtgtcgctttgttttatatggggaagaagttttcaaactttacatttgaacacagcctaaggcggctgtgatctaaagagaagctggggtgagatactctatcattttttgtgagcatactttttaaactgctaaacagtatatttttaataaaaaatatacaaaagttttgacaaatcaaatttccaagtttacaatagctaatactccatttaattaattatgcttgttttcgacgttaacaaaagcgcagccccaacctccattttaaacgtattgtatactaatttagtataggttgaccggcggttggtgtactaatattgcttgtttcaccggtgaaaaataacaggcaaaggtcgcaaccgtcacagcaacctatatatgaaatgaatgcatatatatatatatcgtggaaaatgttaagaaatgcactctataaactaaagtgagtggagtgaagtgacaagcagctagcccatgcgttggttcataaattaatattgcggccccgagggccacgagctgcggactccacacgaaaatgaaagtgatgcatgcatgatatctcactcagattcagaatgcatgcatggcagctaacctagctaagaaattaatctttctttaatttagacaacaaaagaaagagtgaaggagctgaacaaaacaaagaaaacgatcgaggagcaatatttgcagtgacaaagaaaatccaaggtggttgttaattaagaaagtggaaactacatataattgaagagagatcatatctagtggtaggaaggaattgaaggtcgccataagcaggcagttggttagttggggatacgtacaggtacacacacttccttccttgaatcatgcaagtatggcaactacagatgtacctctgcttccgggaaaaaacgagcaattgccaggtcaatcagcaattacaatcgcaaatatatgaaagcattgaattgatgtcaaatggattagcaagtcatcaggatcggagtacagtagcagtatgtaatgggtagttaatcatcatacatatgtgtcaacgttgtcatctcacattaacatcctgcaaatatggagggtttgcctctgtcctattttaagtgcagttgatcttatttaaatttttttattaatatttttattattattggatgataaaatatgactagtattctatgtgtggcttattttttaaaatttgtttataaattttttaaataagacgaacggtcaaatattaaaaaaaaacccacaatcatacttaaaattagactgatggaacagcatcttgttggctacgccctcctactcctgccggccttcaattatttgtccatgagttcctgagtagcattgctaaattactgttactcctctactgtaggtagatcctctgctcgtctattcattcccattcatgtcatgcccccataaatacttgtatacgtacgtacgtacgtggcacactcgtatacatacatatacgtacgcacgcatatatcatacgtgaaattatttggatttggaggtgagatatactagtccagtaggtttgtaagtttgtagttgtagtatataaatggcaggtggaggcagggatgagccggcgcccggccggccggagacctcttcttcttcatccatcctttctttctttctttctttcctaggcctaatcttacataaattattcacacggacaaatctagctaagcacaaggtatgccgccggcgccgtcgcaggagcaaactaagctggcgccggagaagcagcagcacatctccggccatggcgagcaagccgtccggtaccatggatggaaggtcatgccgtacgtcataggtatgtactactgtatcttctagctcctccatggttatatatatatatatatatatcctcccggcctccctagctcttaattagctcctcaccctcagctctgttcttctcctttaactctctccggtttggatcctactcttctcttctttgagcatgcatgtactgtatgtttttattttgaacacaaaaaaaagtaagatggaaatggacatccaacatggctgcagctagctatagcagatgatgacctcctgtagtttagtgaagtgcatagtctcctacatcactagctagatctcttccttttagttagttgctggctccaaatctcagctatcaattcatacgcaatttgtgcgcatatatgcttcagctcgctggatttgcattattgcttcatccatacaccaaagtacacacttcctcttttttttccatctcttttttcccaattaaacgtcaatgaaaaaataaaagcttagtagagaagttagatggtaaatgtggtgaagttatacaatcaaggaagcaagttagtccaaaggcaaccgatgaagcagccagatgagaggagccatggaggtagaaagaagaagaaaagaagaagaagaaagcaagaaagaagatagccaagatagaagcnctgtgcactgcagctgcacatgcctgatggcaccaccaacaatcaattgcattaaagttacccaactgcactacgctagggaagtgtcctcttctcagcccagcccagcgtggtagtaccaatctcagcacctctctctttttcgttttgctttttcaaccacctactggtttcaaactgatttttcttttctttccccccattgaaaccgtttcaattccagtagaagtagggaaagggttcatatgcgttccaaagcacccccaaaaaattatcatctgcacggtgcagtttttaagaccttggaaaacaattatcatttgcatagaggagtatttctctactattatgtcatccatatttaagttggtttttaagttttttcgtttttggaaatacatatccgtgtttgagttgtattttaagtttgttttctttaattgaagatgttttttgtggtattttggtatgccatctgtatttgagccggtttttaagcttgtttccttttggaagcataaaaggtgtcgtataacaaatcttttaaaaaaacttgcatgctaacttgagatgaaatatggactaataattgcaactcatgattttctgaaaaaatatcaagagaattcctaaagtaaattttatcctaactaaaacgtatagcaataataaaattttaaaaaaatatttacatgttgtaatgcacggacattttttctagtcaaacatatataaaagaattactgacaactccctattcttttaaaattatttaccggattatgaaataaattattcgctgcacacttcaatttttctataaacttttttctactgcattatttagaccacttattactaaacggaggagtattttgttaagtttatttattacaatatttcatccatccaaataataagtaaataatgtgcgataattaattaatccactcactaatctatatcaaatggggcctttaagatgatgccatgtctagtagatcttataataccattttgcaaataataatttgtaaataaaaaaagagaaaagtacgaattacccctgaactattggatgagtatgaataacaccactaaactcgaaaatcaaacatcgctcaccccgaactttcaataccggacaagaaaccccctagcactattgcgagcagtttagagttcgtatagcacacgtggcagtccagttagtaatttttttctaaaaaaaatagcgggcccacttgtcagaatccccacatctatttctctctcttctccctctcgttctaaagagcgcggcggcggtgggccggccacgcgtttctgaaggagagggggaagagaaagagggtgtggattctgtcaagttggcatgctattttttagaaaaatattgctgagtggactgtgccacgtgtaatattcgaactccaaaccgctcgcaacattgttcccggggagggtgggggaggggggtttcttgttcggttttgaaagtttgaggtgagcgatgtgtggttttcaactttagaggtgttattcgtactcacccaatagttagggggtaattcttacttttctcttaaaaaaaagggatggagtttgacacgagacgatggatcagggaacgagacatgcgaaaggctggggacgatcggcacgaccgcgaacctgctggtgtacctcaccaccg

SEQ ID NO: 4735 - DNA, 6603 bp, Oryza sativa
cagcttcttcaactggtactacttcaccttcaccatcgccatgatggtgtccgccacgctcatcatctacctccagagcaacatcaactgggccatcggcctcgccgtgcccaccgcgctcatggccctctcctgcgcgctcttcttcatgggcacccgcctctacgtccgcgtccgccccgagggcagccccttcaccagcttcgcccaggtgctcgtcgccgccgcccgcaagaggcgcctccctgccccggcgtctcctgccgacgacctgttcgatccgccgcaccggagcaagctggtggccaagatcaagcacacggaccagttccggtggctggacaaggccgcggtggtgacggcggaggacgcggtggtggacggcatgagcgcggcggcggcgaacccgtggcggctgtgcacggtgcagcaggtggaggaggtgaaggtgcttgcgcggatgatcccggtgtggtcgtcgtcgatcgtgtactacgtgatgctgacgcagctgggcacgtacacggtgttccaggtgatgcagtcggaccggcgggtggggaggtcggggttcgaggtgccggcggggtcgatggtggtgttcaacatggtggcgctcacggcgtggctgccggtgtacgaccgcgcggtggtgccggcgctgcggcgggtgacggggcgtgaggaggggatcagccagctgcagcgcatcgggatcgggctggcgctgtcggtggcgacgatggcggtggcggtggcggtggagcaaaagcggcgcggggcgggaggagggtcgtcgtcgtcgtgggcgtggatggtgccgcagcaggcgatggcggggctgtcggaggcgttcgcggcgatcgggctgaacgagctgtgctacaaggagtcgccggagagcatgaggagcgtggcgggggcgctgtcgccgctggcgctggcggtggcgagctacgcgagcggggcgatggtgacggcggtggagcgggcgacggggtggctggcgcaggacatcgataagggccgcgtcgacctcttctaccttgtggtgggcgccatgtcggccgccaacctggcttacttcgtggtctgcgcgctctggtacaggtccaagaacatcgccgaccacggcggcgttgagcttcttcagaccagctccaagcacaacgccgacgcgccgccggccatggcggtctgacgacactgacagctactacacacgtacgctgacttttcatacttactatatactacttgatgcatatgcatgtgtccactccatgatgaacacaacagagacagaaagaagagagatgatacttgtacgatccagtttggaattggactacattaattacattagggatgaatgaatgtaattgtaaatctgtattatgaatgtatgggccggcccatatcatttcttcttagggctgaaacgagcccaccgaaagcccaaaatcgccccgtaacgaagggactcatgtcggcaacactgacaggagcaaaacaacacgtttgggagagctgtaactctaagataatgagaatttccgttccaatctttgcttcaaataagctacaacctttgcagtcaacataacttttaattgcaaagcacaatttaatgaaaaacgagagaactaactgaaacactagcctaaagacagataattgctaaaccttcaccctgattgacaaaatgctacttacataaacaacatttagtttttgtcatccacaaacctttatagcaaggtctcaaagttaaagcccaagttctgaaaattgaattcaaaggtgcaagtagactcaccgaaatttaagcctaaccgttcagtcgaccagatctcgcgcgcaccaaccctcgataaaattgtcttcgagccgtgtgaaacatattactctctctatttctaaatatccgacactgttgattttttatacatgtttgatcattcgtcttattcaaaaacttatgtgaaatatgtaaaactatacgtatacataaaatgtatatttaacaatgaatcaaatgataggaaaaaaataattacttaaattttttgaataagacaaacggtaaaacatgtttaaaaaaaattaacgaagtcaaatatttagaaacggagggagtatcaaaaagtaactactaactgcaaggcaatgtctctcttcaccggggagagggagaattggatggtgtcgatcgccggcacgacctaacgagtacacgacacactaaggtgtttgaaactaatgaagataaataaatttatttgatattttaaagcaacttttatataaaaagttttcacattagcagttagaaaaatgcgctaacataaactgaaagaaaatcttatttgatagtgtagatgagtaagatgaccgcaggaggtcaccactgctgcactgcatgcaacggcccaagctaggacggtaacgaggagtagtagctaatggtaatacgtactgtataccccttgtgatgattaatccaacaaaacattggattctactagcagtaacgaagaatttaatactcctgacgatgcgtggtgcatctagtacggctctcactgcacctgcgtttgtcttgttgttgcaaaatttaacgttgggctcagatgagtttcaggacagatcgatcttgtttgaacttattttattttaaaaagggtgtatgtggatcgaatcgaattggagttggtatgggcgtgtctgtggttttgaaacattcatcaaatgatcaacaagttattgtttgttcttcagctactgtttcaagtttacacgtactagtagtattgaagtagcaactcaacgggattgtgttggtggtggtgggccatcgtcattccattatcaacggctactccagttgctaacattatttttgtcattttgtattttgttgtctctgtcttgctgttccctcgatcttgcacacaccaaagttaagttaatgcatgcaaggagtactatacttacatggtgctcatcttgttagtacaggcaggttactatgctagtgatgctcatgtagtaattatcttcaatggcaatgcagcagtatttgcagtcagctagctgtctgtattttttgacaatccggcctttcctcctgatcctcatcgtataccatcgcacaaccaacaagcttacgtaccgtagctcacatatttacatctccaacgttacgtacctacctggcttgtagtatctgtatctacgtatttaagtctgtctttacatacctacatacgtgtatttgtatgtatatacaggcggtacaatttgtctgtactgtacatacaggaggagtgctgaagaaagaaaaagaaaggaaagcaaaattcagtgtagcttgcgcgtgcgaccagtgtcgtgtttggcggcttttggagtagaaaattgctacggctaccaccacacatccttactcgccgacatgtgggcccgggagtcaggctggagtcccacatgtcagatgacagcagctcagactagtcctcggctcgctcgctacctttcaaaatccaaccagcaaaagcctccctcaccctcactctcactcccactacactctagagagagagagagagagagagagagagagaccaagccaaggccaccatggacagcacaagcaacaagatgaagaagatggagccgacgagcggcggccgccacgggactccggggcaggtggtgggcctgtgcgctgccctcgtcaccgccatggctgcctcactgctctgctccacctccatggccctcaccccggacggtaccctctctctctctgcgctgcactacgcatccatggatggatggatggatggatgagagaacgcttcctccaatctggctgtctcaccggggtagttgtgttttttctgctccttgcagggcaggcattgctggagctcaagctctccttcaatggcagcagccagcggctgacgacctggaagcccaccgaccctaacccctgcggctgggagggcatctcctgctccttccccgacctcagggtccaatccatgtccgtctccaatttatctctatctttccttccttgcatttctccattttgcacccagattaattagccttatctttcatttttcttttcccttttgcatctctctctcaagtctcaagcaaaatgtttcatggctcggctacccatgtgctcattggattcctcgccccctgaataatctcttctttcatgttttccttttctaccagaaatctcccttacatgcagcttgggggcatcatttcacctaacattgggaagctcgacaagctgcagagaatgtaacattttttcttcttcaccacttttgtgcaacacttcccatttcaacaccatcttcatttacactatccgcattggtctttctttaatttctaaccccttttgttcagagcattgcaccaaaacagcttgcatggcccaatcccttctgagatcaagaactgcaccgagctcagagcgatgtatgtatgctgctacgatctagtacttgtttggttccatctccatctgtctgctaatgactttgtagagctgaaatgcggaggtttaatttactctgtgtgtgtgcagttacttgagagccaactacctacaaggaggcatcccttcagagattggcgagctcattcacctcacaatcttgtaggttcttagcaaaataccctgatctgattcactgcttattcttggtctaatgcgtgccatctgcagggacttgtccagcaacctgttgaggggcacaataccggcgtccattggaagccttactcaccttcgtttcctgtaagtttcttgctgtataaatttccttatgccatcttgtcggcattgctaaaaccagacgagtaaatgctgttgcaaatctctgaaagaacatatgcttatttgcattgcaggaatctgtccaccaatttcttttctggagaaatcccaaatgttggtgtccttggaaccttcaaaagcagctcgtaagcttttagatttgggcccatcttcctttctactttctttgatgtgtcattgctctttatgatgtgggagcataactgtagcaaacatgaacaaatttgtgcatttctgctacttcttgagcacaacctgtattcaatgccatggtgcatttcttcacatgacaattcaatggcatttgcaggttcgttgggaatttggagctttgtggactgcccatccagaaggcttgccgtggaaccctcgggtttcctgccgtgttgccgcattctgatcccctcttctcagctggcaagtcttccatttctaagccatcttctcagtgttgaagctcttctcaccaaatttggtgcaatgtgtgtgtgactaactgatggtttcatctctctgtcgcaaacaggcgtttcaccaatcaacaacaacaaaacatcgcacttcctgaatggcattgtgattggctcaatgtcaaccatggctcttgcattgatcgcggtactaggcttcctctggatatgtcttctgtccaggaagaagagcattggtggaagctatgttaaaatggacaagcaaactatcccagatggtaataaagtcgacacagctgctatcactcgttccggcctgtccaggccctcacttaatggaaactaattgctatctgtggtgttctgacttaggtgcgaagctcgtgacataccagtggaaccttccgtactcatcaggtgagatcatcagaaggttggagctgcttgatgaagaggatgtggtcggttgtggcggttttggtaccgtgtacaagatggtgatggatgatggcacggcatttgctgtcaagaggattgatctcaaccgtgaagggcgcgataggaccttcgagaaggagcttgagattctgggcagcattaggcacattaaccttgtcaatctgcgaggatactgccgtcttcctacagccaaactactcatatatgatttcttggagctgggcagtttggattgctaccttcatggtaagcctattgtctttcttgcatcttgctgcatattgtttcatcatcatggttacaactgcttcaattgtgcaaaaacttcttacattacctgatgctcaaaaacgccttgtccctgatttcaggagatgctcaggatgatcaaccattgaactggaatgcacgtatgaagattgccctgggctctgctcgagggctggcgtatttgcaccacgattgctcacccgtgattgtgcacagggacatcaaagccagtaacatccttctggacagaagcttggaaccccgcgtatcagattttggccttgcaaggctgcttgtagataatgatgcccacgttaccactgttgtcgcgggtacttttggatacctagcaccaggtacttattctctattccacactgtgatgctttcaatcaaaacaaaagatcatgctgtcctgcataattactgctcccccttttgtattgtacagagtacagactaacagtagaagcttatgactgttaagcactttctccgtcctaaaatatagtaacctaatattcgattagacaccacctagta

SEQ ID NO: 4736 - DNA, 9005 bp, Oryza sativa
  unsure (1)..(9005): unsure at all n locations
cattgttggctgggtaagaagaacctctctatattccctccctcctatgaatcttacaagtgacaaaagtaatctgaattgccaactttcttctgcagctcaacaccctgacgggggagcatcggctggaggagatcattgatgagaactgcggtgatgtggaagtggaagcagtcgaggcgatcctcgacattgctgcgatgtgcaccgatgcagacccaggccagcgtccatcgatgagcgctgtcctgaagatgctggaggaggagatcctgtctccctgcatgagtgagctctactacgagcagcacctggaactctgagtgagtacctcctataatggttgctactactcatgattgcagtgacaagcaacaaattttgtagatacatgatgatgaaccgtgtaggagtgtagctggacaagtgcagcttcacatcttcttcttttgtgcccagctggttctttgggcagaaccaaatcactgtggtggtctgtacatagtggagaccttctgttcatctttttttttctcatttatctgtctggctgctgcaaatccacttaaaccaaaccacagaaaaaatgctgtcaactagctaggtactgatgcaagccaaagtgataagttaacaacactattttggaacaagaaaatcacagacagcactaaattagttaataaataacttgaggatcatcagttgtgtagtatagtaacatacaacagctgggtgagtagctccaaatattccaggcttgcatggcaatccaatcttggttcttggtagatgtggcactagttaccagctgcaaacaaacaagatatacagtcaagcaagcacgggtgcaaaacttgcacaatgctccaggaattgaagaaggtgaaatgaaagaaaatatactactgggatggcaagaactagtggagttttgcacgcttccattcttccatggcacttgagaagtgagccaggcgggcctcatcaaaatctccatccctttcgaaagctttcacaacagactgactagaataatgaggagcatcgtatcatccttcttctttaatccctaatatatgcagattaatggttgagatctgaaccctgtcaatgtgctactagcatggtaatagtatagtagcttttcaagtaactaggtactcaaggatcaagatcaagcatgcgaaatctaatctttcagaatcagagcaatgttaaaatccaatctttcagaaccagagcaatgtgaaatcgctcagatagaagctaataagaaaaaaaaaggaaaagaaaaatgtgcattgtcattgccattttgccatgacattatggtggagccacccagtacatgtcataccgtgtttagtaaagcgctaataaagcctttcaaaaggctggcctgaagtgacaaatgcttccagacactggtatggtagcaaaacacaacacatgcatacttttacatgcatctatcagctgctgatgctgcatgctactacagcactgcactgatcatcactagtggatggtagtagtgagagaacactgtaatggcatgaattttttcttctttttttatcaaaggaatggagggacaacgctctccatttctattagagaaaaaacaattttacgattcttgagaaggtatcattttttctattctaaatttaatacctattgatatctaggtactataagataacaaattttacattaaatttttgataccttctcaagtactgtaaaattacttttatagaaatggtaagcttgtacggtacaaaagagtctttgcctgagacaagtccatggtagcacacacccttgaggctagttatggtagagacgagagatggggacatggggtacatgtacagtaataatattgcacanagagagagagagagagagagagagagagggcatgcatactccattttactcccacgagttaaaattgttggagtggtccacatgtcgatggcctttgctgtgttgacagcctggtaactggaaaaagggtagtacagtaagcaggcagagtaactgtagttcagattttgggacccacaatctgaattgtgaagcgaggcatgagacacgcgtgaaagaatgattggacggaccacatactaattgtcactagctagggtgtgttattcttcacttcttagtggagtactatgaaatactcataacttctatcgtcggtttattgtattaggagggatcacatccccttctagaatacattttctttaggcggagggtttagaactttaaattagaaagcaattcatacaggcatgatgagtattaattccacataaaaaaatcaagggacagaattgatactactactaacttctcgttcaataaaagaacaacttttagaagcgattgtaggacgagtttgtataagcatttgtttagatttgtctgttaataaagttgatttttttttcgctaaagcacgattaaaagagctataaggaatcaggccaaccatgcactgacctgaccttggtaaagcactcttgcagttgcccttgctgtcgtgccggaggcgtcgatagttggtcgccggcgtgatctaagcctaatagggttagagtcaaactgagttgtgatgtgtttgtgttggactggttcgtcatgggctggacgtatgtgcgctagctttggtgggcctgcagccgaccaaggcccggcccactatgtacgttgtgtttcaactgcctggtactactagtatagataggtgtacatttactgcaaccgcgagatcagcggagttcgtttctcaatgtcgatcatctaatctcatcgatggagataagaagatgaaattcagcccttccttcaccgaaaagaaagaaaccaatcatataatatactgtatcttcgtcgttaattaattcgttatctccatatctctctctctatatatatactcgcagccctatgctctgcccgcgcactgtaaacaaattactaatagattctccgacgatcgtagttgattgttcgtcaccgagatccgacaaacgccatccatgggtcgcggcggccgcggtggaggttagattcttcgatcgaccttaattttgttcttcgatcgatcagtcgtgcattatttggtagatccggccgaccgatcactgggtcaatatatcgctaataagtagtagcaacagcttaacttttgtgaattaaattattagtataattaagctagccagtaactaaattgaattaattaattggtgcgtacgtgcaggaggaggagggaggtcaagcttccgcggcagcagcacgggcacgaaagcagtaccccgtgctgctccggcgaccacgccggcggcgaagagcacaggcacagctccggccaccaagaatacttcctccggcagcaatgactccgtcataggatccatcggatctgctttctttgatggtcagttagttattcaatttgcttactaaggctctattcactttgttgcaaaaaaaacattatcaaattttggtattttagcatagttgccaaaattttagtaatttgtcaaaattttggcatgatttcttatatagttatcaaaatttggcagcaaattaaatgtagccattttttttgataactttatcaaaatttagtaaggttgaaaatgcatcaaagtgaacagaccctaaatttctagctagctccacaatgctatatactgctatatatacacttgctctccatgcatagatgcaaattaatctactagccaaataccgtgctttaatttgctaccgattaaacaaagtaatagtaattttttttagaataatttcatttatattgtataatactgatgaaatgtgatagaatcgtacatgtgcagagattattttataacattaaagtacattattaggtagttaatggaaaatatgattgagtaggtgataaataaaaaaaatactatactaaatggagtatagatatttgaccttagtttttttaatcagatttttgtcactggattatttgcttcgtgcttctgagaaatatgcatgatttatcaaaatacttttgtacctattgtattggtcgtacacctaccacttaattgcgaaatttattttccataatattaatttttcatgttaataagtaaataatcgagccgctctcaaactggacggcataatcatgaagtgaaaatgcagggtggggatggggcacgggttacgggatggtgcagagggggatggacgccgtcttcggccctcgcaccgtcaacgtcgtcgacgccacgtccacttcgtcttctccggcgccggcggccgccgctgcggctcatccaatgttggatgcgtgcggcgcccacaagaaggcgttccaggaatgcgtcgcccagcaagggatccacgtcagcagatgccagccctacctcgacatgctcaacgactgccgccgggactccgccgcctccgccgccgtcggcgttgccaccaccaccagaattctctgatggatggatcgcctgccagcctgatgcatcatatccatgatagcaatgcaatccatcgattgattaaattagtttgattgcttgtttatttatatccgttttgcagccacacgtaataataataatcatgcgacgctgtatgctactgcatggatggaccttaataagttaagttaatttatttgcttcgatcagcttgaaccaacgaagtaggattacgtaggctaaaactactacaccgacccctctgtttctcctttttaatggtgcattcttattctactgctactatcgttttctttctagtgtttgttcctttttgtttaattagatcaccttgaataaatgaactattacactagtttcgattatgaccgtatatatcaaccattactgttggcagtcaaattgagagtcatagcttctgagattagtattgtgttatctgacttgtcttgatggatgagctggaccgatggacatcatttgtgatggatagatggatgatgcagaaatgtcaaacgtacagcaattaaactggacaacttaaaagaaaataccggaggataacgtttacagatgcatgatcgagggggttcggagattaaaactccgaacccctctggaatctggatattcttttctttttaacactgtgtgttactctctcttttttttttcctcatgttcgtcgcgtgtcgaaacacttcattggcaactggcaagcgctaaccagctgacagacaactagcaatattcactgaaatcttaatttgttggcctttggtaaaaccattcagctaattcagtgtgcctatgctttgagcctacttactactcagttagcatttctttttgataaaaacatacaactattcctttcaaaaagataaaacatacaactcgaccagtagacggcaatgtcatctgatcatgcatatttatcgtcctactcggtcccctgaatcagacattcattcaattagatatctgatcatccgattaaagcacataccaaacacttttagaacaattcttggactgcatgtgaagttgggcctcggaattatttagtcggctcatgcatgcattctccttagggtttagtcaccagggatgtgtgagttgtatccctacttctgatcttgtgttattggttttgtcattgatggccttatgatgcgaaatgacatacaacaattaagcacgattaagtggaactgaagagaaaatagctgcgataacgcttgcagaagcaaggttgaggggttcggagattaaaacgacgaccctttgtttcttgttttttaacggcacattttctactatatattctctttattttttctcatgttccttgctttcaatcgccttgaatgaactattactagtttatgcaattatgaccggagcaatgaaccttgagtgaactagtattattttctttaccttttttttccttctatcttaatactaacatgcatttggatattgtctgggtaaaagaccgtatcaatggccatgtattaatggaaaattattgcaagcaaaatgagagtagcttgtgattggcttgtcttttttatgggctggacctggacaaatgtgatggatgatgcagaaaggtcaaacaatgattaacctggacaaatgaagagaaaatactgaggataaggcttacatgagcagcatcgataggttctgcgattaaaacgccgacccctctggatcttatgcagttttgttttgttttgtttgtccttatatatatgttcctcgcatgacgaaacacttacaagcagatagtcactggcagtgagctagcgatattcactgatatcttagttggcctttggtaaaatacttgtactaaaattgttcagctaaatattaagtgtgccaaggctgctagcctttaaagcctactgcccaattaccgttgatactcaatgaggttacgaaccgggactaaaaacgatttctccaccagtgttatttcgtcttaaaggatttagctcgatagatagcgacaataacttccatttattactagccacgtagttatgttttgcgtgacttttaatcccgtttaacaagttctgtatctgatctattagtttatctcagcttttaagaaagttataacattagcacagtatcaattagtctagcaaattataaatttagctaagttatacttatagatatatgagagaaatcactataaacctctttttttttcattatcttcgtctcctctctctttatatcatctgtccagtagacagcagaaacctctagagatacatgttcagcctatttatgattttttattatctatatacccttttatccaactatcagtaatttcttttgcgagaaatgctcagtattgtttacacaaactttctattcggctcatatggttttggtaaaattggttatataacattaaaagttcacgttttttttatagcaccaaaaaataccggttcactttagtagttatccgttctaatttttaacacttccgtcaattctcgatcatttttcatccgccttgatcgctattgatctagccacacacgcgatataatatttttactcacaagcacaggtagaatgcagaatgcatggcaataagagataaaaacgtcgtatcttgaaaaaaaaaagtttattactactctactttcacgcgcgttcgacatcacactacactgctgcctggaatcatggcgcatggagccaaatcccaaccttttgtaagcttttttttttctcttcctcctgtagcagcacgtgcatcaagaccaaactaatcagctcactttttccctttcaacttaataataataattcagtctcatatactgttcctagtcctagaataacagaaaattaagctaccggtcaaatcactgagacaattaaatataaatcaatcaaatactactcgtcagcttgtttaactacatttcatgcattgcctagtacattagaattagctactcctagattgcactgggttactgacatcttgctctgttttggccctcgcagcatgcattttgttgttaaaaaataagctattcgatcctacttcttgtatacttttactgttaatcacatcctttttatccaccacatctcccacgcgcatgctgtaagtgttcactttcattggactactttccaactgatatcctatactcagatgtggctgcctacccaaacttttgaactaattaacttaattaactgcattttttagcctcacctcaaaggcaatctaaacgggagagagaagaaactaaaattgtactgctacggtacctcttgtacgcttcccactcttggatcaaagttactgcatctgttctaaaacgtaaaagatttttatggttagacatggttactttaaaaaataggtgaaattaaaaagaaaaaatattataattggatgaaaagcaaagtaggtgaaaaaaatgaaatgatggagggctataattaattgggaagataatattgatagagatattgttatttttttcgtgaacacgcaaaatgattgcacgtcaatatattagaaggaaaaaaggtatttttttacacaacgcaatcagtcagaccggcttatgccaggggaaggaagaaaaaacaaaataaaagctgtagctaggaagaaaaactactacagcagctatacgtaactccgatcagcaggaagaggcggtgccacactacactcccaagaaatctttaaaagcaacaatgccagttaaagaccacagatggccctccgagcggatggactccagaaccactgagaccgaaggaagtgcggagttgaaaaccctggagttctattccttccacagctgccaagtggccaggagaactagggagtcgaagccgacatggagatgctcagataaacaggccctagagattggctaccagtcctggatccatctcagcgccacgtcaactggtgctgaatgttgtgccaccgcggatgggaggctagtcggcgtgccaatgtgcattcagcgccgtgttattcggtgctaaggtgtctaagttcagcgccacaaaaggttcgtattttaaataagttttggccacgattcatttgtaaaattagtttttgtaaagggttaaattgtcaaaatttgtgttgttgaagagactttctaccgtcttcaaaactgtcttaactttttttacaaagtagtgcaacatttttttttgagaactaggttatatcatccggatccgggaggcaatcacacgacgtgtctaggagtagtatattcctatctacgtactccccttgtcgtcgtgtacaaacatttactgtaccagctagcgctccagtccagcctccaaccggccatgcccatggcggcggcggcggccttcgcggcgcatgtgctgcgaggccggtggttcatggcgtacggctccttcctc

SEQ ID NO: 4737 - DNA, 35975 bp, Oryza sativa
  unsure (1)..(35975): unsure at all n locations
gcgcgccgcgaataccgcgcgttctgtggcttcctctacgtgtcgctcgcgctcgccgcttacctcatggtcgccatcatcctccagaagaggctccgcttcacccgcgccgagtacggcgtcagcgccgccgtcgtgttcgccatgctcctcctccccttcaccattgtagtgcgcgaggaggctgctctgttcaagaataagtcgcctgaagaagaggaagccgacgacgtcccgcgggcgctgtccgtggtgaccgcgcccgcgaagccggcggcacagccttcgcctgaatcccagagaccgacgacggcgacggcgaggatcctccaggcactgaggccgccgccgcgcggcgaggactacacgatcctgcaagccctggtgagcgtggacatggtgctgctgttcacggcgacggtgttcggcgtgggcgggacgctgacggcgatcgacaacatggggcagatcggcgagtcgctggggtacccgcagcgcagcgtcgccaccttcgtgtcgctcatcagcatctggaactacctggggcgcgtcgccgccgggttcgcgtcggaggcgctcctggcgcggcaccggctgccgcggccgctcatcctcgccgtggtgctcctgctcaccgctccggggcacctcctgatcgcgttcggcgtgccggggtcgctgtacgcggcgtcggtggtggtggggttctgcttcggcgccgcgcagccgctgatcctggcgagcgtgtcggagctgtttggcttcaagtactactcgacgctctacaacttctgcggcacggcgagccccgtcgggtcgtacatcctcaacgtccgcgtcgccggccggatgtacgaccgggaggcggcgcggcagggacatggggtggccgcggccgcggggaagaaggcgttgacttgcatcggcgtgaggtgctacagggagtcgttcttggtgatgaccgcggtgaccgtggcggccgctgctgtggcggcggtgctggcgtggatgactcgggtgttctacgctggagacatctacgccaagttcaaggacggaaaaacggagctcggagtggacagcaatggcagtggcactgccaagaaataatatactagaatactgtactcgtatttgtttgaggaaaccaaggaatatactgtacatattacaaactttatggaataatggtcctgtgtgtcgtcttccttcctggaagggacgactcaccactctggccggccgttctgttttggtctagtctgttctctcctccattccggtccatgtgtctatggcgatcggccttccagcctgagtgatcaaggccattaataagaagcgtcgcgccttcttgtggacgggcatggactcggctcacggtgggcagtgccggttttcttggacgaatgtctgttgtcccagagctttcggtgggttgggaattcatgaccttaggttggcaggtttttccctgcgtgttcgctggctttggctccagcgctcagcgcatccctactgggacggcctgaaggccccagccgagcaagccgtctcttacatgtttgaggcgttcaccttcttcataccatgtgatggtgagacaattcttttctggtctgaccaattgatctgcggccgctcggtagcttccttggctccggatctcctcttcgttgtgcccccgcgtctgtgtggttcgcgcacggttgcttctggcctggcaaacaacgcctggatttctgacatccacggcgccctcactgtcccggtcatctcccaatttctccttgtttgggatgcggtactccacattcagcttatgccgggtgtcggggatcatcttgtctggcgttggacgagtgaccagcgctactcgacgcattcggcgtaccaggcgttcttctttgaccagcactcctttgcttgtgccgattttctctggcacgcgaagggccctgctaagtgcaaattcttcctctggtttgcatttcagcagcgctgttagacggctgatctccttcagaagcgcggcattgatagccactcggcctgccccttttgcgctcaagagcttgagacgacgaaccacatcctccttgactgcgtgttcgctcgttaggtctgatgacgggtgttgtcgtctcctggctgggctgtcctctctcccctccgtggcagctggctgcaggattggtggccatcttctagggcatgtttaccttatcatctccgtgccagcttcaactccctagtcctcctagtctcatagcaactgttgaaggaacgtaactccagggtctttgactctgtgttctcttcggtcacagtagtcgtagagtccatcctttcggaggaccggctgtggtcgttagcggccgttgcttcctttggggaattgttgggagcgtagagtggctctaccccctccccctgtttggagtagagttaccgtcgtttcgagtttttttcctttcctttctttgtttttcttccttccttggcataggccggtctggctgagtgcgttgtgtatcaaaactctatttttctaatatattgacgtgcaatccttttgcgcgttcgtgaaaaaatgttcatttttgcacaaattatttacacagtttttttttagtgtagtacgtagaagattaagtatatcacaaactcatcaagtggatttttaagcttggggatttgaatttgtgtaactttaagctccaaaatttaaccatgcaactaaaaaactgcaactttgtagacagggggaaagggaaaatgctgcatagtccactgggataatatgaagttgatactgtcaaatcacaacagtatctcccaaagaagtggtcttcggacttactaaatggcattgttagggattgagatcctctaacttctcggtttcaaaaataaaagtttcatgtcaaccctctactcaatgatctcacatacccacataccagtgactcaaagttagagggaagtaagtaagagaatcctctctcaattgttagatggtgcgatctcattgaggcctctttagagcgtaggatagaaaaacagctgaacagaaaaaaaaatgcagaaatcaaagtgacatgttttttttatgatacagaaactgagaacacaagaagagaaaccttttgattgcatcacgggaaaattgaaccacagaaaaatttaagactaccaaatcttttgttttttccctttaaattctaccataggaatacaatccaatagagaacattctattgttttgctatgaatgaaagacgtcttttggagaaattcataaggaaattgatcgttgaaaagaagtcctccaacaatccttcattttaaataggccctgaaatggagcaaactcactcaagattcccagctttcgctctctggtattttagttcaagttggaaatttcaagttttcaacgccaagttgatactactacgtgttagttgtatcccatgagtaatgtacgagtacaaccccaagagatgagcacaagtgcacaacagtaacacaaccaactcaattgacagcgagctgtacacaacgtccacatgcatatctgcttgcttgcaagcgacaaatttgacagcctattataggtcatcggacacatccaagattcatatgcatacagtatgcaacccaaagctaaccatcaattgaactagtatatccaagttgtcaaacaagaagaagatccaagaagaagaagaagaaattgggtgttgcaatgttttttagaggggaggccagatggcccagctttttatagaaagcataagtcttacaaaccgttttacataatactggggctgccagttttcaattaaaggcattaccatcaggcatcagaacataagcatccaaagaaggatgactctaagaagaaggatgactctaagaaagggtaaaggataaaggttatctagcagaacagagacgaaaactaaacagatgggagcagaattatccaatcccagctcttcgtaaggacaccagtactccttgcatagcttgagtcttcatttccaggtcatgggccttctccggctttaatagaatcttccactgtaaaagaaaaccaatcaagcggaaagagataatcaggggtgaggagattagtttgtttctaaaaatcatatcattgcgagcagaccaaagagtccaaatcaaagcagccaaaatcatggtattaagtctagaggttttagaagtatcaaaaccatagagtctaaagaagtcctcaaaattaaaagggatccttccccagtccaaagcatcccgacatacacaccaagcaaaagtcgcaataggacagttaaaacagatatgaactgcatcttcacttctatcacacagttgacagaattcagagccttcccaattaaatttcttcagttgaacagccgattgaatctttccccttatagccagccataaaaagtgtttttgttttggaggaatcgggctagcccagataagttgaaaatgtgggtcaattatccctctaaatgtgggtgttgcaatgttgtagtatagcacttcttaaaaactaaaagaacagttataaagaaaaaaggagtcctttttgctcctctatctctcagatcttctgatcgagcagcagaattgcagctcaggtgctcgtcggcgtcatcaccgccttctcctccttggattccaccttctcatcttctccggcgccggtgccattgccagcgccaccgccaccggcagccgccttcttcctgaagcgcgcgtagatgtccccggcgtagaacttcctggtccgccacgcgagcgccgtcatcaccaccggcgcgggcaccgtcaccccggcgacgatcaagaaggaatccttgtagcacttcaccccaatgcacgtcagctccttctttcccgccgccacggccacccgcccctgccggctcgcctcccggtcgtacatcctgccggcgacgcggacgttgaggatgtaggaccccacggggcacgccacgttccccacgttgtacagcgtcgagtagtacttgagcccgaacacctccgagatgatggccaggatcatcgggtacgccggcccgaagcagaacccgatcagcaccgacgccgcgtatagcgaccccggcacgccgaacgccaccagcaggtgccccggcaccgtgagcagcagcacgccggtgaccaccaccggccgcgagatgccgtaccgcgacagcagcgcgtccgacgcgaaccccgccgacacgcgccccaggtagttccagatgctgatcagcgacaccagggtggcgatgctgcgctgcgggtaccccagcgactccccgatctgccccatgttgtcgatcgccgtcagcgtcccgcccacgccgaacaccgtcgccgtgaacagcagcaccatgtccacgctcaccagggcttgcaggatcgtgtagtcctcgccgcgcgacggcggcctcagcgcgcggaccaccctctccatcgccgtcgctggtggcgtctcggcggccgcgggcgatggtttcgtggccgcggacagcgccgggacgtcgtcggcttcctccttggggggcgtcttcttgaacagggcggcctcctcgcggaggcgatggcgaagggggcgaggagagccgcgaacacgacggcggcgctgacgccgtactcggcgcgggtgaagcggagcctcttctggaggatgatggcgaccatgaggtaggcggcgagcgcgagcgacacgtagaggaagccacagaacgcgcggtattcgcggcgcgccgcggctggcgagcgcggcgtgcgtatgatccggatggtgccgaggaacgccagggagacggcggccggcagccagccgacgagaaggatgagcggcttggtgttgccgccgccgtagaaggcgaggtagagctgcgtgaagatggcgccgctgaggccgacgaatcctttgagcaagccgagtatgacgccgcggctctcggggaagttcttgacgcaggtgacgagcgcgccggtgttggcgaaggcctgcgagttggcgccgacggcgatgtagaggcagacgagccagagcggggtcctggcgccgacacggccggtgacggagaggtagagcatgaggtaacccccgagattcatggcggcgccgatggcgaggacgaaccatggcggcgtgacctcggcgatgaggccggcgtggatgccgatgttggcgccgacgtccttgaagaagccgacggtgttgagctgctcctgggtgtagccgagggtggacttgatgtccttggagtagatggcgaagatgtacgtcgcccccgccgccgacatgatgaggaaggagccgtacgccatgaaccaccgcccccgcagcacctgcgccgcgaaggccgccgccgccgcgcccgccattgccgccgtctaccaagctcctcgcttaattagcttgttggatagataggagtgtgtacggtcggtgagatcgcattaattgcagacttgtagcagtaggaggagaggaaaatcgttgaagatgcatgtgactcactcaagtccacttcactgattgagtacacggtttgagataattttgacaaaagttttggttcagcgtcaaattgccagcatgatattgacctttgctgcgatggtttgtcccaaagtctgatgatcctatccaaatccccaattcccaaaatctcatcttttatgatggatattcttcagcattgaggaactctgctgtcttgccagttgctactgtctgaaaaatgcagataattcactaatctgattctgttctattccggaaatccggatttgatacttatctgttccagtctcttactcctatcaacattgacatacagattatgccaaaactaaagaaaagatcaactctttcttcagacggtatggcaccaatttgttcaagctggtagggataggaccagcggcagcaaggcagcaagcaggacagtttttgttgactttggtaatgctacttcattattgcacctctagtttgtggaagtgcaactataactgaaaatttatgtcggtaatgaagaaaaggttgaaggggcagctaaagagtactcctctgttcaaaaaaaaaaaacacaatcctagaattggtttttttattttttttttacagagggagtacccctctgcaaaaatgttagaattattttatatttcagtttttcttaatatgttagttatatttgtagtattcaagtatctaggatataaataaaaaaatatttgatcaaaacccgataagttatcttaataatcattggttgcatgcatgtattttttaatctatgttacatataagatgagttaattttttcttaatcttagtaatgaaagtaatatgtctaagggcattagtatagtatactcagtaagtaaggtggggtctaacaaatgtagatttttgtcgttggaactttcataatgtgtgaggcaataaggcggtcccatgactatataaaaatccaacggtgtgcaatggcatggatggaaaggagagagtcaacacataggtgagaaaatagtgtttttttattccttactattctctatccaaaagtctaagatatattttattttttgttatttcaaaagtctaagacctatttgtaacctttacatatccaaaagtctaagatatattttattttttgttatttcaaaagtctaagacctatttgtaacctttacatgctaaatttctcttaaaaaaatctttatgtgctaaattaaattgttgacggaacacaagaaaccatcttaatacttattggttgcatgcatgtgtataatttattggttttgtcacatggtggatgtgataattactcattggtcttggtgacaaatgaaatgtcttagaattttgaatatagcaagtactagggagttattgttgcttactacttccacaatgtttgtattattgcttactacctggtttttaagcatattgtggatgccataactcttttggatggagggaatatttcatacttcctccatccaaaaaagtctaagacctatttataatctctatgtgctaaattaaattgttgaccggaacccaaaatgtcatcttagtacttattggttgcatgcatactataagggttattgataccacatacccaatagtaatcgactaagctcggtgaggcccaccacataccatgttctatacggaaacaaacctcgtaatctcgtatatagaaggagttccggataaggaataacaaatagagttctatatggaaacggcaaggactacttggattgtattcattttggtctccctagttttatttggacaagaggacacctatggatataaatacaaaccccctaggaggagaggaaaaagaaacccacaatacacaagccaatacgccgctggatattaacatcagagataagcctagacataccccatctggtgcctacgaaagccggcaagagggatctagcgccatctctgatctcgacgagttcgtacttgaggaggaagactaccctgtcgtcgactacgagttggttatctagccgccaagtcgacgacagctagataggttatcccaaatattatatttgtgtgatccagatgaataaagagtaacaccggctttggccaacaggatgtagggctattacctaccagataaggggcccgaacctatataaaaatccctatctccatctctctttacctcaatcccgcatataccctggtgccaacgatccccataccatataaataccgtagtcgcgatctcaaacgtcaacacatgtgtatagttcattggctttatcacatgatggatgagttaattactcactggtcttactaacaagagaaatatgtcttagatttttggatggagggggtaccaggctaccagctactccctccgatttcattttaattgacgttttggacaatgacacggtctacaaaatatatctttgaccttatttttctattataatatatacaataaataaatgcatgtttactttattatattactttgaaagacaaatctatatatgttgttcttgtttctttaaaacaaatattttgaaagttattgatggtcaaagttataaaagattaaactcaaccttgtccaaagcgtcaattattataataccggaggaagtaagacacaaccaccactaacacaaataaaaagaaataattgttatcaccttctcgtttcgaccgcctcaataaacacgatgcatgcaccaatgagattagggtggatgattaacagaaaatttatggaagagagaagtattagtgaattgtatgtagacatacgcacatcatattatgaaatacttaaaaaaaagtggctacaccttagtatattttaggatggatgggtataaagtactagctttgaaacccccaattttgaaaagatatgtgtttttaagtgtggctgggaatcaaaagaaaagtaaggttttggtgtacatatccatcgtgaaccggaaataaaatggcggccactgtcaaggccataactgataggttggatataatacgagaatgacactgcacagctctcatttacttgttgacagcactttcaggctgtgcaccactatatctatatgtagatcagcagacctttagtaaagtgaagggaatgaaaggagttaagttcacacgtttgcatgtatctacaaatgaaatcattatccaatggtgagaattgttacacgtgtgagcacactcaactttttctcctaaaaataattaaaaaaaactttatctgcagcagcgtataaactcattcgcgggaagattttagtatgtgtgttaactgtgtaattgaaagagagagatagagaaatctgaattgtttcccttgttgcggggaaatctgaattgtttgccaaacaaacaaaagagacaggtcctcacatctcgcgttcaaaactaattgggccaattagataagcccggcccaaagagagtccgtgctgcatgaccaggcagaagtcagatccaaccggcctgcctgtcaatctacaaaggatttggattcataagcatttgtttagttggaggacggaatggatcggattgagacgaatttattttctcagggtgtttattttgggatacgctaaaccaagcatacgctaagaattactacttataactgtcatttgattatgtagcaataaggtatagaaaatccaaaggaaattaatttccttttctaacagttgtagagaaaaaaacataaaaaatttcccatctactcataccttttttttaattagtatggatttgtaattatgcattcctgttcctacattattttctatttctgtggagttgaaatcccggcctccaaaccaaacaagcctgcgctgttttgagtatctttataccttacaggttcttatatatgtctatatctcttagggctcctttggatgcaggggaggaaaccccgggaaaaattcccgtacagagatttttccctgcaccaaccgatccccttccacctccaagggaatcactcctgttaggggaattttccctgataccatttgggagtagggggagagggttgatgggggaagggggatttagacaggcaaactgctaaacagtgtttgaacaacatgtctctagaaatattatagaaatttcaggaaaaatagaaagaatatagaaaatccatataaataggaaacaacctacaaaaattccagaaaaaaatataaaaacataaaaaatcaacaagtattagaaattcagaaaaatacaaagaaatataggtgagtttatgtggaaaccaacttcgtgacatgacataagttaaactttagaatcatccatatcatacaaaatttaaaatctttggaatcatccttgcatccacaaatatagaactgtacattatatttatatccacaaatgtcttgatcaagaatgagacatgggtccatttaaatctttatctcttctatcttcttcatcatctcttcaacaaatcttcatatattctaataaatctgtcaggatgaaaaagataatctgaaatttaagtaataaatataaaatagtgatacttcagcaatcaaatttgaaggatggccattgatactagcttaggaaaaaaatgcatgcacatcaaccaacatattgcaattgtcagctacatcagcgtaaacaaactcttggtataagcactttctttttagatcaaacatcctacatgcagatacacaccattatttttaaatcaaacacatttgaagtccatgtttttgtattgatagttttccaacaatactctatttcaagtccatatttgaaagtaagttgagcatgcaattcaaattgaatcctggcaagaggaagaatgcaagagcacaattatgaattatcattatggacatgataaggaaaaaaaagtagtagtagtagttgttgttttaattaatcggtactactaggtcactttgtttggccagtgtattgtgcagtgagtgagagagaggagattgaaacatctgtgtgtgcgtgtctttgtatataggttgctgccaaagcttgtgtttttttgaatgcacaatgccaccttgctcattttctgctagtgatacatgacatgaaactaaagtttggactaatgtataagtatagagcataaaagacttcattttgtagtaagtatgagttcctatcaaaaatatgattgttaccatttatttagtcccaacatgtatgctaaattgaccactaattctacagttccctgacagagactacaagaatggatcagactaaaaaatacctccagaaaaaacaaaaaacttgatgctagcagctcaaccagtactgagatctacctctaggttaacagagctgacagcatccaactaaaagaactgcatctctaattaactacaaaaaactgttactggtttgcagactaaaatttctcatatacctcactagttgaatgatcctcactgcatgtgtgataattcctcatttcttgggattggcacattgatctcacatatttagactacactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatatcacaatgtattagaaagaacaggagaacagattacaactctcccaaaccaaatcaagaaacatgccatacatacaccaagaaaactgaagtactgaacgaacccccaagaatcaagcagcagctacaagggcacgcacaaacctagccgggcaaccgccggcgggcgtcgcgcagcgaggaggaggaggaggcggatctgcgcctcagcgcctcctctaccggtgagtcgcgccgccttggatcccccctgtccccgcctgcttggagccgtgtgcccgcgctgccggctcgccgcctcgtcgtcgttgcaccggctgccgcggtgccacccgccgcgcccacgcgtcggtgcctgcgatacaagcgctgagaccggagagcgagattgggagctaactagaggaggcggaaaccctagaggaggaggagaacggaaacccaggaggaggagaggatgggaataaggagaagggcttacccttctcgccggaggaggagtcccggcggtggcgcgtctcgccggagaaggaggcgcggcggcgcccgctgttgttcgcgcgagagagaagcgactccggttgcgcgagcgagaagcagtggcggatcgagagagcaaaaattcccaacctccgaaggtcggggacctttccctagggtttccccgtggattgggccgggaaatccctgcctcgtgggcttccaaatggacatggaataaaacccgtgacaatttcccctgcaggcctttctcccagggaatgggctgggatcccggtgggatcccgggctgccaaaggagcccttatatgattcccacgccccatttaaacggtcattgcttaattttcttgtaagttttcaatctaatggatttgaagcgatatgacactttaatcctgtaccttttcagaaatcagaacctgtagtgttccaaagagccctagatcggtggaggctggagggagagaaacatcaatgaagtgttcattatagtattgcacaacatgatattttttttaatgaaagaatcgagtggcatatgtttttacacgtttgtttgtagctttactagtactataaaatgtaccactagtatataggagtaccaagtcactgaaatggacagacgacagttgcgtcttgtccgtatacattgttacacacacccgttttgttcttcagctggtagttgttgcaaaatgtgcagtgcaaagtaaggtgtaagttaatctcaagaccctagcttggatgggtacagcgtgtgaaaacagacaaaataatggatgatccgaaacgaaacggacagacatgtcactagctctgtcgtcagtgaattaattatcacaaacacgaataatgtggtacaaaattaatcgtgacctcgatcgtgtgtgtagtactgtagccgaccgtcgatcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggccatgggggctcgcctctgcagcagcagcattattgttgtggtggtcgtcctgattgtggcgacggcggcggaggcgatgcggtgtccggggacgacgagcgtgtaccggcggccgaagaagaaggcggcggacatggtggacatgccactggacgccgacgtgttcgcggagccggcggggaggaacgcgccgcagcaggtgcacataacgctgggcgaccagacggggacggccatgacggtgtcgtgggtgaccatggaggaggccggcaacagcaccgtcttgtacggcctcgccatggacaagctcgacatggccgccgacgccaccgtcaccacctacacgtactacaattacaccttcggcttcattcaccactgcaccccactactaggaaaatgatttgttgccacgaaaaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggcctatggggcagtaacagaagcttagatgccccatatactaataaactaaacaggcaactgtttttgtcagcaaaggggacgtgccaaatactaatacaatccaatgagttaagtagcaaaagtaccagatcattacctggatgctacaccaaaccccgagctgatttagatatttctttcattcattcttccattttctcctctggcctgttacaggatttggccatacacaataagaaattattttttttacaaacagaccatgagcaggaaaacatattgtaaaattttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgctgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatatcctcccgtagcatttccctttccttacgttcttctgaatcttcccgtgacattgtcatcatctgaatcttcaccgtggtaaacccactgtatgtaactttcatcgaatccattccttagcaagtcactttgcacttcggagcgtgttttgtgtaccacattaaggcatcttctacatggacagggggcattatccccaggattatcatcttgaaatgcaaaatttaaaaattcctgcaaccctttttgccactctgcagttgccctactcatgcgcatccaactcttatctactgacatgcttcctgcttatcactatacaatattactaatagtatcaaaccacccatttaatgaaaaaaaaacaaggaaaatatggttggcactttatgatcttaaggaaaatggagaaactgtgtgaacataaactcaccttgccagaacttgtctctgtaggctgaccagaaaaaatattcctgtacaaagatatgaacagataaattagaactaaacaaaatcatgaggatttgagctgaaaaatagacattggacagtaacagatatattggtattcccatggaaggtgtttcttatttttcaaaattcatatgagaaattggacaaactgaagaaattaataaatatgagagaccgtgtatagcaaatttggatattgtgcagtataaccaaggtaaccttgtgggagacagaaattcagaaacaaagacagaaattcagaaacaaacataactcatctgagctattctacgctagcaatgctcgccctgcctgctctgcttgcctactaagatagctaatctgaagttctaaactactcactgtcgctgccgctgcggccgtcaccccatctgcagcaagcaacatcctttgctctatgttaccgagatacagggatacggatatggataggatacatcattttctgaaaaacatggatacgggatacgtctatatatgtatacaaaaataatatgaatttatgcctgggaaatcaatagcactagtaaaaaaaataaatcatgtcttccagtctgatttctctctatcttctccaataactcaatttaattacctccacaacccattggatggcagctttgtgccctggcctacgtggtagtgtggtggcgatggcatagggcgtccggcggtggaggcagtgctacgcccagcggcggcggcggcagcggcgcgacgcggcatattcggcatccgacgatacacccggcttccgtcaacggcagcgctgcgctcggcttccatcgacggcggcggcgctgcgttcaacttccatcgatggcgccgcggccgacccccccatctgcagcaagcgacatcctccggctccgcttcctcgtcgacgccggggccgaagccgaccctgtgtaccctcgcatccttccattgtagtggctctctcatgcgttgactgaaccctcgtcttccccagcgaaccctcgtcttccccggcggatgtggcgcctctagccaggcacctcgcttggatccctcccgcacacatctccggcatgttgcttgtggaactagggctggaggatcagatcgggatgaggaagatgaattggaggggatgcaggcgtcatccggtcgccggcgcaagtgaggcggcacagaagacggtgagcgccgacggattgggaaatttggctagaccgtgaaaaaagaaattgtgtattcgaggaggatgaggggatgaaaacgnaggatacctgaaggctgaaagctgaatcactgaacggagtggaggaattcctcgtgacgcggttgacggcggcaccgtcgcggtgaaatcaccaggcgctgctcctccgtgagactttggaagtcacgggagcactgcccagccgtgtgaatggaatagattagattgataaatagtactaataactgaactactttttcgggagttaatcgatcttttcacgcgcccaaaaccgcgaaacacagaaatatttcgcgctaaattttgggaggttcggctgagtcgtggcaaatattgtgtgcttattgccacaaaaatcgaagtcgtggcaatagggcttgtacgttgcaccgatattttttttgtggtgatagcttagtttttattgcaacgatattttatttgtggtgataacttatttttgttgcaacgaaaataaaagatattacaacgattatacatcgttgcaacagaatatacttatttgccacgaaaagttttatcgtggcaatagtatgatatattgccaccaattatttttcatggtaatactttcgtggcaatagctaatttttcttgtagtgccctcaccaacctccaggtatatatcaccagtttaccccccacacacacttgttccaccccaaccgtttcacctccagactacggtggtgtttgaatctcccgaagatgaagataaagataaagattaagtgtttcatataaaacgagatgataataacgtgtgattaattgagttttaattattacaaacttgaaaaatggaccaatctgatattttagaacaactttcatatataaagttttcgtacgaaacacaccgtttaacagttcgaaaagcatgccacgaaaatccaagagtttgtcctaacttttgttggagaaaagaacaacttttatattattgattataaaccgtaacgcttattaacattaatatataatttataagtaaaacttttgtacatatgttcttaacaccttaaaaacaacaataaaaataaactaggatttaaattataaattttggttacaacttataagctgaaaaacaaacgatagagctatatattatgaatattactgttctattgacaaaaatatattatcaaactctgacaagtcacaagtctaccagaaaatgtaattgaggaaaatttccgtaatgctcctgttcacatatgtataagtatttctaactagtaattgaaatttttatataagtatttacccaccgactccatatatcaaccaatcaggtgatgaaaaatatatatggtataaaagtaattttacctcaatcttaatttctcctaaaactccagaaatatttagagaccatgttcataaagaaatgctccattagctatgaaatatatactggatcgaacagtggtgcagtgtcttgatcagtcgaacgatatactggatgtttccaaacatttatacattctcaagcaagcggatcgaatggagtggccctattaattaattttgtttgcaaagttaatatattaatatgaactatcaaaatatgataggtaaataaattattggcgtttcttccaaaaaaaactattggcatcaaacaagtggatattggacaggcatatgtagatgtatgtgcagtacctgcctcaaggcaaaatgaagtactccctccgtttcgtaatgtaagtcattctagcattgtccacgttcatatagatgctaatgaatctagccacatatatatgtctagattcattaacatctatatgaacatggacaatactagaatgacttaaattatgaaacggaggaagtaccacctaaaaataaattagaaaaatatttatatgcaagcgtacattcatgtcaagaaaaatatcagatgcaagtgtccaataagctgacataattagctgaacattatatgtatatggattaattaattaattagagtggaattattaattacgctttgggacgcagtatggcgtaaagtactattacgccatgggtttcgggttcacggtgcgcagcttctggttcacgacgccgcctcggccgggtcccgacgtggccttccggctggggctcatcggcgacatcgggcagacctttgactccaacgccaccctcacccactacgaggcctccggcggcgacgccgtcctcttcatgggcgacctctcctacgccgacaagtacccgctccacgacaacaaccggtgggacacgtggggccgcttctcggagcgcagcgtggcgtaccagccatggatctgggtggctggcaaccacgagatcgactacgccccggagctgggggagacgaagccgttcaagcccttcacccaccgctacccgacgccgcacctcgccagcgcgtcgccggagccgtactggtactcggtgaagctggcgtcggtgcacatcatcgtgctctcctcctactccgcgttcgccaagtacacgccgcagtggaagtggctggaggcggagctggggcgggttaaccggagcgagacgccgtggctgatcatggcgtcgcactcgccgggtacaacagcaacaacttccactacatggagggggagtcgatgcgtgcccagttggagaagatggcggtggacgccagggtggacctcgtcttcgccggccatgtccacgcctacgagcgcagcttccgcgtctccaacatcaggtacaacatcaccgacgggctgtgcacgccggtgcgcgaccgccgggcgcccgtctacgtgaccatcggcgacggcggcaacatcgagggggctcgccgacgagatgacgtggccgcagccgccctactcggcgttccgggaggacagcttcggccacgcggtgctggacatcaagaaccggacgcacgcctactacgcctggtaccgcaacgacgacggcgccaaggtcgccgccgacgccgtctggttcaccaaccgcttccacatgcccaaccacgacgactccacccccacccccaccaagcgccattattatggatgattcattcattcgcatccatccatcgcttcctcttcatcgtcgtccatgcctgcctacctagtgtgattttgtacacgtacgtacgtgtgattttataataactatatatataatcgtgccaatcaataccattaggtgtgtaagtagtaacagtttactgtaatctcttcctgctgctgctgttttctgaataaagaggaggcaggatatatctatcgatggaggagcacagagcactgcctgctgcttcctctgaaaatatatctgaatatatatatacacatctgcagtttgcaggccaattatatatcatcgatcttagctagttgaaatccgaccgactcgactcgactcgattcataccccaagatcgctttcagtctctggcgcaatcattgtcatgcggaatataatcctctgccatggactattggactgagaagaaaaaaaagatcaatcttttcgggcgactcacacctcacatgtagagccactgcgagctgtttctttctccatcgctagctgctttttctcagctgaaaagaacatgttcaagatgccaatacctttcacgctagcctctcactcaaaggtacttcataaacactggaatatcaaatttacgaatccggattttccgtacgaacatcaaatgagccgagcagaatgaatgactgactgaatgagtggttccagtcattcagatggatcgagtcagttcactaacaaaagtaaaaaagaatcgaacatttgaggggcatgagggagtcttgaatatatatcatgtgtggttagccaaaacttaacggtggtcgcactaggcagaatcgacacaagcaagcactgaactgacattattgatgaaagggttagggcctttttgaatcataggaatgaaaaaacagaggagtagaaaaaacataagattcagataggaatacaagtgtaaaacagaggattgtaaaacacaggaaaaatataggaatgaccgtttgattgagtcgtaggaaaaacacaggaatttgaggagagataaagactcaaagtattcttaacatgaggtagaacctcatgctaaattttctccaaacttgcatgggaagtggcattccatagaaattttatgggattacatatgattcatttctttaattcaaagggctatataggaaaaattcctataggaatgaaatcctttaaaattcctatgaatttcctttgggagcggattctaatccctcgaggggatatcccatcgtatatctttttcttttaaattcgatgtaaatagttgtgaaaaattctgaaaaaaattgacaatgtagagtataatgatacctactaatccaccaaaattcaagttcaaattcgatttacacgtcgagaaacaaaaaagacaaatttagatataaacagtacgctactatttatatgctgaatttgtcttttttatattttgacgtgtgagttgagtttggacttaagattttgtggagttgtatatatgtattgtatgaatgttgtcaaatttttctagaatttttcataaccgtttagatggtttttaggtaaacgaggaacatcccctcgaggaattagaatagtttcccatttcctttgaatgaaaggggccttagctagtagtgagctactagtactagttgccatcgagaggtcatcttctccttatctttctcttcttcttctcctctcaattaagatacatgcatcatgtgaaagcctcatgataataccaggtcaagcagggcaacaactttatttctgttgattacaagttagtacaatgcgaactaaagaaaatttaggcattacttattcgagtcaaagcttgcccgtccacgacgccgatagccagtgagcttgacacgcgacctgccattgccactgccaaattttatggcattattcagaaaacttatactatatgctagttgattcagggaatgaaagtagctagactgctcctaattcagagttcagaaagttaagatgaatgggtggtcggttttcaaaaaaaaaaaaagatgaatgggtggtagcttattcagatttcacaaaagggaagagcaattgtggtattttaactcggatcaaccctctgaatgatgctgtcagttactggcactaacggttttacacagaaattaaacaaaagtagaatctataaaggtgaatctgctgtctagtgcagcacataaaacgatatgaggcaatcattttgggggcaaatctgtgaacaagtggttaccaaatcgaccaaaaggtggcagcatgcttctctgtggcatgcttttggctagatcaagttgtgaaattgcgatctcctagctagctttttcttcaaggccaccactgtgtttcaaagatgtagcgagtgatacatggatgggcaagtaacagtatgtgcattatactgaattctactagtaaaaaagtagagagctaagtttcctttgttgaagaggtctgaatgatatgatatctttaacatatcttaacggaacaaatataaattgtgttatgcttaatatcatctggaatatactggcatatgataagcagttcacattacatcatttaaaacgatatccacgggtgatgtttcgacaaagaagaactgcaagcctgcaatgccagcacacatgtcgcaatcttttgtgaattggtggtgtgttttgtcagtcaaagtaggcgcccatacaaatcagtagaaggcaaggcaaagcgatgtgagatttgtttgtccctcccttgcttggttggttgtacatgctgcgaatcgaagaataaatcagtagggatagaagagtacttgtgttcaaagtcaacttgcaagtccttaatctccaagattgatccgcatctccaactaaaccctctcctaatctaatcacggtctaatggcaccatctatggatattccccacaaaccattcagattagttcaagtcaacattaagatgcacgcaacactctcctatttaagagatgtatcctttcttgcttgtccaacgaaacagagtagcacaagaagcagagtgcggctagctcacagtcaccatggggatgctgcggtggggagctcacctcctcctcctcctcctcgccgcggcgacgtggacgtgcgccggcgccggcgccggggtgacgagcgagtaccggcggaagctggaggcgacggtggacatgccgctcgacgccgacgtcttccgcgtgccgccgggctacaatgctccgcagcaggttcagtcttcttcagtctccacaaccacacaacgcgcgaccatctctcatctctttctttgtcatcaggtgcacatcacgctgggggaccagacggggacggcgatgacggtgtcgtgggtgacggcgaacgagctggggagcaacacggtcaggtacgggagctcgccggagaagctggaccgcgcggcggaggggagccacacgaggtacgactacttcaactacacctccggcttcatccaccactgcaccctcaccggcctcacccacgccaccaagtactactacgccatgggcttcgatcacaccgtccgtaccttctccttcaccacgccgcccaagcccgctcccgacgcccccttcaagttcggcctcatcggtgagtaacattacgccatgaattcatcaccatttcgttcgtttcagttcatcatctcatcacatcaatttaaacaagtcattaggagttgtgaacaaagtagatcgatcacatatgcaaacaaaaactggttcgataggatttaggttaggtttagtctcacagtaatccgttgcattcaatgttgaatggtttcttgtcaagtttttgcattaattatatatatcgggagactccaaagtcgctgcaaaccgccctcatcccaacgtcagtcagtgtcattactcaagtctgaatttcctctcgagtactcctacagtaccgtactcaatcaagtaggtcagccgtgttgactatacatgcttcaaagtcatcaaaaaaaccaaaaatgtacgcagctggaattgatgaccatttgactgtgatgatcgtatggtatttgaaaccaatgaagatgtagattacgttaacgcacataaaacaaaaggtcattattatataattaattaaattttaattattataaaattttcaaatggatatatttgacattttaatgcaatttttatatagaaagttttgcatgactatttaatagttttaaatacatgctaacggaaaaaactattaaacattttgtttcgtgtaaaaaatttctacatataggccgtgtttagttcacccccaagtccccaactactctaaactttcaactttccattacatcatatcacatccaaaactttcctacactcataaacttttaattttttttcaggaactaaacacactcataaattgctttaaaatatcaaatatgttcatttgacaaaatagtattagtaggagtactcccctacctcgcagtaaccgtttcagcgtgttactaatgtatgttagttgacttttttggaaaaaaaacaactgtacgagttctgtcaaatgtagtacttagtacaaatacaaacgacgaaggacctgtttagttggcaaaaaaaaatctctacatgtcacatcagaacatcggatatacggacatatattttattaaacatagtctaataataaaataaattatagattctgtcagaaaactgcgacatgaatttatcaagcctaattaacatgtcattcgtaaatgtttactgtagcaccacattgtcaaatcatgacgcgattaggcttaaaagattcgtctcataatttcctgccgaactgtgatattggtttttttttatatttaatactctttatatgtgtccaaacatttaaaaaaaattgtttggaactaaacaggccctaaaataatgaaatgaaatggatgagtgcacgcaggtgaccctcggcagacgttcgactcgaacagcacgctggcgcactacgaggccaacggcggcgacgccgtcctcttcgtcggcgaccttttctacgccgacaactaccctctccacgacaacaaccggtgggacacgtgggcgcgcttcgtcgagcgcagcgtccgtaccagccatggatctggaccgccggcaaccacgagctggactacgcgccggagctgggcgagacggtccccttaagcccttcacccaccggtacccgacgccgtaccgcgccgccggcagcacggagccgttctggtactccgtcaagatcgcctccgcgcacgttatcgtgctggcctgctacttcggctacggcaagtacacgccgcagtggacatggctgcaggaggagctcgccacccgcgtcgaccgcaagctcaccccgtggctcatcgtgctcatgcactcgccgtggtacaacagcaacaactaccactacatggagggggagacgatgcgcgtccagttctagcggtggctcgtcgacgccaaggtggacgtggtgctcgccggcacgtccactcgtacgagcgcagccggaggttcgcgaacatcgactacaacatcgtgaacggcaaggcgacgccggcggcgaacgtgaacgcgccggtgtacatcacgatcggcgacggggggaacatcgaggggatcgccaacaacttcacggtgccgcagccggcctactcggcgttccgggaggccagcttcggccacgccacgctggagatcaagaaccggacgcacgcgcactacgcgtggcaccgcaaccacgacggcgccaaggccgtcgccgacgccgtctggctcaccaaccgctactggatgcccaccaacgacgatgtataattattaatcgactccaaccatctcaaacttcttaatttgtatcactgctatgctattgccattcttcttcttctttagctttggataataaatactcctactatgcaataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttttaaatcttgacttgaatcaaatcttaacttttaaaaaaataaatctcaagttgaaagttttcaaaattgagttgaaagcttttaaaatctcgagttgaaagttttcaaaccctaattgaaagttttttaaatttgagatgaaaagttgaaagttttcaaattttaacttcaaaattttgttttcaatctgttacttaaaaaaaatcttccaaaaaaagaaaaaaattatcttaattaccatcgtgatctaaaactaacatgttagttacgttagatatactcgtcttagggaaaaaaccacggaaaaaatccaccggtatacgcgataataaaaccacagagaaaatagaactccggaaaaaaaataaatctactgtggtgaagaaagggaaaaaagaaaacccacccccaggctacgtgcgtgttgccggtgtgcacgcgccaagcggcaatccctgcaactgcaactagtggaattcgagaaacgcgggaaggttgttgatggatgaatcgttcattccatccatcgtattcgtgaatgccgttgcatgatccagtgcgtgacccgattatcgtgaaaaaaatgcagcatgcatgcccctcctctccaactgatcgatgtggacttggactaatctatttgctgctcctccgtcaagtggcaatccctgcaactagctaagctagtggaattcgagaaatgcgggaaggttgttgatgaatgccgttgcatgcgtgcgtgatcgatcccgattatcgtggaaaaaatgcaccatctgcactatatatatactcactcctcatctagaacacaacaaattcattagattagattagatcatccatggtaatggaggcggcgtgcgtgctcgccgtggtggtggtggtgatggcgttcttgtccccggcggcgcgcggcggcgtcacgagcacgtaccggaggagcctgcaggcgctcccagacatgccgatcgacgccgacgtgttccggccgccgcccgggttcaacgcgccggagcaggtccacatcacgctgggcgaccagaccggccgcgccatgaccgtctcctgggtgacgccgaagctccccgacagcaacgtcgtccgctacgggcttcgcgccgacaacctcacccacaccgccaatggcaccttccggcgctactccttcgggcgcaagtaccggtcgggattcatacaccacgccaccctcaccggcctcgactacggcaccaagtaccactacgccgtcggctccggcgacaccgccagcgccaggtccttctccttcacgacgccgcccaagcccgggcccgacgtgccgtacaagttcgggctcatcggcgacctcgggcagacgttccactccaacgacacgctgagccactacgaggcgtgcggcggcgacgcggtgctgttcatcggcgacctgtcgtacgcggacaaccacccggggcacgacaacaaccggtgggacacgtgggcgcggttcgtggagcggagcgtggcgtaccagccgtggatctggacgacggggaaccacgagctggacttcgcgccggagctgggggagacgacgccgttcaagccgttcacgaacaggtacccgacgccgttcggggcgtcggggagcacgcggccgctgtggtactcggtgaggatggcgtcggcgcacgtgatcgtgctggcgtcgtacgcggcgtacggcaagtacacgccgcagtggaggtggctggagggggagctgaggcgcgtggacagggcggtgacgccatggctgatcgtgtgcgtgcactcgccgtggtacagcagcaacggataccactacatggagggggagtcgatgcgcgtggagttcgagcggtggctcgtcgacgccaaggccgacgtggtgctcgccgggcacgtccactcgtacgagcggacgcggcgggtgtcgaacgtggcgtacgacatcgccaacgggatggcgacgccggtgttcaaccggtcggcgccggtgtacatcaacatcggcgacggggggaacatcgaggggctcgccgacgacttccggtggccgcagccggactactcggtgttccgggaggccagcttcggccacgccacgctgcagatcgtcaaccggacgcacgccttctacgagtggcaccgcaacagcgacggcgtcaaggtcgtcgccgaccatgcctggttcaccaaccgatactggtttcccaccgacaccaactagctacccttaatttcctacggcctacttcctctgtcacgtaaaaaaccaatctagtataggatacggcctactttctctgtcacgtaaaaaaccaaatcagtataggatatgatacattctaaaccaatctagtataggatacggcctactttctctgtcacgtaaaaaaccaaatcagtataggatatgatacattcaccaaatcagtataggatatgatacattctagtactccgaatatagatatacatctattcagattcatcgtattagaatatgtcgcatccgattttagattcgttttctgtggacggagaaaatacctgcttaattttttctttattactagtacttttctttttctagatttcgacctgaattctatttagtacgaatgcatcaacagcaaaacagattagcacactagagagggagatggattaataaaatcattcggttctgtttggagtttgctagtataatatattcttggttctgtttggagtttgctataatatattctttcttgacgaattatctccattcgtaagcgtgcgttatcctcgcctcaactaatattggaattacagttcttctgtccagaatagtagcttggctatccctttgtcttttgctctgccgaataaaacagcaactgcagttgttacacaatttttctaaaaaaatcttagtccaaattccgaaacaattcattctactacttgggacctgggagtggaaaagcagttctgactgaataattcatacgcgtgataaattgggatattgagagccgtatagcgaatcagaattttgatataacgtactgaatgaacaagaatgacctctgtattgggcatatccgcatatggcaatttgtcgaccatcatggaacagtttgatcaagttgatggcatgcgtttttagagaaagttgatgcaatgcactggaaatgtaatgttgtactccaaacagaattgggcaagccctgatatgctattccgccctttgcacacaattcggccatgatagtatgccttgatggtgactcctatatatgcaaagttcatctcttttgttttctaatagtccccttcactgtttttttttctgtcgtcctatatatgcaaagtcctttttttttcttacctcttaattaccaaaatccaaaaaaaggaactaattgaggtttctttctatacaaatttgacatccaaaccatctactttgattttgactattttcaagagatgtaaatttttttttcacaccagttaaagaatagctgcacaaatttatttggtttcaagatttgctatttgacattcgaggatgctcagctgacttcttttgactataagggctgtaaatgcaacatatattgtaggagattcctgttccgcgcatacgcgccgccaaacgaaatcgtgcgcacgcggtttcaataccatttgctataggacttcttttattttctgggagatgcgcacatctaacgtaactaagcttgctagctagtttagatgtaattaaggtgacattttcctttttctcgaaaggtttttttttactaacagaatgaaggaaatctatacgtgtaagaaactttcaaataaaatttagaactttctattaaaaagttaaaagccatatacctaataaattttacaaatttcaacttacaatttaaaactctaaactcaaattttgaaaaatttaaactcgaaatttgaactttcaagttaaaatttgaaaaacttttaactcaaaatttaaactttaaagtcaaattttgaaaactttcaactctataattgaaactttcttcagattggaaaactttcaagttaagatttgaaaacttttacctaaaaatttgaaaacatgtgtgctaacaataaaaaaaaatcagaaaaagggggaaaaaaagaaaacgcgcgaggagaggcaccaaaatagggaaaaagatagcgagaagaaaaagaaaatgcgtgcgtggggtgccagctgacgtgcgcaccagatagcaacccccatattgtatgttttagatacaaaagaaggcatcaaattcactatatagatgaaaaagaagatctaaatcattttaatcatggtacagatctactgataatatagttatatatataaaatgtaactaatttctatatgttgttgtaacacgagttatacatcaaatccatgaattgcattacccgaggttattttctagacactaataacagtaatatagagaaatacaatagtctttgctaaatagtatcatattggctccgttcaacagcaaattctttttactgtactgcggccaacaaaaacattgttttgtatttgtagttgcggcagcacaacggccgaacagacccattactagcaggattttagacgtggtttcatgagagatagatgacacgtcagaagccagagcgaattggattctttgtaaaagagaaactagaaaatgatgcaaagaataataataataatgcaaaaggaaaaaaaaagaaagaaaaggtagccgacccgacgtaaaagagaaggcgaatagccgaccgagcccgagcgcccttcctcccctcttcttctccttcgactttgttcgactcccctccttcccggcagaggagaggagaggagaggagaggactcatccatcatcatcaatcaacgccatgacgagctcctcatctccttcccgaaaggtattattctactccttcctctctctccccaatccgtctgattctcgctatctgtgaacgttttggtctaatttccccccctttttttttgtacctgcgcgcaggcgctgagcaagatcgcttgcaatcggctgcagaaggagctcgccgagtggcaggtcagccctccctccgggttcaagtacagggtctccgataacctccaaaggtcgtcatcttgtcttctactggttgatttcttgtttcttctcctgtggatgaaccgcgggatcccatcttacaattgattccttttcttttcttgactgtatatgttcttgattttggggatttttggtgggtttttattattagtattgttgttaatctgtggagatggattcgtacgattcgcctaataggtgggtaatcgaggtcaccggagcggcgggcacgctctacgccggcgagacataccagctgcaggtcgacttccctgagcattatcccatggaggcgcctcaggtgagctttcttttcacaacagattactttctcatatagaaacctttaattaatcctttcgtttcttctcatctgttccctgcattcgatttggttgcaaactaatttaactctttcattccaggtcatttttctcaacccggcgccgatgcatccacacatttacagcaacgggcacatctgtttaggtaaagttgttccttatcatctcaaaaataaaataaaataagttgttcctcatgtcggcctcttctctctagcagatatttgtttaggcttccatgttgattaactgcatgttgtatgagaatgttctttgcctaacctgatgttctatctagctgtcagttaggtgctaagattccatctgttaggggaaagccaccacctttgccaagtgtgcttttccacttcctagagtagctgtacaattgagatgccccgacttaacttttcattctatttctcttttactatgttagtagacaatcttgatgggatcacgaaattcacgaccttgttgtaaacattgtttcttgcttctgctttctaagttttcttattatctagatattggaggtttgtcttgtttcctcgctattaatacagctgtcaccagtgcttctacttctatgattgttagccatcagagggaagctttaaaattatgtagtttatttggtactgaatcctgagtgataacacctttgcttcttttcttgtcctcaattctccttccacctctgaaatttgatctatataagctgtttacgtaacttcttatcacccttttgtcttcttgtacaattagctacgagtctaatggtatgatagcacatatgtacagccttcctttttggttcctttcagagtggcatgcatttgctttttttggtaattcgttctagtaagtatttcttgtttaaatcttatcttgtgtagtgatcacacagagttgcagttgtgcttgaaaggctttgatttgtgatgcagagaatacaaacaagatttatacttctatctgttatttcttttgcctgatatatatatatttcttgattctagttgagtgccaaagttagtaaaaatataatactaatgggaattaaaacattccttaccttgaactgtttgaagggagttaggatgcatgtcagttaggttcgtgtctgggtggtcgagggtgttttcttaaatgtcctggaaaggtaatgaggattagacatctatacagtagtacaaactaggatgatagcatgcttctattcatattttaaactattgtgcaaatataatgttggccctcatgtttccaatataaccttgccatttccactttactaaaatagctgcaaatgcattggaacaatagattgttatagtttggcagcttatgaagtgagacacttaaaagtagatgtgctgaaaagtttgttctttcatcattgcccttcacatggaaacatatggtatccgtgtcttgtctctgttggatgcataaattatgttaaatggtcaaatcacaacaacttaaagcaaacaagctattgtataattagttgttgccaaatttgagctgttttcagtagacttgtctacctgtatgcaataacatagcacttatatcctttggcaaacggaggtagtcaaatctattttttgtcccccaagactcggcgacatgctttcatgttttaagttatatatacaacaattagcatcttgaatctgttacttcgactatctaactagtctagatgagctgcttgagccaaagggttgttaattttggagcaactttactgctcagctggtagttgagtgtgtgtagtattgaatttgagtaacttggatcactgattctgaaatacagtgcagcagcagctgaaaatcattcattcaggaaaatatgtttctgagacaccttaatctctgactcgtgatttcatctttgagcatttgatctgtccttttttttttaatgttccttctccatagaaacaggactacttcttgatccttgtaatgatgatttctctgtgattgtgaaccaaaagagagatgagatacagtttttatgcataaatataatggccattaagaataacagcttgctgctggtcatatatctgcagatatactgtatgattcttggtcacctgcaatgactgtcagttcggtctgcatcagcattttgtcaatgttgtcaagttcaccagcaaaggttattatatataactaacacccttcccattttctttcgctgaccaaaaacattaaaaggtatcttgctataatgtggtgtttgcagcaacgccctcaagacaatgaccgctatgttaggaattgccgcaatgggaggtcgccgaaggagaccagatggtggttccatgatgacaaagtgtaagaggaactagttggcacttttgccattcagtaatcgtaataccttgaaatctcttgcaaggggaaaatgagatgaatgtaggcttactgttaagcatcactctattggaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4738 - DNA, 13854 bp, Oryza sativa
ccttgctcataacaaaccggagatagagcggagggtccatgctgtgattgacaaatttgcagaacgtggacttagatcgcttgctgtagcataccaggtgagaagggttacagtacaccatctatcataacctgattttcactgtgcagcagcgatggtatcatttcatgaacaggtttaaagtaattgtagattttagtaactaccaagtcttgtccatgcaaaccatgactttcctctttcactgtttactgcgtacgttatcttagtggtgtgttactctgttgttgaatgtaggaagtaccagaggggacgaaagaaagccctggtggcccatggcattttgttggtctcatgccactttttgatcctccaaggcacgacagtgctgaaacaattcggcgggcacttaatcttggtgtcaatgtcaagatgatcacaggtgcatgctcaaatattctgtattgtcagttttttttcaggcttatgcaggaatacagaattctggagactcgatttatacaatcaactttaaacaaaaaaaagaaaaggaaaataggattcacatgagaaccaaatagtacaatgtaagaacatggtcgtgagcacccagacctcaccaggaaattctgttctgctgttagctggccagatttttcaaccctagttctgtgctttccatgggatgatccaaattatccgtttgtctgtttggtcactttatttttacagtgaacatggttttgatgcagtcctattgataaatagaacataactcagattaaaaatagtatatttcctggaggtagccgttttcattacattcaaaagactgctatttgcgttcttttgtcctagtttattaattggtctcctaatgttcaggtgatcagctggcaattggaaaagaaacagggcgtcgcctgggaatgggtacaaacatgtacccttcatccgctttgctgggacagaacaaggatgagtccattgccgctttaccagttgatgatctcattgagaaagctgatggctttgctggtgtattcccaggtatggtgataaggagttattacactgcaaagattgagagttgggaaagatgaattgtttaattctaagttaactgagtgaatggcttttgtccagagcacaagtatgagattgtgaaacgtctgcaagcaagaaagcacatatgtggaatgactggtgatggtgtcaatgatgctccagccctaaagaaagctgacattggtattgctgttgctgatgcaactgatgcagccaggagtgcttcagatattgtgctcacagaacctggtcttagtgtgatcatcagtgctgtgcttacaagtcgtgcaattttccagcgtatgaagaactacactgtatgttaaagcggaatagtgttcaagtactcttttatatgtttattcccctaatttatctttctaatgcattttcatgttggcagatctatgctgtctcaatcaccattcgtatagtggtatgtttatcttgcttttacttctgaatgaaaacttttatatccatgcattttttaattatgtgatttaatgtgttggtatcaagctgcatcaagtctctgtatttatttatttatttgaacaattatccttgatgcgactgctagggattatttttttatgttattcagatcaagttacaaatactacgagatttcaatccataactgtccgctatgatatatatccatcttgaacactgaattgtgccagtgttctctatttgtgttacttctgagggattaattcactttgttaatttcaacagcttggatttatgctacttgcgctcatctggaaattcgatttccccccttttatggtcctaatcatagcaattctaaatgatggtaaatctctctctctctcacacacacacaccggcacacaaccactgcacatgttcacacttgctttttgacaatagaaattatgagcatataaagatattcaactatgtactgtgatcgataggtaccatcatgactatatcaaaggatcgggtaaaaccatctccactacctgacagctggaagctggctgagatttttacaactggagttgtcctcggtggatacttggcaatgatgacagtaatcttcttctgggctgcatataagacagactttttcccggtaaggagcactgtgttgagacttgagacatttgtttgtgatgatttttaagccagctatgcaagtattcttggctactaacgatggttaaattgttagtgaactacttttaggaccttatttgctttactcgctgaagcttattgtttataaaatttcagagaatatttcatgttgaaagccttgagaagacagctcaagatgatttccaaaaacttgcctctgctgtttaccttcaagttagcaccatcagccaagctctcatctttgtcacaaggtcccgcagctggtcatttgttgagcgccctggatttctgctggtctttgctttcttggttgcacagctggtctgctcctactctctcactgtctccctcttatattttgcttcaggagttaaagccgcattgacgtaaacttttggtttaaacaaatacagattgctacactgattgctgtgtatgctgactgggcgttcacctcaatcaaaggcattgggtggggttgggctggtattgtgtggctctacaatctaatcttctacttcccactcgacattatcaagttcctcatcagatatgctttgagtgggaaagcatgggatcttgtcattgagcaaagggtaattaataatgcatgctacacaactgtcttggcccctcacacctattaagtttctgattctcactaatgtttgtctacctgcagatcgctttcacaaggaagaaggactttggtaaggaggagagggagctcaagtgggcacatgctcagaggaccctccatggactgcagccgcctgatgccaagatgttctcggagaaggctggctacaatgagctcaatcagatggctgaagaggcgaagaggagggcggagattgccaggtaggaggaccacactacacttgcaaaacatcatgctttcttgcgtatacgatttcttggatcctttagtattgttccacctgtccctttctccatcagtgcattgttactcatgaatccatttttgaatatgaaaagtagtatctttttttggcgccaataggcaggcaacagttacattgaacatataagttggttgataacgatgtgaagctaactttgggatgatttgttacaggcttagggagctccatacgctcaaggggcatgtagaatcggttgtgaagctcaaaggcctcgacattgagaccatccagcagtcttacaccgtgtgatccagcctgtccataaagaaagaaaaaagaggattattttttttccagattttcctgtttcgctttaacttgactgcaattctgcaatcacctacgtgtacttgaaccgaattgctgtaatctttgtccctcctgctccagctttctactacatggtagtgttatataatttttggtcacctgaaaatatataagtgtttgaggtgaagcacaatggcaatgccagagtttttttgctcggttactgagaagcatgttttcataatcaatcggtcaattgtatggacatattatagatgaatttggtaactgtttgtgtgggggcagctggcagtatgtaacatgtgggcttcaatgtatccaaccaagaggcaatgaatgaatgaatgaatagcggtgactctggtcctggactggaaacggatctgtttgttgttgggttccagccagatctgtagtgaggctctggctggctgatattgttgtctgccatgttgcctgtcaagtttgcaaaaactgtgggcacatcacatgagatgagttgagagcttttattttctaagctgcttgctgcgttgcatgcaggatctcgaatgatgcacgcttgcttgagctgtgcctgtaccaaatgtatgtagtactagattgtgtatgtactatgtattctccagctgccgtactgtgcacggataattggtttgtctcgtctggtctggtaaatagagaagtccaagtgttcaattcacagaatcttgttttgtagcaaaagtaatcaaatgtcatgagatttttcctttttcttgaataacaaatgtccgtcctagggacaatgtcacatcagtttggtatatgtagaagtgtagtaagaatcaatagattacagcacattcagaaacggtgatcccaacttaaaagaaggccacggcccacggcccacgacccactgaaatggcaaagcccaaagaggaccaaagaggcccaaataaagatgaggcccagaagcagaagcaaacaccatggttagctcagctggaggagagccaacaagcaaaaatgccgcagtggccgtcactccagctgcccgccgccgccgccgcccgccgcgccactcccttcgccttgtgcaggagctcgtcgtcctccgtttctgcgtcagcgtccaaccaggacctggtagcgtgttcttggcaaaaggaggatgaggccgaggcgcagtcgttggtggtggtgggcggaggcgccgccggggtgtacgcctccataagggccaagtccctggctccccacctcaacgtcctagtcttcgacaaaggaaggttcttgtccaaggtatagaaattctctttgtttgttttaatttctattttccatcaggcactacttcctttccaccgaatatatcattgttactgttgatttgttgccacttccgacgaggctgctgtaggtcaagatttctggtggtggccgatgcaatgtcaccaacgggcatcatctggagccattggtttgttcttgtccacactggatgcatatgctctatcctatcgtctcctttgttcactttcactgtaacagactgacagttgaattcttgttcaggggatggcaagaaattatcctaggggacacaaagaactcagaggatcgttcttcaaaaatcatggccctcaggatactatgcgttggttctcagatcatggtgtcgagcttaaggtatcatagtcatgacaccaagattattaaataaatcttttacatccattgatcatctattagtctgaacccacccggtcaagttattgatgtcgtggctgtttctattggttcgatttcatatcagacagaagatgatggtagagttttccctgtcactgacaattctgcatcgatagtagattgcctactgaatgaagcaaggcgacttggaggtatcttgtcctaattgactctgttgtttattcatttgtcatctgaaatttaaacaacaatcgaatggaagtttccctgcaggctggtaaagctgtgactggtgcatctgtcactgaaaatgggaagtttgttgtgaaggttgagaagcgtaccgttgattttgtggatcatgtaaacgctaaatatgtcttagttgctacagggagcagccagcaggtttgagaaaagatgtttggctcctcccttcttgttattgatgtataatacagcataaagttctcctcctttacatttttcttacctgcagggttattcaattgctgcacaatttggtcactctattattgctccagtgcccagccttttcacatttaaaattacagacaagcgattggctgacctctctggggtatttatccatgaatacctttgtggctcttatgttatgaagtagcaaccaagacttgtaaatctcgttttcatcactgttatgcttttgacaacaaaacaatcatgtattgcatatgaagagtctggagttaacatgtttttgtgtgcttccatggtctggtctaggttccatccgagtttaagcatctcatgtgcatatgtatcctgttttctgtctgatatctagtggaaatcacaaatcaagtggaagcatggaaaccctttcagaattcacgttagcttgctgcctcaatggatttttcatgtttctgtctgtgcttttcactagaattgcagtaaacattactatgaaacttaaaacacctctgagtttgctcctaaaaggaggaaagctgatattgtagattttttttttcaagtcaattggacaagagctattcaccccattatctcctgccatgtaggtcacattcccaatagtcaaagcaaaactgaagctagacggcattaagagaagtgctcctgaattaactcaggtgaacatgtcaacattcaattgtttcatagatgtttgcttacattaactgcttggtctttacagattggacctatgttagttacacactgggggcttagtgggcctgttgttcttcgtttgtccgcatggggagcacgtgaactgcatcagtacaactaccaaggtaagatgcaatggaactatgcaggaattgcactacattcgcagcctactggtaaatggcaacacaattttacttgccatgtctgtctgtttccgtacttgcacaagttgcattcagtagatccacaacagagcctttttcttatcagattgctgttttgctgggcatccttatgaggtcacttctatgtagaatgctaaagtcgctgagttattattcaatgagttacgcatggttgcaagtttcataacaaatgagactactggtatctcatattaggaatctttatgctgtcagtggatttggacaaacttaccttcatttgaaacacttctcttgctgtttgttctcttggatcatatgattcttcgatgtattgttctaacaaacagtaaacagctaaagaatggtctctccaccttctgagccaattagctttactgtttgactctttggcagctgcattgagaatttttatgtttcatcaagtatctgaaattttccactatgataatattttacaattatatgtaagacagaagtaaatgtctatattatccacttcactgatacccatacatttcttccaacacagcaaagctcaccgttgacttcatacccgacattcatattgaggacgtgaagcgcatccttttcctgcacaaagatcaccatgcggttcatttctcactcttgtgctattccctttacatgttctattttttttttataatctccttcacgcattcatctaaggatctgaatttctgatgactaacattacacttgattgtccttgctttaataattcagaacgtgtgtactaaaaatagacacgtgtacaaatctctgttctatttgacatattggggtgttttaatcaagactttagatggattctgtaatctgttgcagaaatattccttgtgttcctgtgaatgttctaattgctgaataaaaaaattgcaatgatgaagttgaattaacaagttttagtccttgcagaagcacaaaataaacaactcttttcccatggagttcgctctggtgaagagattttggaaattcttgctagaacaggaggtcataatattactgcggtgctctttactcattcctctattttaattgatggtttcatcactaaaatcttctcgcgcagagtttagatggtgatatgcactgggcgtccataccaaataataatctaaacacagtagcccttaggttaaagcaatggatgtttgaggttgtcgctaaggtatgtgatatcttaatataccaattgaaaacataatgagcgcaatcatttaggtaagaatattttttgtctgtccaaactcacagactgttatctcatcatcatttgtagggtcaattcaaagatgaatttgtcaccgccggaggtgttccactttcagaggttattagtcttaattggttgcagttttcatcaaaactgaatcaacttgcatatatatatgtctaatttgctgccctgttctaaagatatcgctgagcactatggaaagcaagaaacagcccaacctgttttttgcaggagaggtatacatttgttcctgaacttgcaacactctggatcagcaagagaacaattgaccttagcatgaccgtggtgcaggtacttaatgttgatggggtcactggcggattcaattttcaggtacgcattacaagttcccttaaagaatttcacctattttaaaagatcgaactgttcattagagacttggagatctttacatacgacaaagcaaatttcaatctcatcgatcaagtatagcacttgaaataatagaatattattttgattaaaaatgtttcacttattttcaagtagaaaacatggtttgtaactataatctattctacattctccacagaatgcatggaccggtgggtatatagctgggacaagcataggaacattggcatcaagcaacatgaggcagcaacagccatatttgcaactggacggatcatgaagtatcacactgcaaaaaggactcctgcctgttcttactactgaagactaacattgacaaatgacattgtagatgtacatagaggtcaatgatcgattgtagagatgtacccgtgaaacaatctcttgttattagttagcaaacaagttcagaagtagtggattgtgtactctgcacagctgtgagcaaatctagttgtcatttctccaacataaaatcagatataaagttacactcaaggttatctgttggcagtagcagctaacgagtcattcaagctcccagaaaaggttggaacagcaatggacgtgctggaacacgaaatgattctaattggctatcaattaagacaggataatctcacttaaaatgcaccaatgccatctctaaatgttatcacaaataagaggtttcaaagcataaggaatcaaagagaactacaacttagactacagaccaatctagacagatgcaccagatcatcattcttcccccaaaactgcaccctgtttagatgagtcccttatttctgactggaataacctcactagtcactagagtctctagagcagatgcatgcgctcaacataaggattgtgcagccacctattcagtggctccccacatccaacgaagcatccagtattgcctcgcgtggtgacgaacgggaattcgaagagatgtagcagcttctgaactgactgtctaaccaaggaagacccggttaccctgctcctcctgccccagccagtgacaatgtcaattctttcagggcatttgcccattgtcagaatctgcctgtggaaccaagccagtgtccttgacagcgcagtcactgcagtgccctccgacatcaggtgtaagttgatgagccaatatgatgggtccttctccctcacagaatccgggtacacattcctctgggcagcaacctcccatatgaagccagcctcctccttgaggccggacttgtgtaggaaatctatgacagcatccattaaaccccttttactctctctgtcctcactgtgcatcatgtccaagaaatatctggtgtgatccctcacattctggccgccaggttctgcatcgggcaaatataacaagaacatgtgggcagggtgtccagtgatcgccatgagctggcagcataaacccatctgtgcttgagcctcagtacaacaactgagcagcaaggtgtaggtctgcaaagatggaacgagcccctgagcaagcatgttttggagcacgctgtaggcatcttggaacctgtttatcttaagaaaagcactcagtagggaattgcaggtcggcacattgggctgcaaaccatcctgaagcattgcatgataccatcctagtgccttgtcaacattgccagctttgccccagaggtccaccaaaagaccatatacaggctcatcaggagcccagtcatgcctcatctcaatgaacacagcctcagcctcatccagatgaccacaatgaccaagaacttccatgacaatactgtatgttattttgtcaggacgaaacccggcaacctgcatgtccttgtacagcttcacaacattttcataatttcttgctttggcctgaagagcaatcattatgttgtatgtaactaggttaggtgtgcagccattttcaaccatctcacagaaaagcttataagcagctgccaggtgaccaccttttccaaggcaattaaccatggcactgtacgtgaaagtatctggtgacagccctacttcttgcatcctggtatataaatccattgcaaattccaggtatccacctttagcatggatatcaatcaatgtacaatatgtaacccgatctggctcataaccggctttctgcatctcctcgaatactttaacagcctctcttagataatttgcacgaccatatgcatgtattattctgttgtatgttacaacagttggtttgcagtgaacactgttcatctcatcaagaagtttcctcatcgtaccaaattgcctggcttgtccaaggatgcctatcatggttgtgtagctatgaccatcatgcttgaaacctggttgccgctttaaccactggaagaaaccaagtgcaatggtgtggtcatgaagcagcttgagtacttggtttgcctggaatgcatctatcttgcaatggagattatccagaacgtgttccgtcataggaccccatttcatttgctgcagtgtatggtagtactgttcaactgagcgcaatgacttcaatgatcttaagttagactgaggtcctccaccatgactctttattgttcccgcaagggcctgagatttgtgaccagaccagtatacatagcttgagctgacaagttttgggtttgaacttcatcccacctagcatctgtactgaaattgttagaatgataatttgtgtggcgctgaccaggatgtctttgattctttatttgcgatggtgaattagcaaccatagcaggaggtcctgaaaaactctggtttgattttgcatagccagatcttgatacacccttcccaagattattttgcacggaaggattataaggcatctttgcctcaggaagactatgctggttgtgtgacttgatattagaaggctgggcatccgacaagggctggtaagaatagctagtggccatctgtgaagcttgattggtgcctccattatttgatgtggacttgaggtttactaactcagtgtacacaccagctcctgcaattgcagaatgagaaatgcttctggcggtctgcttagaaggctgtacataatcatttcctagcacctgaggagttcgagggtggttgctagtgttgccagatgctggctctgtctcttgagatgagttggaaggaacaatatgaacagctggagcagggtaaccagtggcccgaccaatggatccaacaacatgttgtacagatggagtttgagcctttacagagggtctgcgagttgaatgaaacttctgctcgataccattagccgtctgcctttttggagcagaagtttcatcttcagggcatgtgcatgaagctccatcagtgctaccacaccttgacccattaacgtagaaggaccgtgcacactgggttagcgtgccgagttgctttgccctcaacatgaactgcaatattaagttcacacgatgttatcagctagaacaacctttatgttatgaatacatcatacatgagaggttctgcttgtgatgatgaagacagtataaaagatatatttgatgttgctttgtggccttgtgctcattttatatatatacccataactctttcctattatttctaaagataaaacaacaatgatgtgtattatgaagcatgttagtaacatatatacgaatagaaatgggtgtgcaggtgtcaactggaagaattgatggctatgatggctcatgctttagtttgtaacctaagttcatgtacaagcaagtctattaatgtgagaaaacacagtcaatgatataaggaggaagggacatactggttagttggttaataaatcaagctagaacttttgataatgtcagtgcgaacttctagcctccactgaactccatatggcccctcactggtaaacctgaaacaaaaatagagccaataaatatatgctgcttacaaagtattttgtttagctgtactaaccagtacgaagaagaaaaagaagaactcattcagaatactagatatgtataacaaagggggattctaagtgttaacttctgggcaactacacctatctaggcttattgatccaatctacataactggtgagtaaaatccaacgatcaaccttataggcactagttacaactgcaaagtagtaataataaagttaaatgatatgctcagaacgttcagttcgtcgaaaagccattatcttcttttggaaaaaaatgtcttttaaggcgcgcagaagcagcatgtcaaacagaaaggcagaaacaggattacagatgaagccaaacagattaatgtgcggcaactaagatgaaagaagcagcttggtgaacaatccaaaaattcgttgaagctttaggtctgcaagacgagatttttttgtttacagggaggcaattagggttgagttttctgagccacagcatgtcctttcctatcagaatcagagcattcaaaatttataattgggggctagattctacacagaactttattggattgaatttattacatcacattacaggataataattccaaaacaaaagaaagaaacccttgtttggcattgaagcagaagaagaggtaaaaggtgtccttaattaggataggctaaaataatcatccggtggcgaaaaggaaggaagggcctttgctgcgcaaaatccaaaatttgaccatggattgaggagcacgcgggcgttggggatagggcttggagaaggcatacctcgaatcgggtaccggagacggaggaacgaccgaaggggcctctttggtcgttccagccggcgggggcgcgctctcggttccaacgccagccgcgccacccagcaatcgcacggcgggagacccagctggacggcggcggtgttcggcaacccctcttctgcctcttcctcgtcctttctactaggagtagtacctagctagtagtactaggttccaaggagacatggagagcaaaggaggagcggcgtgaggaggaggagcaacaacaacgaagaagaagaaagatgcgatgcgatgcgatcccgtgtccctccctcccggagacgcggcagcggcggcgcacgggtggggtgggtggggattggggatgttccgtggcttgcgggagaatccaatcctccttcagagccagaggaaagagagcaaaccttttctctcagactcctggaacttgtcacgcaagaataataatctcaaccaatctaatctgttgttccgatttctgaatctttcattattagtatctttttattcaaaacaataaatactacagtttatcgggtttgaccgagtttagttaacaatcctgccgttagttcctcctcctaacccatttggatttggtgtttgttcgggtggattaaacctacaactactactccatataagatattttcttcttcttataagaagccgccccccctcccccacaccactaaattcatccaaaactaaacaatcctttcttcatattgcattttctttgactacatcagatattttattgaggttatacttcgtccgtttctaaatatttaacggccttgattttttaaaatatatttaaccattcgtcttattaaaaaatttaagtaattattaattcttttcctatcatttaattcattgttaaatatatttttatgtatgtatatagttttacatattttacataagt

SEQ ID NO: 4739 - DNA, 9235 bp, Oryza sativa
ataagagtagcaactagtatcaattaaggccgagtttagtttcaaactttttcttcaaacttccagtttttctatcacatcaaaacttttctacggctgtgtttagttcagcgcaaagtttagattttggttaaaattgaagatgatgtgactgaaaagttgtgtgtgtatgacaggttgatgtgatggaaaaggattgaagtttggatccaaactttggatctaaacacagcctacacacataaactttcaacttttccgtcacatcattccaatttcaatcaaacttttaattttagcgtgaactaaacacaccctaagatagtagagatggattctgatctagctttagttatcctagctcagcgaatccaaagataaaacagaaacagggaaaaggtaaagaaaatctaaaaatttgtgtgtacgtgtgtttttgtctgatgtgtgtcctgctttggccaagaggaaacacgcggctcacaatcatccaaatgttaagatcgatacacaaacaaaattaaaataagcagaaaaatgtatgcacatcaggagctcgtgaattgattgatcaataaatcaactaaaagatgaaagtacagacagttgtaaaaaatgacaggaggacaatgacatctatcactccaaaaatcattcaaacctgacatatacattgagaagaaaaaagaacagcatacaaatagtatcgacctaagatttttgtgaattgctatatgaatgctgtcaaacttttaaatactttttataactatttcgaacaacaggaacgtctcctaaagaatcaaaacagtttccccctaaaaacacgaggatatatactccctccgtttcacaatgtaagtcattctagcatttcccacattaacatcaatatggatatgggaaatgctagaatgacctataaattgtgaaacggaggaagtaacaactagttgtggcatacgttccttgtcttctcacgtactcccttcgtccaaaaaaacccaacctagtattaaatgggacattttctagtataacgaatcgggacaagcttctgtccagatttattttattagaaagcattccattcaatcttagattggttttttttaaggagggagtactcgcgagtgtgtccgctagcaatcaccatcaccactgcactaaaggcggcatacacatcacatctaaacacatcaataatttaattttattattccctaaaaaaaatgtgggcaaactgtgacacgtagagtaatgtaccaccacaccaccaaagcttccttcctagcttcccaggtgtatatcgtgtattgtattgtgatcaaaagtaaacacttaattaattatgtcagtttcaatttcatttgacactcatataagcagatagctaggtggttattcaagtgatcggcgttaattgtacacgttgatatcgatcttgatcgataatgattgttccacctaatcaattgattaaagtctcgatcgatagttttttttggctttaagtcgacgcgcgcgtcgctatttagcttcgtacatactactgcgtccgtttttggataaataacgacagttgatcttttgaagtatagttggttatttgttttattttttttctaaaaatatgtaattctaataatttgttgtgagttgttttattgaaaacgttaaggctgagttcgcactccctcttcccaacccaactctctcattttccacgcacacgctttccaaattactaaacgacatgtttttttaaaaaaatttctatacaaaagttgctttaaaaatcatattatccattttttaaaaaaattaactaatacttaattaatcacgtgttaaaaaacctctccgttttgcgtgcagaagggatgggttcccgtcctccactcccaaacacaccctaagtatgacttttgtgagcttatgtatttgaaaaaaatgataaaattaacgatgtcatctattacaaaatgcagaatactgcttgtcgacttttgatgtcgcgattccggtatttgcatagtatggggatcgttggtactaggatatatgcgagactgaggtaaaagagatggagacaaggatttttatacaggttcaggcccctgaattgtcaggtaataaccctacatcctgttggccgaagccggtcgttgctcttattcatcataatcacaccagtacaatatttggggtagcctagctaactgttgtcgacatgacaatctaaagttctgactcatagtcgacaatagggtagtcttcctcctcgggtctgtgcccggcgagatcagatatagcgctttcgtctctcctgacagtatccggagacaccataggggactagccgtgcttatccctgaagtcgatatccggcatcttcttgacgtatattggcttgtatgttgatcttctatctcgacctattgttccgtgtatgttgattgtgggtgtccttttcctcatagggggtcttgtatttatacccatagatgtccccttgtccaagtagaactagggaaactaatatggatacaatccgagtagtccttgtcgtttctatgtagaactctattcatccttccttatgcggaactcctcctatatccgaaggttgtttccgtataagacatgatatgtggtgggtcctgccgagatttagtcgactactattaggtatgtggtattcataaccctgacactgctaatagtacatgttgagaggtgggtttgaccagttctgcttcaattcgcgtgaactcatccaatctgcatgccggtttttgcatcttttgtatggagatgcaaatataaactgtggtggtgtttgaatctcatgaagattaagattaagtgttttacgcaaaacgaggtagtaataacgtgtgattaattgagttttaattattacaaacttaaaaaatggattaatctaatattttagaacaactttcatatagaaaattttcgcacgaaatgcaccgtttagcactttgaaaagcgtgctactttaatccaaaatttcatccactcttcactcttttaagtggattcaaacggggccatgtatctaggctgtttggattagggactaaaattttagttcctgtcagatcggatatttgaatactaattaaaagtattaaatatagactaatgataaagccattctaaaaccttagattaatttgcaagacgaatctactgagcataattaatttataattagcatatgtgataatatggaaaacatgtgctaattatagattaattaggctaaaaaaatatctcgtgagttatttatacaattaactttattattaatctatatttaatatttataattaatgtttaaacatccgatattacaggaacattcagactaataatactccatgctccctccgtcctacctcttggttcaacgaatctgtacacgatacgatacattcggacggtgagggaggcgagtggagtgcgtgtcgacgtgtcctactcatccacgccacgtaaccaattccatctccggccgccgccgatggcctcgcgctcccggtggtcggcgctggcggcgagcgcgctcatccagtgcttcgcggggagctcctactgcttcgccgtctactccccggcgctcaaggcctcccagtcctacgaccagtccgccctcgacaaggtcgccttcttcaaggacgtcggcgccaacgccggcatcctctccggcctcctcgccgcatgggcccccgccggccgccgccgcccctggctcgtcctcctcgccggcgccgccctctgcgccgtcggctacctccccatctggctcgccgtcacgggggtcgccccggcgccgctccctctcctctgcctctacatgctgctcgccgcgcaggcgcagaccttcctcaacaccgccgatgtcgtcaccgccgtcgagaatttccccgatcgacgaggcaccgtcatcggcatcatgaaggtcaattatccattcccctaatccatcctctctctctctctctctccagatacaacctctctcatcatttctttaattaattcggttctttctaattaggcttataataaaaaggatcaaaataaatgaatagtactccagtaggcaaaagccaaaagcatacagattattattgaacaggctgctaccagcctaccaacaaccaacccaactgtggctcttccttgtgagatactattactctgtcctcttctcgaacactcacttgtttaagatgggtccctatgaatttcgactacatacatagtactggatgtgttgctgccttgatgcctcaaagcaacaaccacattttttttatgtgtcctgatcctggatgttgttgactttaattttggagcagagcagagcaaatagaatatcatatgggtagatcacaggaacttatagtgaaaaaggagtgctccagtttttattatcatgatgaacagcacaccagatataaggagggaaaagaaagaagagaacatcaaagactgaaaaaaaaacatgtattgtccactgtgttaattgaatcttgtgtgttttgttctttctagatgacattccagagtattgtacatcaagataataagctctaccgtcttcaaagaaaaacaaaatctttaccttttcatcccaaataatttcccttccttcttaccagttggttagcaaagcatgcgggtaaatttcaaggaactttgactcattgttgtggggggtgtcccaaatcccttttatggtaagccaaactcttggagtagtacttccttcacatagctcagtggtgtactaggccccaaaatttcaggttctggagtctggagtctgcaccaggataaattaactccatgaatgagtaatcgcaagctttaacggtttactccatttacgtgaggattaccagtttaatctgtaaattaaggagtttgtgggatataggaaatttgtgtactgtgctcagaaattattgcttccaaaaagacagcatgactgatgttagagtgctacaaacgtgtaggtaactactcctatttcagaagaacgacatctggtccctgctgagccatcagttgcaatcatcccatgcctgtctttttgttggattcatccttttcaatatttcatgattcattgacatgcttcctgtggctagtaagcttgatttacctcctgtcactaatttcccaaatattaattaatggaaacgtctgaataaagcttgtttgcatcatatatcttttggtattgccttgaggttttatctaattttatcgcggaatacaattatgtgaacttctgcacgtgcattgctctattagcctaacttgccttttatttgcttgagaacatggaaatctgaagtctcatttatttgtgtataatattttaaacctgaatccctgtacagaaaatgatttaggcctgaaactcattttatgctataagcaccatgttctgttctgttgcacaagtgtagggagatcttaaattcattttttttctgtacttttcaaacagggctttctgggattaagtggagcaatactggtccaagtataccgcaccatccacattgctcccagcactttcatactgatgttggcgatattgcccactgccatcaccctgctgcttatgtattttgtcgatgtccaccgttctgatcatcaacggtacaacaagaagttcatggatgctttctccctcattgccattactgttgctggttatctaatgatcatcataatctgtgaccaagtattgaagataataagttcagctgtgcagactgtttgctttgtgatactcctactgttggtcctgtctccagtggctattgctgtgaaggcccagaagacagaatcaatgaagcaagaagaagaaaccagggatcaagctgaaagaatcggactactccaagagcaaattagtacaaatgccagctccagtagcgatgagcgatgtcaagaactgtcgacaggcaaagaaaacatgaatctggtgcaggcaatgtgcaagctgaacttctggctgctgttcctagcaatgtcctgtgggatgggatcagggcttgcaacggtgaacaacatcagccagatcggcggctccctcgggtactcgaccaaggagacgagcacactggtgtcactctggagcatctggaacttctcagggaggtttggtgccggctacatatccgaccacttcctccgttcgcggggagtcggtcgccctttcttcatcggcgtcacgctcctggtcatgagcttgggccacgccatcatcgcctccggcatcctggcgtcgctctacgtcgggtcggtgctcgtcggtctttgctatgggtgtcagtgggcactgatgccgagcatcacgtcggagatattcgggctgaaccatttcggcaccatcttcaacgtggtggcggtggcgagccccgtgggatcttacatcctctcggtgagggtggtgggttacatctacgacatggagtcgccgccgggagctcgtgcctgctccggtaaccattgcttcgttttgtcgttcgtcatcatggcgtgtgtctgcgtggttggctctgctgtcgccttcatgctcttcgtcaggacgaggaggttttataaacgggttgtgtacgccaggttgcaatcttttctatagagagagaaacgaaccgattcttttctagcaaatgcttacctatcttttacaagcaacaggatttgatctgtacctgtacgtcagagaatggtagaaagcagaggcacactactttctgctgccatttttttcttgttgaaaagacatcattggactggtcactggtgttatatactactagtacttgtatgtatgcgtagaagtaaaaggaaaataaaacaatgtacagggaagaagctacagaaaacaaacagcatttgcttcgtcagaaaattatagcagagctgacttaacacaaagaaatcagttcgtgcaaccagctggctggggtaattttttcaagggaataggcttggagagctctgccttttatgctgattcagaaagtagagaatagttcagttctaagcacatgaaagctacattgttacagagtggatttgtcagctgacaactgtatataccagctgctttgcccctcgccggatgcggtacaggaggaaaaggcccaggccacagcgagagaaaaggcccagctacaagtatgcaggtccaaaatgggctctgtaatatgggccaaggccgggaaagtgaattcatctaaatagtcatgtcacctaaatagtcatcaaaaaatatgaaaaaaattggcaacatagattaatatgaaatatatctcttcacaaatatgcaagttttaattcaacttctacaagttgtaacaaaaataacaaatatagttgcgaatgcgtgataactattttcagtttaatttgttatttttgttgcaacttatagaagttgaatttggtcttgcatgtttgtggagtgatatatttcatattaatctatgttgtcaattttttctaaattttttgataaccatttagatgacatgcaaacaacgagaggatgtccccttgagggatgaaaattcacatctgccaaggccctgtaatagagctaggctatctggggaggccaaatccggcgacggcggcggtgggactactgatgtctggaactaccgtcgacacccaaatttataacactacagtagaattaacacaaatttagagccgagcattatgacgtctctaaccatccatgtgagatcaaagttggataaacaagtgcaatatttcaagtgccatcttcagatttaacgggccgaaggaggatattaaccctgtttgagagagcttcagaatcaaaagctcccccaaacaattcagcttttgacctagattctgaaaagctgtagttgtaaaatacaaaaaaataaactagaagccagaagctggaaaacccagcttttatatattctcagaaactggataccaaccaactgcttcttagaattttaagctcctccaaatagaccttaaggtattttttttaattcccaagggggagagaggcaaattaggagctgaacattctgatgtctctaaccactcatgtcggataagagtcggatagacaattgtaatattttaagtgccgccttcaaattcatcgggccgaaggaggacattaagattaaggtattgttcgtttaatttctaagagggattgaggaaaaacaattctatatcataataattatggaataaattatctttaaattatcctcaatccccttattgccgtatgggagggattaaccgaacaacacctaacgaaaaattttccacagctttaacaaaaaaaaagtactaacttaattgtgtggttgatttagaaacaatgatcagagcggcggcatttacacttgaaggtgtatatgccttatgcccttattattacaaagatggggaaccttattaatagaaagaaactatgacaaaaatatataaggactcaaacaattaagacataggagaagactatatattagtgaagtgccatgtcatatgcatgaagaagactgaaaaccactcctcgctctgtcctgacatatatggtcccgtcgatcgtccaggacgaacaactcctcgtgctgaaataatataaacaaacaaaatcgcaatcagtcaagacttgtgcagtaggatcagtaataaacaactttcattagtggagtagtatttgtcaccttaattaattactagctagcttgttaataaattatatggtgccattcgacttgttgttgactgtttcatccaccttcgtccctgcagcttcgtcatccttctctttctctttcgccgctttggccttcgccggctctctttcctccttcgccttggccgccgccgcctcttcttcctctttcgccttggccgactccgccgcctccaccttggccttgttcaacgcctcgatcagacttgccaggcacgcgtcggggtccctcttcttcccttggacgccttgggcatcaggttctccgccacgtccgccggcgacatgtcgatctccttcagcagccgccgtatctcgacgaacatctcgtgctgctccacgcccaggtagttcttggccagcaccttgaacgcctcgaaccggcagtaggacatctcgatgtgcacg

SEQ ID NO: 4740 - DNA, 1035 bp, Oryza sativa
gtcggtcacctcctggtggtcgtccaccgtgatctgcaccgtcctggcgtccttgcccaggtccgccctcagcttgcgcgctcgccgggcgcaggcgtggctcaggtaagcctccacggcgaggaagaagtcgctgcggcggaagcgctggtggccgtactcggagatggtgacgtggaggtaggggctgaggtagaaggtgagcttgtccaccatggtgctcagccactgccggagccccgcggggacgtggttgttgacgacgggccagaagaggaggacgctcaccaacgccgaccacaacgtcgacaccgatcccagattctccatcatgcccatggccatttggcgccgccgccaccgctataaaaagagatgggcaagtgttggaaaccagtgcctgcagctcctgtaggtgatggccagtatatatagagagtgcgctggtattaaaacattttctatagacaacttaatatatggtatttcctccgtattttaatgtataacaccgttgacttttcgactaacgtttgaccattcgttttattaaaaaattttatgcaaatatgaaaatatttatgtcatgcttaaagaacatttaatgacaaatcaagtcatagtaaaataaatgataattacataatttttttttgaataagatgaatgatcaaacgtttgataaaaagtcaacggtgttatatattaaaatatagaagtagtagtatactacaaatctataacccgtttttctcctctcttcttcacataactataaatattatatttgacaaacttatacagtccgcttattatagcctattaagtttttgatgaatattcttagtaatttcgctgcttggttgtgtcgttggtgaggagtacgtgacatatcgatggacggagatcgaatttgcagttggtcgtaaatcatcaagcgttatctgcagagaccatcatatcgaccgtcaataaaaactacaagtggcaaggaggatggattctaatctctcgggtgaacgtccaccctgagtg

SEQ ID NO: 4741 - DNA, 5058 bp, Oryza sativa
tcaaattcgacttctacaagttgtaacaaaaataacaaatcaaactctaactagtatacgtatattcacagtcaaatttgttatttttgttacaacttgtagaatttgaatttgaacttgtatgtttgtgaagtgatatattacatattaacctatcatgtcattttttttgaaaatttttcataaccatttagatgacatgcaagaaacgggtggacgtccaccctgagtgtttaaaactgttttccagtggcaagtgctttcctcatgcgtcatctgtccatccttaagttgtgcctgcttcgtcaaccgccctttaatttggtcatgttaatttcgatcttgtgcgataccttttatacgtgtaaatataattaatgtacctttaggtagttgtaacataacggtgtatttaatgaaacttttagttttggtttagaaaaaactaaaatgcaacaggtaggcttatcaatatgaaatggatggatggagtaaaaaaagagagtagatgttctgtatagctgcaggaccaccaaccaatgaaagggggggggggataccgaatacaagcggcgactggcggccagttgttttaagttttatttataacaaggtgatttataatcaatcatcaattaaaaagagagcgaatgtgattaatcaaacgacaggaattagcttagggcccatcaatggctctcctgaagagtggccgatcgactgcgatcctgatctagccctaagctgcgatcggcatggtgatgggcggacaattaaggaggacggcgactgcatgcatgcgtgaagcagctggagtacgatttatacttgtatacgatacgacgaggcagcgactgtgcatggccgaggtggcgggatctagcaggagagagctagcgcgcgcgggagaagatgcataggcggcgcacgaggccgcttaattcctgtgcgatctcgatatatatatatatatgtatatgctcgccatccgcatgcatcatcctcgatctcctcctaccccgatcttcatcttgttgttgatgacgatgacgtactatgacgacgacgatgtgtgtttcccccatgttgatgacgatcttcttcttcttctgaatgcatcaacattataagagatcaaaacataatgataacactacattataattaaggattaattagatccatcccattaaaaatttagcggttttaaaatataccattactatttatatatttgtattgatgccactatttgaaatcttagtggtgtcactgagatatgtattttccatgtattaaaaaaaataccctcatcttctacctctctctttcccatcttctacccctctctctctcctcgctgcgtcgctcgctccgccgccatcccatccgccatgccgctcattccgtccccgccgctcctaatgctgctcgcgatgccgccgcttaccaccgctgcagctcgctgctgccaccgcgtcgctgctgctgctggcgccgccgctattcaccgcgccgccacgtcacggctgccaccgccactgacacgccgttgagaaggaagagaggaggaaggagaaagaggaagaaagaagaagaagagaaaaggtgcagtttggtataatttttctagaaatacattcaagggtaaatagtggtatcttttgaatatgtgtgaaattataatggcatatttccaaatacatgaatactagtggcacattttaaaaccggtaaatttttaatggcatatatccaattaacgctatatataataatatttaataatgaggttcatttgaaacctgttaggactaaagaagttactccttgattcatcgtaattacaatatactccctccatccctaaatatttgacgccattgacttttttaaacatgtttgaccgttcgtcttattcaaaaaatttaagtaattattaattcttttcctatcatgtgattctttgttaaatatacttttatatatacatatagttttacatatttcacaaaaaattttgaataagacgaatgattaaacacgtttaaaaaaatcaacggcgtcaggagggagcattacagttcgtatcaaagattatcaaccgtctaggccgacggcaacaacaagttgctccctcacctgtattgtatgctgagtctgaatctgacacctggaaaatacaactctaagttttttctttgcaaccggccggttttctatatatattggacacaaatacgtttggcagtactattccaactccgcatgcagtactatctcggcccatatgtatatataggaatatactaggacacaaaaacaacaatctacacacaaattgatcgatggagatgacggcagcaatggagggtgcagcagccggcggtagttcggcggcggggttcagcttgtcggcggtggcgagccttctcttcctcttctctatgcttcaagagcacatccccttccaactccaggactgcctcgccgcactggccgcccgcctccacgccctcctctccccctacgtcaccgttgttggagttaatttatttctagaacataccagcctactctctaactctctctactactcatgaaataaaagtcaaggagcaagtccttcctctgtgaaatttctagagtagtgtagacaataatatgttctttgtgagttctagtattttcatgcatgtaccagtactagttgtgttcaaaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatcaacaacaacaactggtatcagagcgctcaggttcgagtagggcgtgacggagtagcacggcgtatcggtattgtcaattgaagctacaagtatggcttcaagttcgggcgccacaatggcgcagtctatggttcctgtatttgcaggagaaaattatgatatatggagcatcaagatgcggacgctgctgctatctcaaggattgtgggatattgttgagaatggctatcaagagtattccgctggagaaactcttacggcggaacagaaaaagtctttggcagaggatcggatgtcggacgccaaggccttgttcttgatccaacaaggagttgcggaaagtctatttccgcgtattattggcgccaagaaatccaaggaagcatgggacaagttgaaggaggagtttcaaggatctcagaaggtacttgcggtgaagcttcaaaccttgagaagacaatttcagaattttctaatgaaggagtgagagaaggtaaaagactatttctcaagagttattgagatcgttaatcagatgcgcctctatggtgaagatataaacgaccagaaggttgtggagaaaattttaatcagtctgcctgaaaaatacgagtacattgttgctgctattgaggagtcgaaagacatgttgactctcacaattcagcaactaatgagctcgttggaatctcacgaagaaagaaagcttcagcgcgaagggagctctattgaaaatgcatttcagtcaaagttgagcttcaggcctcaaaactcaaggtttcgcggaaattttcaaaaaaatgaatttccaatgcgagaccgtggttattttcagaaaaatggcttttcaaggcagaaggaagatggtcaagagagaagagaaaaaggtacgtccagttcaaatttgtggtgtgacatttgccaaaaatctagtcatactacagatatgtgctggaagaaaatgacctgcaacaagtgcaaaagaaagggccatattgcaaaatattgcagaactcgagaaattaatcgggctaatttttcacaagaaaaggaaaaatctgaagaaatggttttctcttgccatactgctcaagaagaaaaagatgatgtttgggttattgacagtggttgtacaaaccatatggccgctgatccaaatttatttcgagaaatggattcatcgtatcatgcaaagatccacatgggaaatggctctatagcccaaagtgaaggcaaaggtacggttgctgttcaaacagcagacggtccaaaatttataaaagatgttttgttggtacccgatttaaagcaaaatttgctaagtattgggcagcttctagaacacgggtacgcggtttattttgaagatttttcttgcaaaatattggaccgtaaaaataatcgtctggttgccaaaataaatatggagaagaacataaattttctattaaggatgaatcatccaactcaaatggctctcaggagtgaaattgatatttccgatttatggcacaaaagaatgggtcatcttaattacagagcattgaagctactcaggacaaaaggtatggttcaaggccttccatttattactctcaagtctgacccatgtgaaggatgtgtatttggaaaacaaattcgggcttcttttccccacagtggagcttggagagcaagtgcaccattggaactagtgcacactgatatagttggtaaagtgccaacaatttcagaaggaggaaattggtactttatcacatttatcgatgattatacaagaatgatctgggtatattttctaaaagaaaaatctgcagccttggagatattcaaaaaattcaaggccatggtggaaaatcagagtaatcgaaaaattaaagtattgcgcagcgatcaaggaggagaatatatctcaaaagaatttgagaaatattgtgaaaatgctggcatcagaagacagctaacggcaggctatagtgctcaacaaaatggagttgcagaacggaaaaatcggacgatcaatgatatggccaattctatgctccaagacaaaggtatgcctaaatctttctgggctgaagcagttaatactgcaatttatattttaaatagaagtcctaccaaggcagtaccaagcactacaccttttgaagcttgactattttata

SEQ ID NO: 4742 - DNA, 1136 bp, Oryza sativa
gcaggtcgactctagaggatcccctgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaaaaaatcttcgccttctttctgagtatagcccttagcaacaagccgagccttgtacttttcaatagtaccgtcaggcctaagcttcttcttaaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctacccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtc

SEQ ID NO: 4743 - DNA, 1972 bp, Oryza sativa
  unsure (1)..(1972): unsure at all n locations
acctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaatccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctattcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccgactgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgnnnnnnnnnnnnnnnnnnnnnnnnnnnnnnnnn

SEQ ID NO: 4744 - DNA, 9953 bp, Oryza sativa
  unsure (1)..(9953): unsure at all n locations
nnnnnnnnnnnnnnnnnnnnnnnnnnnnnnnnnatacattatatctccggacagaggaagtgtttttaaatagaagtcgttctagttctttttaccaggaacatacaatctttgcaaattactcgtagtaaaagctagttccaatgttctttaactcattttctcgtaaattattgaggtagtattttggcaataacacgtgcaatagcgtacaatcaaacctgttaagtggactgcttgcatgcggtgctagccgactagccgagcacacgttttgtctagttacgtacattcgagttatatgtaacctaattattctatagttatattttttaaattttcttaagaaaaattgttgaatgttcgctttttcttcgacgtgcgttccctcactcaatcaaaattgtaataaaatacaagaagtaggaggggtttaatcatgaatccattgtggaaatccaggtagcggtccgaaaagggcaaaagagcaaagtgagtagtgaaagcaagcgcatgttgattgggtgcgtgcataccacctttttactaagggatgtacaacatagatgcgtgatgtggatgttgttcttttttcctggctatagcctctcagtgttggggtcttgtattttttttcctctatcaatacaaaacgtcgcactatcttgtgcgtgttgttttaaaaaaggcaaattttgctaaaggacatcgcaattgttgtatgtatttagctcaaggacaccgcgaaagtgaacttttgggggaagacatcccataatcgtgaatatttgctgatggacaccgcgccgtctcctctccacttgacgtgctgacgtggcagacgggaggctattttttgacgcggtcggacgtaaatacccctgtgccttatctcctctcatgcactcggtagaaagagcagcggcagagccgatggcgcccggcgacgttgttgccgatgccggcggcgatcggtggcggttctgacgatgcggctaaaagagaaagtgtagagggcatccttgtgaatctataggtggtggttttgtgcaatatggtggccggaatagttgtcggcggcgacgcgagcggcagtgactctcggcatgacagtgcatgacgagctccggctcgtttccatgtgagtgagtacatgcgtgcgtggctataaggctcctggagactcactgaaggtcgtctgaggttcggcgatggatggacggcaatggcgaccttcgaaatgctccagcggcggcagagaacggcaggtcgacggcgtcggctccttctggccttcgggctgtcaaagggaggagggaaacgattcaaagaccatctgaggatgctacatgtgcgaggaattgtgccgaagctcactcgggagcgaggaatcgaaggaatgagccggcggccggacttgaggaagaaaggttcgatctcctcaacggcagtgcctcggatcgattcctccagtagacctccttctgggatgccggcgatgcttttggcgcagtggctcggtcaacgatggcttgagtcgacgggaacggcgaagcgacgcacggcggcgccctggacaccgagaacgccgacgagcgcatcttcatgtgcttgatctgcagttaattaggatgcaaggacatggctagatcaggtagaggaagtagttcacgttcccatggataaaatgcgacgaagctcaccagaggtctctaagattggatcaaacaccttcgggcagagaaatgaggagggtgttcttggagataaggcgcaggggtatttacgtccgaccgtgtcaaaaaacagcctctcgtctgccacgtcagcacgtcaagtggagaggagacggcgcggtgttcatcaacaaatatccacgtttatgggatgtcttcccccaaaagttcactttcgcggtgtccctgagctaaatacacacaattgcgatgtcctgtagcaaaatttgcctttaaaaaataatcatcttaggttcttaacccaacgcatgagcgcttgaaaactatgtaatgaagaggattaaatacgaagatataattaaagattttatttcaataaagactaaaagatgatgatttccagtagatcataaggttaatgaatgtgtgttttggggattaggatcctctgcattagagtacaaaatgcagagatgttacagtaaattgcattagaagacatctgcaccatccattcatagtcctatgcttgttatcaacctccacagcatgaatgcgatagttctagcttaagagcccctttgaatcacatggttgaaaaaatggaggaataggaaaacacatgattttgataggaattgaagtgtaaaacaaaggattgcaaaacacaggaaaaacacatgaatgatcgtttgattggatcacttttaacaaccaaatttggtaatatcggcatcgggaaagaagattagattggtaaagtcggaggcggagattgagttcgaaaacagagcaggaatcggctggagtccagataggctacgattaggatcggctgggtctgagtcggactgggtaagccgatgcagccagttccgacaatgcaacttgatgtatgatatcgggttgaattgaggcgcttcaaggtgattgccgcacatggatagagtcctgagaaggcaattgtatctattaattaggatgttttatgtaatttccttagagatatgcttgggtaaaagtctgccgcaaagacttgtggtatcttagagtttgttagagatagtagtcgtgtccgttatggacatatcttgtaattctcgggtataaatagacccgagccttatgtaacttttaacacatacgttcaatacaatctcggcgcatcgccacctttttgctttagttttatttcgacgagttcttactttcgggttgagctgcatcggtttcgatcttcaacaagaggtaaaacttgctatgatggattatgttctcgggattagtgcttccatctttatgatactctaatcttgtctatataattcgtcaagttatcatatatcttacataatcttcgacaatatcgtcatttaacttacaatcggctaacacctgtcaacagaaggcagccgattaggttaaatagcgatgttgacctagattatataagatatctaccactctatgaaacttccagcggcttgattgtctagatattgttcttcttttcatacttaaatgctgcatcagttgagtttgatctattaagtcgtgcttagaatatcaatctctagcctgccttctggtcgccgattagggtagcgtcggagtttcagccgatcttacctgatttaattgtatttgctctatatgcttcagcgatatgttaaatctgtcctttgtgtcaagatcttatttgcatttaagtatattaggtttttgtttgatatattatacttgtttcaatattctgatatagagtagtatcggagtattagccgatatacgctagatctatctgatcggctatgctataaacatatataaggctgttattaatatatatttcaatctaagtgatttatactgtctcgacatggcgaccgatctatcccaatcacttgatttaagtatatattgatataggaactatatgttgttaatatgtacagccgatcgaatagatttagttctttattgtctatttacaactgccgattgattaacatatgacatcggctcaaagataaatgatatgtcatcggcacctagccgatcggctatcatttatagatttatccgcggtttctttgtctctatttcttgttgattgtagaatcaaatcaactggcacgctaacacacccgaaggcgagttttggacctgcactagagttaagcagatctcccaggtctgtcaacaatcacagaaaaaacgcaggaatcgaatgagagagatagactcaaaggaaatctttcaagaggttagagctcttgctaagtctcctccaaaatccacctgcaatgtgtcatttcataggaactttataggatttggaaaacttcaatctttgaatcaaatggccaaatagaaaattttcctatatgatttgaatcctacgaaattcctacctaaatcatttgattcaaagagccttaaaaagtagaatattgttgctacagtaccccggatgatttgaaccattcgtttttaatctgagtgctcaagtgctactgcaaaacattgtagcaccttgctttggcagtacaaaccgcagaggatccagatccgtgttttggttatacgacttttgaatttcaggagcctcttttgaatttttgcactagggcctcaaattcgtagagacgtccccgcatttaagaaccatgttattcaatagatgcgtatatttataagttagctaattaggcaagtatagttaggtagtactacgccggagtacatgttagagtacgtgcgattacccctgaaaagtgttttccagtagttagttaggtagtacccatcgctacgtttggcactcatattgaacggtaacgtggtaaggatgaaaactggtcctcgaagcatctattctagcatccgattgcacacggcctaagccatgacatgcctcggcactaaggcatccggactgagcttttacttttcaaccatccttttatctgcagagatcgatcttgaccccggtttacttgctgtaatagttgaccccatctcttaatgttaatgcaactcctagcttgtttgtccccttcaccacattcaggatttagacaggaaactgatcatccatgtgtgctcacatggcattgcacgcacattgtatcttttaaattgttcaacgcactaacttcttaagatgtggtacatgatgtatgggaaaaaagaagaactagcagttgcttaattgtgcgtcattttcccgaaacaataaattggccgtcaatgtcaagattgcagtgctggagtttgtttcacacacccatcacaccaaggagcatttccagccaagtggtaagtcataagtagaagtacttgcgattcatagcagcatgacgtacgggatcccaaaatccagtcaccttttcatttgaattttagttagcatgaaaaccctagaataataatctaaatttattttgaaggttagaataatctaaatttattttgaaaggctagttagaatctaaatttgaaaattcatgagtttttagagctccatgaaatggacttcactgaccagctggtccacaccaaaccagaccacaagctaagatgacaaaaaaggagtgaaatttcaagtggataagagttcttggatgacgtggccgacatttgggacaccttttccttaggtggcactgatggctcctatcctcctgtgacccactagtctgtttgatcctacttggccttttttgtttatgtccagtagttttctcccagccatccacctaccaccacgtgtacgcccctcccacgaagcaaaattcgtaccaaataaaaactcctggaaaaaaacatttggcaaattttatctctacatttgacgaaattgtatttgttgctatctacacaaaatttcagtctgaaaacgaaaattactttgagagaaaaaaaaatggtaaaccatgtggccgggagacaagaaaagcgactcgatcggcacaaaagggctcacaaaagggacaccgagcgaaaacgagaccacgttccagactcaacccctactggttactccgtcgtcgccgcgtgcggaaaatgatttcgcgtgccaaattatgtggcatgaaaaataccctaaaaaaacaattacatatatttattcatatatcccgacaacgacccgtcaaccgttggggaagaggagaagctgaggatgggttcctctccgtggctcacacggataacgtccgacgcggctcgacgcgggcgggcgggaggcgataacgccggcggacttggatgacaaccgcgggccagtcgccgtcggggaatagcacaaatgaaatgttgccgagagagttttttttttttcatgcgatctcccgagaaaaaaaaagaaaaaaaaaacgtctttgctttcgtcgtccgttcgtgtccgttccggcgtgcgaaaaaaaatctggggatggcaccgcggaaacgtcgccccgggctgggcgtttttgtcgtggaaaacgtacgctctcgctcgcggcgacgcgacggctcggctgcaaatatccacagtagcatgcagttcattctgcaaatgggagtagcgtgtgtgtgtgtgtgtgttttttgtgacgctgcgtcgttctggctgggatgaacaaatatccgagattcttttgcaatggtggcagtgactgactgactgactgactctgttagttgaagacgttgctgctagggagagagcattggaaaccagggaaaaggggcgtctgtttgttgtgttttcgcggaattggtggtttgcacattgttttaaaggtgtcatggagttggaacatacttgtatgagttattgatgtgtagggggtgtttggcataactcgagatctaagagtttttaaactatgaatacaaatcaatagatctggatctacaattatattgataacttttgaatgaatcatttagatgaaatataaaattttaaaccactataatttaatatacaaacttcaaatccaatgcgaatttaagatggagagttatgccaaataagaccctagtatgtgtctttacgatgatattttccaaatttctctttttttttaaaaaaaatctgctgttcacgaaagaaaaggtaacaccatattgctttcaaccagtgatatctaggggggtaaaggataaagatgtgagataagatggactgcaaaactacgaaggtaaaaaaaagaagatgacgaacgtgctttaggaagttctttttttttttcttgcagctgctttactagcatattctttgcaagtttatattaaggccaagcgtatcaagtattataatggagtgaagcagcaaggcaggacttcaaaattttgctttataatgttgacatgattgtgactaactacaactagaactttatcagcaattgtatgtccaggctgaaggaagaggtaggcgaatttgtcttgccggtggtggagatgtcaaataatgaaaatcacaatgcattttctcctgcaagatgctccttcacaacatcaacatccattgcttttgcctcatgggtaaaagttcgacaagacaaactccatgcagtactatgataatgtttcaagatgtaagctgtacactacaatctatcccaagtagaacgttttccagttcagctgctatacagtgtcaccagtgacaaggctnaaaaatacaaagaacatcaagaactctgtggttgagtagtgtgcctatcttgaccctcaatctttgggcacagtgactcggtacccaccaaggatatcaggggacacaaagatgtatagggtcaataagcaactaggcaaagtaaacaaaagcagaatgcatcatctgattcataaattgcacaccactgtatgtgacattagggcgcctctatttagacaccgaatgctgactgaattgttgacctgacaccagatgataggagcgtagttctagtccaatctgcaacgtttttcttggcatctgaaaaataaccacaataaactcagagccatagttaaaagttcaagcagagtgcaatgtcttatatgccaggcacagatgtcaacatgcttgggtagcctagaagctgacttagacaatgggaaagctagaagtgatatctgaagctgacagaatgaatgtatttcctggcatacaatgtacttccccatggaattatccagttaaagacatccagagctatgaaaacacaagtacgtaaacagagaagaaccatctaaaactgatcagaataggtacacaaaacaatgatggcttcaggataaaggcaactggtctagattctagaacacattccaggctgaacatggtctgtttactaaatgaactgtactttcaaacaagatattgatgttgaaggttctattttctcagctaagacaatgttaaaaggacatgaacgcacagcattctgttgctaagtttaccattttgtaagcaaagatatagaaattcgtgcaattcacttccaatgcatacctgttctgtttctaactggctattttaagacaccaaaaaaaaaaaatcctctaacagaattgcatcttacatgccatgtagacttttctaacgagaaacacggaattctcttcaagagaagtctctcacctttgttgcacttggtgaagccaacaatgtttgctatgctgagactcaagcaaactccaacaacaagaaggtaatcagcatgaagtctgatgagtgagaatatcccaagaacaatccatgcagcagcctgaaacatggaaaaagcatgtttatttcaaatagccttcaaagaattacaattaccttcacagttagtaacctgttctcctagagaattttcttctgttccaaattattttctaatttgaacattattacagtaacaagaaaatgaaaacatgagcaactctacaataaaaggagcatcttttttttttacaaaacatggatataattgcttgacaatacgtcgtcaaacatgaacctgtgttaaaaaaaacacggatataatttttgtaaacatgttcctttttcaataaaaaaaacatgagcctatattgggcttgtttggcacaactctagctccagctccaccttagctccacctctggtggagctggaacttggccaaactgtttcagccccacctaaaatgggagtggggctgagtggagctctcttacaaaatgaactagagaggtggagctgggtttaggcagctccacaactccactctagacccaactcctggagctaagtttaggagttagagctctaccaaacagacccattgtttgacaatacctcatcaacatttatgtagtgttcacatgatgtattctgtatttgctttctcacagtttgccattatgggagctttaattgacgtgaactttcagttttgtgagtgtaaaactgtagatacctttatatgtaacactattgtagactacaattttttacaaaagcaaatcagtgaatcacagtccagattagtgtgttgggtcaactagcaggatatttatcaattgaagagatttctagccatccactatccctatcatgtaactccagcagaacaaatccttaatttcctagtgtttcatccagcttcaatgctgggtagctgaggaacacgtcagatccctcccagatgtaatcctctgcagaagcttcctgccctgcaacaaggatgccacatgcgctgcagggccacatggagctgaccaaagactttacgcttgccttgctccggtcgatgcttctaccggcctacgcagtctgtcctctgctctcgtcaatgcgtttactttctattttgcttttctcaagtgtcacttggtttatcagtgaatccatgaatgatttagtcttcctatcctgcaggaagccagctgcaatacctggtgcagcagccatgggaagaagggaattggggaatgtgagtttgctcgagatggatatggctaagggcagggagccagggattgatgactacatgctgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4745 - DNA, 1206 bp, Oryza sativa
  unsure (1)..(1206): unsure at all n locations
gtttggttaaggggtgagtggaatgggttggtccctgaagaggaatattcctctcagatccggaaccatctgatcggggaaaatgtggcggacgaactcgtcccacctgggacgagcgaacggcgtgacaacgccttcctaccgcgctcgcgctgttcgccctcgggagcaacggcagacggctcggcagacggcgacagcggcaggctcggcgacggtgaccacgcggggctcggcgatgacgaccgcggcggcggggcatcggcgatggcacggcggatccagtggtggggagggcagcggcggctgatccggcgatggggaggactgtggcggtggattcggcgacggggaggagcagcggcggcatgcgaggaggaggtcgaggggcggcggcggattcggcgatggggactgcgatggctcgcgaggaggagctcgcgggggaggagcggcggcggcgtgcgaggaggaggacgaggggcggcggcggatccggcgatgggaggagcggcgacggcttttcctcttgctcttgctcaccgccggcttttcctcttgctcttgctcgccgccggctcatcctcttgctcttcctccggcgatggggaggactgtggcggcagatccggcgatcggttgacggtgattgcaaacggtgtccatcccttccctttctcatcccttcaaccaaacaaaaaaattgggatcgtcccatcttacaaaccaaacatgtgattggaatcatcccaacccaaaaatcagggatggttccatcccatcccacttagttccgaaaccaaacactacctaagggatttttagagggatgtgacacattctatgacaacgaatctggtagggagtttgtctagattcgttatcctaggatatatcacatctttccaaaatctcttatattatgtgacagagggagtagttggcatgtcaatcctgaacattcctgtggattaactagtcatcaatcatgcatttgcacaaaatattattaaatattaaaattataatatttgttaaatatgttggttactccctttgtcccgtagaaaaccaatctaatactaaatgtgacacatcctactacgactttggacatactccctccgtcccaaaaaaactcaacttctagaatttgaattttgttccaaaaaaannnnnnnnnnnnnnnnnnnnnnnnnnnnnnag
